United States Patent 6,812,339 (POLYMORPHISMS IN KNOWN GENES ASSOCIATED WITH HUMAN DISEASE, METHODS OF DETECTION AND USES THEREOF) - sequence listing, part 63

SEQ ID NO: 16050 - DNA, 131379 bp, Human
ccttatgtttttcttctgtaaaatgggagcaaaagatcttaatttcactgtggacataaatgaaatggacggataaacacaaaaggctttgcaaagactaatgccatccaaatggcagttactgccatgtataatttaaaagagagcaagacaatggggagtgttagctcacgcctataatcccagcactttgggagactgaggcgggtggatcacttgaggtcaggagttccagaccagcctggccaacatggagaaaccccacctctactaaaaatacaaaaattaggcaggcatggtggtgcacacctgtagtcccagctacttaggaggctgaggcaacagaattgcttgaacctgggaggcagaggttgcagtgagccgagataacaccactgcactccagtctggatgacaaagcaagactccgtcttaaaaaaaaaaaaaagaatgaacaagtccaatcagccaggagttgcagagtacctactctatcatagagggatccccatcctcgttttgcagggtgccaggagttggggatacaagaatagatgcaaaataaacacaaaggagcacacagctgagggggctgacagagacttagggaagtacagtagcttgctcataatcccacagccgatcagtaagaatcaagatccgagcccttgtctgtctcaacccagggccagagctcaagctcctgagcctccaggcttgggtcagcacagagcgtgtgcatggcagctgcttaataattgggtttactacattccaaattgacatgtacagtgctgagctggaatcgactttacaaccctaattacggtgtgcctggttgtgtattcagcatttatttaaatagtattttttttcttaaatgttgatttctgaaagaggccttccccagctctctctatttctctcccttagctgccttggcttttcttttataatgagaatcacaccctgtaattctatgtttatatttacaggattctatgtccaatgacactgagtgcaagaagggtagagacccagcatcttttactcacctctttaaactctggcttatatatatagcctggtgcttgacaagtattcatgataggggttaagctgagtatactgttgaataaaaccacaataattattggtcgcaattctcttgaatgtcttctccagagcactaagtagtgtaacttatcaagtttcctttcttgcattggctgttaggaagctcaaagccatatctgcaaacccttcatagcaagtctgtaaatcaacaagagcatttatttttgatcctgttctcatttgatgttccaaattttgttcttcaatcttcttttgttatatgttatttcatgctctcataatctattgtatatgtccttgtaagacactttaaacaacatccttgcttgaattaaataaattgcatagcctgtcgaatttctggcctgcaaagaaaaagaatgccctttccaacatcatggtatgtctccagagcaataaaccaccctcaggttacctgatttctggtgtccaaacccctttgggaataaggtttacatgactaggggtagttgagtggatgagaagctatttccttccaattaggtggttaggtggtggtggaggtggtgttctgaagtcagcagacagaactacaaaatctcacagaacgtgttttccctgctctgaccatgacctacggttactggggaaggaaactgcttccccaggtcaacccggcagcctcagtaggtgaggggcactgggtagaatacttggggtgccagggaggcattaatgcgagaggagtcaggtgctcagtttttattggagttgggagggcagccccacatcaggaagagaacctgtttctgcaggacggtccggggagaagggaggactccacccaggcttgtgtttgccctgctctgtgtattcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggtaactgctttcagatcctttaggcatggctggagggtttgctgtttgtggtagacggtgtcatatagaggccaggggtcagacagggtcaagtttgatcccagctctgccttctgttcactgtgtggccttggatatgtgtaagcctcagttccactatctgtgaaatggacccaaagatagcactcatctcaaagtttttagttttacaaggagcaaatgacaatgtggtcagtgttaggcgcatagccacataaataactcctatttggtggaactattgagggtcatttcaagcacaggacatggggagaagtcactggatggagggataggctgtgtgatttggggatccgtcagggcaagaatgccccatagccgagtggaatctgagccttcacctcaggcattgcctaaagaagtgggaggacaagaaaaaggacttgtggagtgccttttgtgaatcttatttaacgctcaagaccaccctatgaggcagctgctgattcaaatcctggcttcaggacccctgctgtttacatctccctctgaaccagtttcctgcctgaaagagtgattgcgattagaatgcgggtgcgctgcagccataccgccagatgccagccccagctccaccctgggctggctgggtgccctggagcaggttccctcagccctctgggcctcagtttcctcatctgtaaagtgaacctaataacagtactgagatcaaagggctgagaggactctactgcccgtaaatacctgtgcacttagtaactctaagctgtggttcttgttttcgctgttaccatcgtctccattttacaactaggaacatgaagctgggtgaagagggagctgcatctggttccaggtctcatggaaaggatgctgtggaactggagtccagtcgggcctgggatgagggtgcagccagtgagactctcaccttgggcacgaaatgtaagggatgccaaaaaactcagtcatggagataaacggtatgttaacacaacatttttaaaagtcagaattaatggcaagacacccgtgatgaacaaactatgaacatgttacagaaagataagatcaggaacagcggtaattttgattttcacaaatttcatgttaaaatactattcatctccatggctgagctttttggtgtcccttacattgttcccccggagtccagggcctgatccgcctcagcctcctggggatcctgagctgatcacagcagcttcaggccctgggtgtatatactcagggtatgtagagggtgcttcctcctaaataaagacaacagacggggcggggcatgctaaagtagtttctcatttaagtgagggtgggggaacaaaccaatgtcccaaatcacagaagattctttttttccaaagagttctggaacccagaagggttttgtttttaggaaaaaggcatgagctttgggaaaagcaatgggcccgttaaagcccatggattctgcctgctttaccatgacaagagatgtggagggagaggaattgaaaaaggctttgggttgggggcgggggtacctttgcaccatgcaggctcatctgtcctgctggagtattagatgtgacttgattgtctctgtgtctgcagcttctcttcaagccaagtgccctgccctgaagcagttcaggatttgagtgcctgagtcacgtggacccaggttcaaaccccaggtgtgcctccccatagctttctgactgctactcttgggcaagtagaactagtaaggtgcctaccctcatggaggtgacgttcgtgagatgaggggatggcattgctcagccttggtttctttatctgtgcaatcagggaataatgggactctgcaagggaaaaggagacgatgtgtgtgaagtgcctggcaccagggtcagggcaagggtgaagccagtgagcacctgggggataaaatgcagggaggcgctcactctctgctgccgattctgcaccagagatggttgccttcctatattttgtgtcctgctatgctcaccctggtgcttcctggcacatagtaagcctccaattaaaattacctgcgattatcatgcacttaacaatgtttggtgcaataataagactatgagagcgagctctaagatttttaggattaccatccgtttgtgcaaacataattaagtactccgaaagcaaaacatcaatcaccaagcagccctaaaacatccaaggtgattttgatcaaggcacccctgcccctggacccacaaagtcccataccaggaatcagggcttgggcagttcagtgaggactggatttcagtttcctgtgtccccttgtgcaggaggcaacctgtagcactgtacctggcactcctgataatagctgccgtgttcctagcactgtgcgggcacacacacggagctgcaggactgtggggcaggcaaagcggggttgttctttcctcctgcaaggtctttactgatgttgggggcagagggctggttctgctgggtgtgccagcctggccatgttggcgtcaccctcagctgagcagtgaggagggcccctgggttacctacattccattgcattgatcgaaggtgttgcttgtttacttggtgactaattctgtcaccattccacccttcaaaaccaccccccctcccattcaacagtcgtctagctgcctgctggtgatgaagtttcagaagtgctttctccaggccagcttgcatggggtttggcgtttggcctgtttccaggaggagggcctattattaatctgtaactacaaggaggcgacatggaccatcaatcactgtgtaaaagaggagggatttgagggcagcttccaggaggccaattcactcatggatcagaacacagaactaactcaattataacaataataagataaatgaataatattagcaataactaacgtttactcacctgagtactgccaagccctggcgctaaatccttacagtgattatcagtgacccttcaattgttcaatcctcactttatttgatttatttatttacttattgagacagagtctcattctgtcgctcaggctggagtgcagcagtgtgatctcggctcactgcaacctccgcttcctgggttcaagcgattctcctgcctcagcctcccaagtacctgggattacaggcattgtgcctccacatctggctaatttttgtatttttagtagagacagggttgcgccatgttggccaggatggtctcaaacacctgacctcaagtgatccacccacctcagcctcccaaactgctgggattacaggcatgagccacagcgcccggcctaatcctcactttagattgtaccatatatattccttgcctagttataattttctcattgcaagaatgaatatgcaggaaatattttctattccatgttctattatattacatataaatatttcataaaactataacatcacttatacagcagaagagacagtagaaagtatgaaaatagaaaagttaaaagtctaaactctggacttgagtttgcgagggttaagtcctcattctcccacttactagaagatgatctgtattagtcagcttgggctgtggtaaccaaaacaccacagactaggtggcttaaacaacagtcatttttgttttctcatagttctggaggctggaagtccaagatcaaggttctggccgatgcatttctggtgagaccactctttctggctagccaacagctgccttcttgctgtgtcctcacacggttgagagagagacagagagagctctttggtgtctctttttataatgacactaattctatcagatcaaggtccacccttctgatttcatttagccttgattccttagaggccacatttccaaatgcagtcatattgcacgttagggcttcaacacgaatccaacacgaattttggaaggacacatttcaatccatagcatgatcttaagtgaggagtttaagttccctgggctcaggttctgcatctgtaaaatggggacaataaaaatacctgcctcggccgggcccggtggctcacgcctgtaatcccagcactttgggaggccaaggcgggcggatcacgaggtcaggagatcgagaccatcctggctaacacggggaaaccccgtctctaccaaaaatacaaaaaattagccgggcgtggtggcaggcgcctgtagtcccagctactcgggagactgaggcaggagaatggtgtgaacccgggagacggagcttgcagtgagccgaaatggcgccactgcactccagcctgggcgacagagccagacttcgcctcaaaaaaaaaaaaagaaaaaaaatacctgcctcatcgggttctgataaggaagctgtgagttaacacagagaagcattcagagcaatggctggcataaggtaggcgctacaaaaatattaggtattactactgctaatgtatggtccattttatttactgcttatactaacagcttatctctattcctcagctgctgtgcaccagccacccagttatacaacacatgggccacacccttctaatcttcacaggagctccacgcaaggaatctattatggtccttccctccacccctcacttctcagacacggagccagggcttatgcatatggccagggtgagccagaggggagcccaggcagagggcttgcgctatttcaccaccacagacgaatttactcacgtgcttttcagaaatgcagatccctaggtgacacctggctacaaacacgaggagaacatccccaagtccaggcactagagcagggcccctcaatatcagcactagcgaccctcagcaaagcagacaattcttcgctgggggaagggggcggtccttggcattgcagggtatgtagcagcgtccccagcctctacccaccggataccagtgcacgccccccaaagctgaaccgtgactatcaaaactgcatgcaggcatttccaaatgccccttcggggccaaaatcgctcctgactccagaaacgctgtgctccacttattgtgagggagaaacaaagaacagcatatttccaaggagaaaacgtttagcaaagcaatgtaagtcatcgaggaataggacaagatatccaaaatatgaaatatagatatatagtcctggaaaattggtaccaaaataaaataccctaaacattgtaaatatgttatatatatagtgtgtgtgagatagatagataaagtagatgatagatagatagatagatagatagatagatagatagatagatagatagatgatagatagatactcatcataaagttgaaatattgtcagtcgaaccatcatgagttgagtttgggacatctatatcactaatagctactaggtgctcgccctgccaggcactttcccatcacatttaccccttcgcacggtaccacgatgtatcaggacatgccactcaacctctctgtgctccggcttctcataagacaactgggaaaataaaagtacctaactcagagagttgttgggaggaccaagagaggcaaatatatgcaaatcagaactgctcagcacagagaaaacactctaaatgtgtttattattgccaccattatgaatactgtcattttccacaagaaagatactttcagaagggtcaagtgctttgcccaaagcctcacgatcgtgggattttacggatgcctgtctcactccagatctcttgttctcaagaggagagaggggaaccccagagatgcaggagagcgagactgcggagggcagcctccacccacctccggtggggcatctgggcttgcttctgaataaccagctggaaagcctgccctgcccgccagttctgggggaagggaagctggaggcccaggacagttctcttgatttgcaagctcacgaaacagtgcgtcagcaaagcagtgcccctagaagggttgtgagtgtattcaggtgcctgggtgatggtggtctgtggactccgaagcctgagctattcctccgtctgagaatccgtgggtttggttgtctaggtcagggtaggcagcagccaggagagttctgaccccaggagacactcactcactcaccccagaaatatccaaaacaggggctctcagccatggaaatcacctagagatcttgaaagtaccccgatgcccagccccaccccagagaatctgctgtcatcagtttggcaggggcctgggcatggggatctcagaactctgtgggaggttctcacatgcagcccagtctgggcatgggcccccataacacaggcaggaggcggggaagtgaaggggctttctcatctgaacctccacaatcaacccccagtggcaaagtgccaaaccctcaaacacaagtctaatttcaaaaacaacacccctccacccaccatagcttcgtatgtttaatgtaaaataaggtcataaagacaaaacactcatataatcagttcatgaaagaaagggcattttaacaccccattcaaactttttctttttcaaaaatgaaagttagctctttcaattgtacgtttatcatgaaaaactctatctgatttatttttctcctttttgagaaatgggagaaaactattacagacaagaattactgtctgaactgccttgagcctcagttttcccatctattaaacggggatttaaaaaaaagtctccacccaagtcattctggtttgcccagggttttccaattttaacataagagtcctgtgtcctagagcatcctcactcctggaaaaagcttgaagatggtcaccatcacactattttctataggtgtctgatcatgagaatcactggggcatttgctaaaaatacaaattccagggccccaaattgacttttcggtgagaggatcacaggaatcagaaatgttgctggattcctcggtagagtctcactaccgggcacctgtgggagaaactggcttcaaagagcaaggatcatacccgtgagagtcctactcatgctaactcttgcgcagtcctctttatgtgccaggccctgttcagggcactttgcttatattcactggtttgactccataccagccccttgagatggaggctataattatccccatttttacagatgaggaaactgaggcccagcgaggctcagtgatgctcagggattccaaactccagagcccacattcctatcctatgtgctacactgatgtctacatagagcttcagcactgggctggcatacggcaagctctccatacaagtcatatatggttatcattattacgagttccaggacctttggggcactgaaggagttgccatcttcttgccaactgtgaacagaaggcttcattgcaaaacatcaaaatgcttctttcagccttcccagttgtttggacctagtcctgtaggctgaattcatttctgctaatattgacatcagccaatagatggcagtaaccttttgcttttgtcccacccagatgaatcctgttctttaaaaggttgatggacaggcaggagcaatttcacgacacatgcattatatctgctggtggagagtgacaatatctgaatccaggttatcactgaaaaagacacgccattagattttccttctttcagggcccttcaccttgaagtggccgagaggctacttagggtgtgcaatgatcagaataatgtaaccccaactctgtgggaagaaaaatcttctctcctacttctgtacaccatgcgtcttccagcaccaaggtttttcataacctcaagtgttgattcaaagtagctttgttaggattgaatttacattaaatagtaagagctttaaaataaagcttgtaatcctactgttaaaataattttaaaacttgttaaaagctgaatttagatagagatactttgtgtgtatatattcttgcatgtgtatatatgaacgtatgtgtttgcgcgtatccttgactgagacatttaacctgcgtgcctcagtttccacaccagcaaaattgaaataataatacctctgtcttgttgaattgctgcaaagagcaaattagttttactgcaaataaagctcctagaagtttctcaacagatggtaagcactcaccaaatgttgttattgttattactctatcatttctatgattttttagagttgttgtcattgtttttatacacagtaggctcaaatcctggtaaactttctgtaaagagccagatagtaaatatcttaggctttgcaggccataggtgtctgttgcaactactcagttctgccattatagcatgaaagccatcatagacaatatataaataaaagggcatgactatcttccagcaaaactttatttatggatgccaaaatttgactttcatataattttcatgtgtcacattctatgattcttctaatttttttccaaccatttataaatttaaaactcatttttagctcactggcctactaaaacaggcagtgagctgaatccagccaccgctgttctttgccaaccctagtcttgaggattcaatattatattattcataatgtcccattaacagacagaagcgatgatctgatgcaagtgtgtgagtcacggattttataaatagaaaatagcacaaaacaacaagtgtcctacatgttttaacagtgctcagctttattatgtggtatgatcagaagacatacaaaatccccagatttggttatgtattaaattcctgcaagagaacacatggtgagatccatgaccctttttttggcctcctcaatatctaattgctcaatgcgtctactaccagggaataaaaactcacaccaatggcgagagatccacaagaatccctggtgactcattgactcctttcagccagaaatcaaaagtcctaatttttattccgagagccactagagcagataagccagaagctaggtctttggagatgggctacattggaattacatgtgcaaaagaactttaggtggcaagacagcaggcctttggagtggctgcaagagtccttgtgtagggatcagatatactaggagtcaattcctcactggatgtttgcccttggtgggtcttggaggttccattcctcctttttaagggaagctagtaatatgcagaacattccggtggttaggagcacagccagactgtgtttgaatcttgctcattaactgggtgacctttggaaaatgatttaaccccctcgagtttcggctacctcatatgaagaatgaaatcatgatacctctatctcacaggagtgctataggactacatgagacaatacaggtgaagcactccaaaattagagcttggaattgagaacatgctaagtaatgatttgctattatcatcattattattatatatcatacattattataacgaagctcttcagaggtttggtgatgatgtggtcatgtacctaggtctgtgcctcatatgtgagagatgctatcaatcgttattccctccattgactaacaataattaagctcccagtaaatgcaaacacactgctaagattaggagatacaaaattgggtgaaggtagacactgcctttgacgtcagggtgcttacaatttcttgtggaagggagacataaattaaatattcaactttgcccttcacctatgggacaataaccacattaacagtcatttcagaaccatcctacccagcagtgccacaacctgccatctcccatatgatcccatctcacgtaatgttattaattacttttattcgaccaggcgcagtggctcatgcctgtaatcccaacactttgggaggccaaggcgggtggatcacatgaggccaggcactcgagaccagtctggccaacatggtgaaaacccatctctactaaaaatacaaaaaaaaaaaaaaatagtctggtgttgtgccacgcacctgttatcccagctactcaggaggctgaggcaggagaattgcttaaacccagaaggcggaggttgcagtgagccgagattgcaccactgcactccatcctgggcaacagagagagactccgtctcaaaaaaaaattacttttattcataacttagaaccctatgcatttttgtttaataagcagatatgttttgcttaacatgagctagacattgttctaaccacgtcacaagcattaactcattgggtccttatagcagtcttatgaggcacagagaggctaattaactctcccaaggacacacagctacaaggggcagagagaggattcatgcccaggcagtcttgctctagagtctgtggtcataaccactgtgccatgctgccttgaactatcagaaacaacctcgtttgtggatttattgttcctatgttaactctctccctgtgcaccatacttcagctccatgaagtcagagggccttgcctgtttaatttacagctgtaaccctagtgcccagcccagcaacaggtgcagagctgtgctccatagacacagtcatacactgcataatgataccttagtcaatgatggaccacatatacttagtggtcacatgacattataatactatgtatttactggactttttctgtttcgatatgtttaggtacacaaatacttcccagtgtgtcacaatttcccagagtgttcaatgtggttgcgtgctgtgcaagttagtggcctaggaacgataggttataccatacagcctaggagtgtagtaggctatactatctatgatgttcatacaaccatgaaatcatctaatgatgcatttctcagaacattttctcgcccttaagtgacacatgaccatatgtgctaaatcagtgaaagcatgaatatatacccaagtaagtatataattacaagccctgctaaatgctatgaaaaaaaaaaggccgtagtgtaaaaggttttaataggggaattaatttagtttgagaatcagaaaaaaatattattatttcaattaccctcattctaaaatcctaatagctgtgactttaactaaaagagaaaaaaatgctatctacactgaatacacttttcatgatgataaatattttcccctagcaatgaaatgcaactgaaaattatgactgcatttaactttaattctgttgaatacatgagtccaaaatctcctttctatttcccaaaataaatataagcaatgatatagtttggttgtgtctctacgtaaaatcttaccttgaattgtaatcctcataatccccacgtcaaggatgggaccaggtggaggtaattggatcatgggggcgggttcctccacgctgttctcgtgatactgagtgagtctcgcgagatctgatggttttataagcatctggcatttccccagctcgcactcattcttctggtgtcctgtggagaggtgtcttctgccacgattgtaagtttcctgcggtctccccagccatgcggaaccatgagtcaattcaacctcttttctttataaattacccagtctcgggtatttcttcatagcagtgtgagaacggactaatacaagcaatttgttctgatctcagctgatgataatacagccatgggcggcttgtcaggcctctgcaccttagtagcacatgtagcttcgtttggttttgatttctttctctcttcctctctttctctccattataggagcaatgggtaaccaaatgagtgttccccaaagagttgaagaccaagagaatgaaccagaagcagagacttaccaggtagtgtagtaaccattacaggggcatcagcagaaaaaaaaaaaaaaaaaaaagaacttcctgtatttgacaagtgtgttgactgaagtcctggctgctgattgattgtgtctgtgtgtgcaagacagtggagcgaggataacctaaaaggtgtcagaatcagcatattaaattcgtgctccagccctgacttgacaaatgcccatttgagcctggggtcccctccgtgcgacgggtcagagcttcctgtgagtgtggggtcccctgagctgaggcaccatggtgtgctctcataataactggagtccactcttggagtgagttattttggttctccaaggcatgatagaaaactggggagtttctagaaacacagcctttaagttaagtttaattttttgtgagacacccttgtatcttagaggttcttccttgagttcttctgattttcccccgaagatttgtctcacaatgccacgtgctctgtttcaggacaacgcgtctgctctgaacggggttccagtggtggtgtcgacccacacagttcagcacttagaggaaggtcagtgctactctgggaagggcatctaccctctcgtggggaaggggggtctgcagatgctgtttacggtgaaaaaaaaaaaaaaatgaaagggtcgaagccgcaggctcagtttgaaaatacttgcgtttgttccttgggctaccatgccctggtggcttaagcaacagaaatgtattgtctcacagtgctgaaggccaaaagttcaaaataaagttgtcagcagaattggttccttctgcgggtcatcagggagaacgtgttccacgcccctctcattggcttgtagatggccatctcctccctgcatcttcatgtcatcttccctctatgcatgtctaaatttccccttcatcatatggaagcagtcatgttggattagggcccaccctaataacctcatcttaacttgatcatctgcaaagatcctgtttccaaataaggtcacattcacagggggttaggacttcagcatctttgggggcaatatgattcagccataacaacagatctcttctgagtgtgtgtgacagctggaggagactgaggagttacagcagataagataaaagcaatagagtgaaaacatgaagcttggcagacctaggttgcaatctctgccctgcagattactggctgtgtgacctggaacaaggcatctgcttttctcagcctcagttttctcatctgtaaaatggggataaaagtacctacctcacagaattgctatcaggattaaaggaggttgtttattaaacatttaacatagtctccagcgatatttcatatattccttttccccaaatgtgcacagcctctgccattatcagcacttaggaattcctcagaagctgataaattataaaagacaacagaattgtgtccacatgagggcagtgttaaaactgaggcatatacttacctatttgactttatcctggagtataagactgtatattcaatgcttccagggtggtcaggctctactatgtgacggatacatataaattatgtaagaagaggtagtatagcccagtagttgagggtaagaattctgcaatcagattgctagctttgccacgtactagctgtgtgaccttgagcaagttacataacctctctgaacctctggctcctcatctgtacagtgggaataatgacagtacttatagcataagcatctgatataatgaaagcacatattacagtgcctgactgataataagtgctcctatcattatcatattatggttatggttgttttctttcacatgtaagattctgggcttcagtttcctttcctgagtaatgaaggaggtatattatagcattggttccaaagcttttagaatttcctagggaatgtattaaaaattccatgccctagtctcatcccgtagctgctattcagaataccctaaagttggggactgagaacctgaactattgggggctctgtagaaggttcttttaaaaaaaaatcatagctttagggtacaagtggtttttggttacatggatgtgattatatagtggcaaagtctgggcttttaatgtacctgtcacctgagtagtatacattgtacccaataagtaactttcaccctcattccactcccaccctcccttctttggagtctccaatatccattatgctaccctacgccccggtatacacatggcttagctcccactttcaagtgagaacatgcagtatttggtttctgtccttaagttgcttcacttaggataatggcctccagttccatccacgttgctgcaaaagacattattttgttatttttatggttgagtagtattccatggtgtgtgtgtgtgtgtgtatgtgtatatatatattcaacacatccaccaccatacatagctacttttttgtttttgttgtagggtgtggtgaggacccttacaatctactcttagcaaatttcaagtaagcaaaacagtattattaacttatatttaccatgcaacttattcatcttatgagtgaaagtatgtaccttttgaccaaaattttccctggaccttagcccctgataatcaccattttactctctgcttctatgaattcaacttttttagattccacataaaagtgagatcatatagtatttgtctttctgtgtctagcttatttcacttatcctaaagtcctccaggttcatccatgttgtttcaaatgccaatatttccttcttttgtatgattgaataactattctgttgtgtgtgtgtatttacacacatgtatatgtatatgtgtgtgtccatatatatatttcctttttccattcatccactgatggacacataggtcattcccatatcttggctattgtgaataatgctgcaatgaacctggggctacagctaccactttgagacccttctttcacttttttagatatacccagaagtggattgctgaatcatatggtagttgatatggttttgctctgtgtccccacccaaatctcatttttaattgtactcccataattcccatgtgttgtgggagggacccagtgggagataattttaatcatgggggcagtttcccccatactgttttcatggtagtgaataagtctcatgagatctgatggttttatcggaggtttccacttttgcatcatcctcattttctcttgccaccaccatgtaagaagtacctttcacctcccgccatgattctgaggcctccccagccatatggatctgtaagtccaattcaacctctttttcttcctagtctcagatatgtctttatcagcagtgtgaaaaacagactaatatagtagttttattttttaactttcttaggaacttccatactatttcccataatgactacgccagtttacattctcattttgtcccaatttttaatcgggttgtttgttttcaattatcttcttatgtttaatatggagtgcaagggcaaggaatgaatagggaaaaattgttgggattgagaaagcctcttctctatccttctctccatcctccatctcactttctcttttctttcctctctcacctgtaatatatttatgttttttatatattatgcatgtgtgttaacatatatgagatacacatatgcataggtatatctcatatatgtgtatgtctcacatacatgtatgcacatatttgagatatacatatatatatgcatatttcatatatatgtatgtatattacaaagatgttcccaaaaggagggaaataggtttctcttgaaacgtaggacaacagtctgagacagcagttgccgtgtgaacacctgcacatgacgagggaaaagaaacacacatttctgagtcatgggttatttgtacctcgccctcacacctggcagtcttgctgtcaacatcctcagctactgctggagagtttgtaaagagtcccagttaatcccgaggtagcaattttgcctgttattcattgacatcttcaacctgtgaaacttgctttagagtgattaccccttttaagcttattgttgtcctcatgcagttttcctaaggttattagctaagttataattttcagtgcagttttaaggggtataaaagtgaaattctgggtgaccctttcttgtccttcagagagaattatttgaccatgtcttttgatgcacatttctattgatctctattggtgtatacatatatgtatagaggtatagaaaagtcattggaaaaatatgtaaatagaaatctagttgactgtttggtttctttttatctatacttttcctacttacaaaaattacaattaaaacaattcattggtgatacggtttggctctgtccccacccaaatctcatcttgaactgtagctcccataatccccacgtgtcatgggagggacccagtaggaggtaattgaatcataggggcatgtttttcccatgctgttctcatgatagtgaataagtctcacgagatttgatggttttataaaagggagttccactgcatatgctctcttgcctgctgccatgtaagacatccctttgctcttccttcgtcatctgccatgattgtgaggtctccccagccatgtggagctgtaagtccattaaacctctttcctttataaattacccagtctcaggtatgtctttattagtagcctgagaacagactaataccattggcatccaataatatttcctatgaaggcttatttagaagcagcaatggtaccatggctaagcaaacagccaaagaggctggaatgctacattgaatcatggctccaatatgtgagcttgggcaggtttctgagcttctttgttctgtcatctgtaaaatgggaattataataatgataggaccaaagcttctaagttattgtacggtttaaataagttgatactcctaaaactctcagaacagtgtctggcatgtggtaaacacataaggaaagttattctgtcttggatttaatgtcaattgacataaagactgccattgctatttgaagttaactgtattatttctgcctaacatatcttttggaactttaagatcaaaagttaaaactagtctttcctacatcccttatgccttgtaagtcttttatttgtctttcgatacaatgtgagagatatcaatcagggaaaatacctcttttaaactaaaacatgaaattacattctgtatcctcctagaaagaaatgtatcgtgtagagtgctttttcttagtaagagcaaaccaccatgggaatttgatatcaaacaaacattaagtaatacaatccatgtggattggagatctttctcaaaagtttggtattattattcatcttaagtaacaatatattaaaaaatcaaaatgtctcagtttttgcttatgttatatttctagcttaactcaccaattttagatgttatttgagtgtcccgttttggagtaggttgctaatgatgttaaaacaacataccatgtgatttacctgcaatgccactaagacaaacacatttgcttgcaaactttgggtgagaggcttatgtgcttgttctgccaaaatgcaattgtttaaattagtatcctcaatttgtctccatccttttcaaatagttgttttatttgaacccaaaaatatcttgagaattattagagcaaaatatctatcattagaagaacggataatccaattagggtatatccgtacaatggtctcgtaatctgtttgtactgctataacaaaatgccatagatctggtaatttataaaaagtagaaatttttttctcttagttctagaggctgggaagtccaggatcaaagcaccagcaggttcagtgtctggtgagggccctgttctctacttccaagatggcgccttgctgtgcccaccagaggggaggaatgctgtgtcctcagatggcagacacgacagaagggcaggaaagggactaactagttccctcaagtccgtttataaagtctataattccatttatgtggtctttgccctctaaactcaatcacctccttaaggcctcacctcttaatatgatcacatggtaactaagtttcaacatatgaattttgggggacacattcaggctatagcagatggtatactccttagcaataaataagaaggaactactgatcaatgcaacagcatggatgaatctcaacattattatactaagaaaaagaagccagacacaaaaggcaacatactacatgattccacttatataaaattctagaaagggcacaaatgtagtgacagaaagtagatcagtggttgctaggggctggggctggttgagacactcactgcagaggggcatcgagaaactttgcaatgatggagaagctttataccttcatcatggtggaggctacatgactgcatattttgtcaaaatgcactgaattgtgctattaaagttggtggattttattgtatgtgaattatacttcaatcagataaatctgatttttgtaaatgctgttaaggtacaatgaagttttttaaaaatcagcatagttggctgggtgcagtggctcacgcgtgtaatcccagcacttttggaggccgagacaggtggatcacctgaggttgggagtttgagaccagcctggccaacgtggtgaaaccccgtctctactaaaaatacaaaaattagctgggcgtggtgacacacgtctgtaatcccagctactctggaggttgaggaaggagaatctcttgaacccagggaggcagaggttgcagtgagccaagatcgtgccacggcactccagcctaggagacagacagagacctcatctcaacaacaacaacaacaacaacaacaacaaacaaaaaaaaaaccagcatagtcaaaagcagctcacatcaactaaagaaaaaaaataaattcaataaagaatggggggaaagatcatttgctatgttagaagggtgtcttctgctcaaccagttcttttgcttcctctggattcatcactgggggcaggaggagtctgcacaaaagaaagtaatgtgatggggaggtgttttgtgaagagatgacatctcttagctattttgtcagcccattcctcccatatactgcccaagagagggagacctcaggagactgtcatctggtacctcttcacctccccccaatacatgtggtatgttaatttattgcatctcattgaatcagacaacttcaagtaggaccacacttcacagttgagcacatcaccctcctgttgcgtacagagatcccctgttttgttcacatgcaaactttggtggattgtgaaggagaaactcaatctcccatggctcagagatcaggcagttagaaaggacagaacatttagtcccacacaccactgtcaggccacacaaaattaatcatcctagaaagagaatatgctgttccatttagtgaaacattaccacggaggtgccacaacccctattaatatgcaacaatcactttcccaccaataagaaaggagaatgacggctgctccttacctttttcactcaaaagctaaaaagagaagagaaagcctaagcctagagattctgggaaggaaatacctaaaaaggctttttaccaccttgagaatatagttgttttctagtttgtttctttgcaaaagacccacctaaagagatagatggccagtattagcataaaaccaagctctgtgagagtgcagctaatgctgatgtgatttagttaacatttgttcttcaataacaaaaacatagttttaaaaggcacatatgttctcaagggggaccccagagtcatcttctcactcaagcagagctgaggtgttggggagggacgcaaggggaggcagagcgtggacggccagggcaaagaaggcaggtgggcaagtgagatgacacgttggcctcgcaggtgacatccaggactagacgaggtaatgcattaagagctaagcgcatcccattcatgaaattgtaatatcactgacgtgtatctgtgtatgtactgtatctgtgctctatacgtaaaaagaatgagttttgttcatcctctcccatagaaccattttcgccctcttgggattaataccatccccactgagagtgcatacactagggagtgcaacttacttatgcaatttcttcatgtatgagaccacagagtattatagctaagagtccagcacaaggcacggtgcccttcctcccatcaaatgctcacatctaatcttcagcacctatgagtatgtgaccttacatggcaaaaggacttggcagatgtgactaaggaatgtgagatgatgatattatcctggattatccaggtggacccagtgtgatcacaagggtcttcatgagagggaggcagaagggttggagtaggaaaaggtgtgattatgggagcagatgtcacaaagagagagaggcttaaagatgctacactgctggactggaagctggagaatggagccacaagccaaggaatgtaggtgacctctggataccagagaaaagaaggaaatagattctcccctacagcttctagaagctgacccatttttgacctacaggcttcagaactgtaatatatttgtgctggggcatttgggataattcattacagcaatcggaaatggaaccatatcctctcaagcattggactctaacagacccaagcataggttttggctctgccactcactagctgtacaaccttggcaaggaagtttattctgagtctcatctgtaaaactggaataatagtatgaactttgtaggggagctctaaaaacagcagctggcacaagataaaagtgctgaaataaaggagtccgggcaaaactaaaagtagaggctattgggatgggtgcagtggctcacgcctaaaatcccagcactctgggaggctgaggtgggaggattgcttgagtccaggagtttgagttcagcctgggcaacatagagaccccatctctatttaaaaaaaaaaaaaaagtagaggctattttcatacttattctttaccattggctttccctgacatatcacctgaccagattttcccacctgcatattatttatgcctaaaacttcatagatctttggagaaataaaaatgcctgatttttggccttctttgattcctttctagcaaatttatgacattagttctcaggcctcactgctaacgtatggcagagactaagacatgccttccctgccaggacacgtcattttccagaaacagaaggaatgtttgacctggataaaaggtttctaaaattagtattttccttttttgctcctagtcattgttcctaaaaagaatagactaattttgcttttcttaaaaaaaagatgtaagtggaatcattttattggattgaaaattctaacttgagaaaagtgctcctgccaataacataatgagtgagaagagaagcatttgccaatatcaatgcctagtcaaagtggaatgggagacctgatgccaaaaagcatagctccctgatgtagtaaaaaatataggcaacagcacttgtctggaagggagcaaatacatgtgttctcctagtgtccactatttccctccaattgatcttattttttatctgtttccaaactcaagtaaaagtccctgagagcaggacgcttgccatcctttcttgttatgagggtcccagagctcagcacaaggcctgagatacactaaagacttagaaatggttgatcaatgaacagtggcatattaagccagtggtagcagaggaataaaataataaggccgaagggcaagttcccagactctgctgcactcagcttcaaggaatgcaaccctggataagtaaatagcacttttaatttgagcaagaagtctggaggtggcagttctaaatttggtacagcagtctgacagcctcatcaaaacaccaagtacatgagccaattgtgtcactcctgctcacaagatggctgtcacagaaccaaacatcacatctctacatcatgggatccaaaagcaggagaggaaaggccaaactttgccaccatttttttttctccttgtattatgcgaggaaggaggatccttccctgaagcctctgccaccatgtaggcatcctcttattggccagagctacatcacatggcccataccagctgcatgggatactgggaatcaagcatctctttgagatgcaagtgaataataataatacatggttggggctggagacgattggctattgggcaggccacaaacagtgtctgccagaggtgattccaaagaattattagaattgagcaaaggaaagtagttcatatcctcactctggcctttcaaaagacattaaggagatctaactcacatcctaaacaccacttttctctctcctcacattgctatatgtctctcactcaagaggctccctatcctcaactctccaccttgaaactctgtgagacaccccatcctcatgaggtaggggaatagggtctggaggcggggaagctaaggacttcctagaactaaatcaagcagaaaacccacaactttctatgctcaactatggatgtaactgcacttcagctatggcaggaaatatcctcttcatttgcatagggtgtacaccaagtaaataactttgtaacttcccttcatcctcttcatttacatagggcatacaccaagtaaccaatgggaaaccactagagggtatttaaaccccagaaatttctgtaaccagcactcttgagccacttgctcaaacctgctcccactctgtggagtgtactttcatttctataaatctgtgctttcattgctttgtgcattttgtccaatttttttgttcaaaacaccaagaacctggacaactctccactggtaacactcacaggcactctcctttcttctttccctccattgcactgtatcaccactgagtctaaagtaataacagagagttctgaacactggctctcccagatggcccaacagctccttgtgcctctgtcttccttgggagtgagcaagagccctggggaaatctcatccttctcaaactcagtgctttttctcaccaaaaagtctagtggagaattcctgttagataaaattatcttccctattgcattattgtggttgatagtctccaaagatgcacacatacaacccaccacgcaataacccatgcttcctggtattcacacccctgtgtagtcccctctgggctggtcctatataaccaacagtatgtagtagaagggatgacacaggactttcaagaagccttttaagaagactcggagcttctgccttgtctcttgcaacactagctctgagaaaggctagacacaatatcagaagttctaccctgagattgccatgctgtgagagagcccaagctagtcacatgaagaagccatgaggcaagagagaggtacccagccagttcccaaatattccagccatcccagtccaggaaccagacctgtgattaaagaagacatcatgggcatttcagctaatagatgccgtatgaggaaggaccataggaaccagcccatagccagaactaaagctccagacatatgtccctgtgtgagccgtcccagccatcttcatcctttcaaggcaccccagctgtggctccagacatcatagagcagaaataagctgatcctatcctctctctgcctgaattctttttttttttttttgagacagagtctcactctgtcacccaggctggagtgcagtggcacgatcttggcttgctgcaacctccacgtcccagatcaagtgattctcctgcctcagcctcttgtatagctgggattacaggcacgtgccaccatgtctggctaatttttgtatttttagtacagactggttttcaccatgttggccaggctggtctggaactccttgacttcaggtgatctgcccatctcagcctcccaaagtgctagaattacaggtatgagccactgcacctggcatctgcctgaattcttttttttttttttttttttgagatggagtctcgcgctgtccaccaggctggagtgcagtggcatgatcttggctcactgcaacctctgccttccagcttcaagtgattctcctgcctcagcctcccaagtagctgggattacaggtgcccgccaccacacccagctaatcttctgtatttttagtacagacggggttccactatgttgggcaggctggtctcaaactcctgacctcgtgatccacccaccttggcctcccaaagtgctgggattacaggcatgagccaccgcacccggccctgaattcttaatgcatggaatcatgacctaataaaatggtggttaagtcaatcattttggggatgcttgttacacagccatagataactgaaataactattagtatgcattttaattctttgtattttatttttacatgcatatatacttacatacataccaattaacatatatgaataaatgcaatcatattttctgttattgttgttttggtgaaacctgtctttttctttttcttattggcttcttcctcatctcacatcttccctaccccctccaaggacacccaagctaacaacctaatatttcttctttcatatttttctctttgttctatactttgtaaaagacaaatctgagacacaataaaatttcaaagagtgtatctgaatagaggcaattcattaatttgagaaaagaaaaccaaaagggaattagtgttttgatgacaaagcattacatgccagaattaagggaaaatgcagaggcataatataaaatgtgtttgatgtgttacaattacacagttgccttatttgatcatctcattggaaggtacccagttatataattttaagtttgttgactgtttctgattggttgagctcaagttctgtttttctttagcataggcatttacaagaaacagttcgagttgttttgcttatgtctgcaaatcaagcaaggtttagctcatttatgtggtctaacaggctttgtccgctcagggattcttcaggtctggtctttattttaatttactttaactagccccatacagacatttcccagcacatccattaatagtgtttgtttttttttaattgtaataatcttccccatctcaactccaaattcaactggtataactttaattcattttttttaaagctacaatgtacttcaaggtatagacatactataattcattcagccattatgctaattttgggcattcagtttttttcttatttttctctgacaatttttacctgggcgtaagttttttgttttgttttgttttttttttttttttgagatgaggtcttgctctgtcacccagctggagtgcaatggcatgatcatcactcactgcagccttgacctccagggctcaaggaatcctcttgcctcagcctcctgtgtagctgggatcacaggcacacaccaccacacctggctaattttttagtttttttgtaaagatgaggtctccctttgttatccaggctggtctcaaactcctgggctcaagtgactgtccctccttggcctcccacattgctgggattagaggcacgagtcacagcactcctctggcataagtatttttaaactcgtaatgtttatccaatattaaaagttatttggaatacacttagaaaatttctttttttctttttttttttgagacagagtctccttccgctgcccaagctggagtgcagtggtatgatctcagctcactgcaacctccgcctcctgggttcaagcgattgtcatgcctcagcctccctagtagctgagattacaggcgcgtgccaccgcatctggctaatttttgtatttttagtagagatggggttgcactgtgttggccaggctggtctcaaactcctgacctcaggtgatctgcccaccttggcctcccaaagtgctgggattataggcatgagccaccgcgcccggccggaaaatttcttcttcacatttttcaaaaataaaacattggcatttctgttttaaatttttaaggacttttttgtacttaccatgacagatactctggacacaacttactgttccatgactcatacagtctgattttaactgtcatgcaactgctgttgagtaatatgcaactttctctttgcctctttggatggagaagaaaacaaggcagcacagttgggctccaaagataaaaacatgggcagggtttcaagatcactcatctctgtcttggaggatagaccaagagagataggacagaccaagagacaacatgaaaaaaacatgaaaagagaaacagcattgagaaataacaacagctgcactcaattcttttcctcaaggtgcattttaaccagatcttgaaatagaataaacacacctacaattctaatcctagagtggacatttttttaaaatcagcttttcatatccttttaccacaccaaaaagaacttaccaacaattttcatttaacaaaaataaaaataatcagcgagatcaaagaaatggtaaggtgcgcttcaagtttctggaagtttatcaataaaagcagcatactgtattagtgggtaggatccattatatgcaaagcataccccaaagagcaaatgtttctgggaacaagaactgaaaaatgtaagcagagcctgcctccttgtgtgggtgcaatagcagtgcccaatagcagtgactcgcagagttgtccctgggccagcagcatcacatcacctgggtaccggttagatgtgcagtttctgtagccggagcccagacctcctgagtcagaaacacccccttccctgggggtggggcccagctatctgttcccacaacccctcccgggtattcttgcactagctcaagtctgaggaccatgtaagaactggctcaaggctctgaatgaaatggagtttgcagggaactggaaagcgtccttgtttatagggctccacacagcttcaaggatggctgccctgggaaaccctgagccaataataagatatttcaataacagcctgattttaggacttttaaatgaaatttcccaattcaaaaaaatataaacactgtgttggccaaaccatcagcagacctcatagttggcaacctccgatagtgtgaggtttatttttttccctacctcaaatccctctaaaaagatggctataaaaaaaatcatcgtcatcatcatcatcatcatcatcatcatcaagttatcatagcttcaagcaatgaaacattgaaatcctgtaaccaatttcagctgtgcttgcagatttgtgggctctccaggcatcctgcccgtcacaatgtgcatcccatctgtgttttccacagagagggacagtggtgggatgttaccagtggctggccccctttgcagctttctgtcacgtagtcttaagccagtaagttggctatgtggttaattcatgagtcctcttaaaaatgccttctgagagttacatcagctccaggtgatataaaaagaaaagctggattttctgaatttgccaagcagaggctcagactctgcaacatggagatgtccctaaggccatgacactctcagcaagcagggcccacctggcctatcagcccctccattcaaagctgatgctcattggttagaacctgcctcgctgctgggccagccccaggcaaattgggaaataggtcaagtgttcagtccactttgaatcccacctctcatttctagttccctactttcattttttcttttcattatttcttcatttcttaatggatggggtaggtgcatacacatagcaaacattctgagcgatatacataataagataaggcagagaaaaaatccccaccctaactctgatggctccccaagccccatcccaaatttccttccttagaagtaaatactttacagtttcttatatccagaggtatcccaggcatgtctatttataagttgtctcctcaacctcccgacaccattttttaaaaacaaatggaaacatactgtacgtgctgttgggcacagctttttctttccttactaaaattccttggggaattttaatgcctgtggaatatttcattgtagggacatatgattatttatttttttaaacttttatctaggttcagattacatgtgcaggtttgttataaggtaaactcatgtcatgggggtttgttgtacagattattttttcacccgggtactaagcctagtacccactagttattttttctgatcgacttcctcctcccaccctcaagtaggctcagtgcctgtcattcccctctttgtgtccctgtgtcctcaaggacatatgataatttatttaaccaggtttctactaataagcgtttaggtcatttccagttttttgccacaactacagtagtccagcaaatagttccatacgtaagcctttgtacccctatgcaattttatttctaggataacattttagaagtggaagttagacttacagtgtttgtgaaattttaagtattaatagatattactgagctattttccaaagaagtggccaaattacactcccaccgacgatctatatggctgttcttttttttttttttttttttttgggggagacagagtctcactctgaactctgttgcccaggttagagtgcagtggcacaatctcggctcactgcaacctctgcctcccaggttcaaatgattctcctgccaccgcctcccaagtagctgagattacaggcgcccgccactacgcccagctattttttggtgttttgttttgttttgttttttagcagagacagtgtttcaccatgttggccaggctggtcttgaactccttacctcatgatttgcccacctcggcctcccaaagtgctaggattacaggcgttaagccaccgtacccagccacagctgctctttttttatacgctttccactggggtcatcaattgtctcctttttaaccaatttggcaagggaaagccaagtgtcataattttattgtgcttttattttactatttatgaggccaaacatcttttcttctgcttaaaagctggctgcatgtcttttcctgtgaactcttcactcctatttgttgtctgtttcctacccccaccccttggtgctgtgttgctgtttatttatctaattcttctttttacaaattgaggtacaattcacctaccataaaattcaccttttagagtgacaattccgtgattttaaggatatttgcaccatgtgtgcaatcgttccacgtctaattccagaacatcgtcattactccaaaacaaaactccctaccctttagcgctgagttttttccctattcccagccactggcaaccactaatctgttttctgcctctatggatttgcctattctagacactttatataaatggaatcatacaatattttgctttttgtgtctggcgtctttcacttagtaccatgcttccaagtataaagcatgatataacatggatcggtgctttgtttcttcttatggctgattaatactctattatatgcaaatgctagatttcctttttccaattgatggatatttgggttgtttccacttttcagctattatgaaaatgctgctatggacatttgtgtacaagtttttgtgtggccatatgttttcattttcttgcttacctaggaatggaattgctgggtcttagggtaactccatgtttaacttttccaggaactgttaaactgctttccaaagcagctgcaccatgtcacattcctaccagcaatgcatgagcattccgattttttcacatcttccctaccactggttattgtctctctgattatggccatcctcgtgggtgtgaagacgtatcatgctgtggctttgactgcacttccctaatgagatgacattaggcatctttttatgagttccttggccattagtatatctgctccaaagaaaacactatcatcctgatttggctgctttgctgcaccctgagcctcttgtctctgtttcctggctaatttttccagagtctcaaagtaataatagtcaccctttggcaatcttctatgtgtcctgaactcaacctgccccacaaccgtatctccacagctgacccgtggtgtcctaacaactgaagccactgatagaataataggccacctcccctggtaagctgcttaccacttaaaaggtgcttgagacactcattgctgctggaaatgtgaatctgtagagcctttttaagaaaataatatggcagtgtctgtttttcaaaactaaatgcatattgatttgagggtaacacttctacatctgtgcctctattctatagaaatatagcaccagtttaggatttttgaacacgaaagtttattccactatagtggaaatggaaaaaacaatgtggaaactaccaggatattcattgattaggcaatggtttaaatatcttttggtatatccatactgaggaatattatgcagctattttagaagataagatagctttggagctattgactgtgaagaccaactataatgtacaaaagtcatcagaaaatatgtctaatgtgatccaatttctataaaaacaacaaggacagatacagtccctgtatatgtgtatctgggatgcttatacgtgtttgtgtgagtataaacaaagttcaatatgccacatcaggttgcagatgttatttatctggcaatgagggtggaggatagagacaggaaaaacaaagggttcagagagattaattattttggttgtaaacacgggttaaatgtacattattatcagatttataaaaaaaatcaaatgaaacatctgatttgtctttaaatgaaaatatatgctcatgttggagcaaaggctggttttgcatttgaatgagctttgcatattccagagttttgtagcacatgaatgacaggaaatatatgattaaagagaagagtggaaatcttgagtgtcactgtcagtcttgccccacagtatctgatcatcactgttgcttttagaggatgttttctgaagagcatgggggtagtagtacctttgcctacattcctttggaatccagcatttccatcactaaatgtccagacatgttgtataaagctgatagtcaagaattctaccatgatgttccaaaatcccatccttttcttttatttatgctagaatttcttggcaaagacattctggctttttaatgtacagatgaaaagcatgaaatgcgatcattcagtgaaagtttcaaatctaatctaacgtcttcctccaagtcataagtatctgccacgtgtaccctgactttacgacctttaaaacaacaaatgcatttgcacaacatagaaagccgcagttgtttgaagtgtcatttgactcttgcagcatgaccattgaagggtcatttttgcataattttttgaggtcttcataaagttttgagttttcccaaaggcctaacataatcttttgatattctaatataactcttttgaagaacttactgtgttgtgttgtccacttttccttcttcggtgatctgtgttaactttgccagatccttgtccaaccacggtcatgtgtgtgatctgagcagctcaccaatgttacaagactctataaacccctgcatcttttgcaagatgtacaatttccctttgcaattagtgtgtatatgtccactttatcctgaatcctgacagatcaggatattgatgcataggacggtgttgcttgcataggaagagatgattcggcggtgaataatgttcatacatggacactttgtaaataaaattataatgatagttcctgctttcccctttaaactgaaagcttggaggatttggataatgtattgtcagaaaaagaaatttcatccagcacaacattagtctcttctcagagactcagtttcccaacctgttcattggtgtgccctactacagttacaatcatggtcctttgtggagtgtttgctaggctgtgccccaagctctgtgcttgctgcttcacccatgtttcctggcttaatcctagtgtctagcactatgggaactggaatccagctgtaagcagagcagaccaagtccgggtccacttggggcttacaggtcgtggagaggaaacaagtgaagaagaaattaatgggatcatttcagagagtgatgaatcctctgtggagtctagagaataaacaggagtaagcaggaggggttacttcagatggaggagtcagggaaggcctgacataacctaagtcttgaatgataagaaggtaaccataggaagatcttagcgaaaatatttccagattgaaagaataactagtggtgagggctgcaggtggaaacatgttggtatgttgagaggtgtgaggaaaaacatagtacgagctgaagttctggagggtgtggcccatagtagagagtttggattttgttttaattttgtgaggcccttctttggatggttttatgcaaatgaatgacataacctaatttttatttaaaaccaaaaatatatagatatcaatgtttcccagatgtgagaaaacagggtttttttccccctcttgtacatagttttttcttgggtatccactaattctattaactaaactttgtctactttgttcatcttccctcccttctatttcttctttctcttctgttcctgctttggttaccacatgttgttgggagtttgaactttggaatcaggcaaatgtgggttcaaatactaaatctaccagtcattagctggacaacattagaaaactgacttgacttttcagagcctcagtttcacgacctgtaaaatgggagtgatgatagtacctaacttgtagatttgctgttatacttaaataaaatgtttcttgttatagacatttatccaaataaataaataataaataaacaaatgtcatacataaataaaatgcctcttgttacacacatttatcctaatgctgggaaacagtcaatgaatgttagctattgtttttacagcttgatgtcgttaggctttttgtccccacccaaatctcatctggaatttaatccccataatccccacgtgtcaagggagagaccaggtggaggtgattggatcatggggacagtttcctccatgctgttctcataaaagtaagtgagttctcacaagacctgatggtttcataaggagctcttccctgttcatttggcacttctttctgctgccttgtgaagaaaggtccttgctccccctttgacttccaccatgattgtaagtttcctgaggccttccctgccatgctgaactgtgagtcaattaaacctctttcctttataaatcacccagtcttgggcagctctttatagcagtatggaaatagactaatacacagctgtagcaagtgaaagttttagctttggcacatgaaaaaaaaaagataattcttcctcagaagttttgaatattgtaatacaaacgtgtgtgtgtgcatgtatgtttaaatatataattagaactctgatgaagcagcttgttttgacgagaatatttggtactttgaaaatgataaacatttctgaaacttgcctggcccagatacttatgtttcttaagataaattgatttatatcactactgtttttaaaagtctttctagaaaactcaagtttgtaaattaaactattggaataattcctttccttatggcttacatttaaaaatacaaaatggtaattatattaataacatattagtataacaaaaataactactgtttaccgaataccaatcatctaccagcctgtggtaagcactgtatgggcaatatttcatttaatcctcagaattaccctctgaaggaggcactgttattttcatgccaatttgtaagaaaactgaggcacagagacaggaaataacttacccgggttatccatttaaagagtgagcagttaagagtcaaagccaggttcctgtgatccacaatccaagttcttaacaattacacgaagatggcactggaaataaggttttaatcacatatacagataaaatgactttctttaaaaaaacatgcagcacaaaatatttttctgcactaagaaaatcaaaattttcaactctaccttctaaatattttggagctgctactgtcattcttgatttctttttaattttccttaaattctttgacttttttaaaaatgaaaagtaacatctctttggtatgtcatctttttgcatttttttaacttttattttaagttcaggggtacacgggcaggtttgttatataggtaaatttgtgtcatgggggtttgttgtcacccaggtatcaagcctgggtgatgaaataggtattattaatacctgggtgatgaaataatatctattaattatttttcctgatcctctccctcctcccaccttccaccctccaataggccccagtgtgtgttgttccccctgtgtggccatgtgttctcatcatttagctcccatttataagtgagaacatgtagtatttgattttctttttcggcaatactttgctaaggataatggccttcagctccattcatgttcctgcaaaggacatgatctcgttctttttatggctgcatagtattccatggtgtatatgtaccacattttctttatccaggctatcattggtgggtatttaggttgattccatgtttttgctattgtgaatagtgctgcaatgaacatacacatgcatgtatctttataaaagaatgatttctatttttcgggtatgtacccagtaatggaattgctgggtggaatggtatttctatctttaggtctttgaggaattgccacactgtcttccacaatggttgaactaatttacactcccaccaacagtgtataagcattcctttctctccactacctcaccagcatcttattttttgactttttaataatatcattctgactggtattagatggtatctcattgtggtttttgatttgcatttctctgatgattagtaatattgagctttttttcatatgcttgttgactacctgtatgtcttcttttttttttttttttttttgagacggagtctcactctgtcgcccaggctggagtgcagtgatgtggtctcggctcagtgcaagctctgtctcccgggttcacaccattctcctgcctcagcctctccaagtagctgggactacaggcgcctgccaccacacccggctaattttttgtatttttagtagagacggggtttcaccgtgttctcgatctcctgacctcatgatccgccctcctcggccttccaaagtgctgggattacaagcgtgagccaccaagcccggccgatttttgtatatgttgtaaggaaggggtccagctttaatcttctgtgtacagctagccggttatcccagcactttttattgaataggaaatcttttccccattgcatgtttttgtcaggtttgtcaaagattagatagttgtaggtgtgtggtcttatttccgggttctctattctgttccattggtctatgtgtctgtttttgtaccagtagtatgctgttttggttactgtagccttgtagtatagtttgaagtcaggtagcatgatgccttcagctttatgctttttgcttaggattgccttagcaattcaggctcttttctgggttctatatgaattttaaaatagttttctctggttctgtgaagaatctcaacagtagtttaataggtatagcattgaatctataaattgctctgggcaatatggccattttaatgatattgattcttcctatcaatgaacatggaatgtttttccatttgtttgtgtcatctctaatttctttgagcactggttcattattctccttgtagagatctttcacctccctaattagctgttttcctaggtattttactctttttgtggcgattgtgagtgggagtgcattcctggtttggctcctggcttgactgttgttggtgcatggaaatgccagtaatttttgcacatttattttgtatcctgagactttgctgaagttgtttatcagcttaagaagctttggggctgagactatggggttttctagatataatgtcatgtaatctgcaaacaaggatagtttgacttcctctcttcctatttggatgcgctttatttatttctcttgcccgattgccctggccaagacttccaatactatgttgaataggagtggtgagagagatcatccttgtcttatgccagtcttcaaagaaaatgcttccagcttttgcccattcagtatgatcttagctgtgggtttgtcatacatggctcttattattttgaggtatgttccttcaatacctagtttattgagagtttttaacataaatggatgtctaattttattgaaagccttttctgcatctgttgagataatcatgtagtttttgtctttagttctgtttatgtgatgagtcacatttattgatttgtatatgttgaaccaacttgcattctacttgatcatggtggataagctttttggtgtgctgctggattcagtttgccagtattttattgaggatttttgcattgaagttcatcaaggatattggcctgaagcttttcttgttgtatatctgccaggttttgatatcaggatgatgctggcctcatcaaatgagttaggaaggactccctcctactcaactttttggaataatttcagtaggaactgtaccagctcttctttgtacaactggtagaacttacctgtgaatccatctagtactgggtttttttatggttggtagtctatgtattacttcctcaattttagggctcattattggtctgttcagggattcaatttcttcctggtacagtcttagaagggtgtatatgtccagaagtttatccacttcttctagattttctagtttatgtgcatagagatgttcataatattctctgatggttgtttgtacttctgtggggtcagtggtaatatcccccttgtcgtttctgattgtgtttatttgaatcttttctattttcttgtttattactctagctaatggtctattttattaatttgttcaaaaaaaaaacagctcctgaattcactgatcttttgaatggtttttcatgtctcaatctccttcagttcagctctaattttggttatttcttgtcttctgctagctttcaggtttttctgctctcagttctctagttcctgtagttgtgaggttagattgttaacgtgagctctttctaactttttgatgtgggatttagtgctataaatttccctcttaacactgccttagctgtgtcccaaagattctggtatgttgtatctttgttctcattagttcaaaaaacttcttgatttctgccttaattttattatttacccaaaagtcattcaggagcaggtcattcaattaccatgtaattgtatggtttcaagtaggacagtcctgtagatatctatcagggccatttgatttagtgctgagttagatcttgaatatctttgttaatttcctgtctcaatgatctgtctaatattgtcatggggtattaaagtctcccactactattgtgtgggagtctaagtctgtttgaaggtctccataaacttgctttatgaatctgggtgttcctgtgtttggtgcatatatacttaggatagttagatcttcttgtttaatttaacactttatccttatgcaatgcccatatttttttcttttaacctttgttggtttaaagtctgttttgacggcaactaggattgcaacccctgttttattctgttttctatttgcttggtagatttttccccatccctttatcttgaacctatgtgtgtcactgcataggagatgggtctcttgaagacagtataccaatggttcttggttctttatccagcctgccactttatgtcttttaatgggatcatttagtccatttacatttaaggttagtgttgctatgtgtcgatttgataccgtcatcatgatgttggctggttattttgcagacttgttatgtagttgctttacaatgtcactggtctgtgtacttcagtgtgttttgtagtgtctggtaatggtctttccatatttagtgcttcctttaggaactgttgcaaggaaggtctaatggtcacaaattcccttagcatttgcttgtctgaaaatgatcttatttctcttttgcttatgaagcttagtttagtcagatataaaattctgggttggaattctttttgtttaagaatgttgaatattggtcctcaatctcttctggcttgtagggttaccagtgagaggtccactgtaagtctgtgcttccctttttaggtgaccgggcctttcactctagttgcctttagcattttttcttacatttcaactttggagaatctgatgatgatgtcttggggaagatctttttgtggagtatcttactggggttctctgcatttcctgaatttgaatgttggcccctctagctaggttggggaagttttcagggatgaactcctgaaatatgtttttcaggttgattccattccctccatctctttcagacaccccaatcaatcatagatttggtaggcttgattgctatgtatttacaagtgaaacagggactgaccaattccctggaattctctcaaagtcactgagtatgtattcaatttcaactggcgtaagttggggaagagtgatttattggcttatgtaatgctaaagttcagcttcaggcacagctggatctaaatgtttaaatgacatgattgggtatctgcttcctggatttccaggttctactttcatttgtgctgattctcaagtgtacctcctattggtttgcaactcttttttaataggagtatcaaaagttacaggacttatttttattagtctatcttatgtcaggtgcccacctaggaggtgagcatctgagcaaaggaaatagaagccccaggtgatggacttgggtatgtacccacctaaatttggagagcagagcttcagttgcatggaacgtatcaccgaagaactctaagttcttagaaattgtcaaaaacactttacccattctctgatatcaaaagctactgtttggatttgctataatcactaaatgcactgaagtctagtccagatacctggatgtaaggaatttattctttttcaaagcaacatattggcactttaaaataaaaaaggttgtccatggaaagtactttgtgttttttgaagactttttctctggctataacactcttacttaccactagctcctttgctttccagccagtgggtaaggaagagaggaattaaactgaaagatataagttggtgctcttggcattttgaaaagcccttccctgttttgaatcttagcatttccctttttgtcaaccataccctcttctcctggcatggaccattcccacaattcatttatattcactctgacacttcaacagccttacttgctaactttacaccctgatgcatccatctatcacttacttattctccctctttttttcttctttagtataatattttctatcattatgaattcctgaatcacagaaaaaaaggttaagaagagctagaagatcaatatgctggcagggtgattttcttcaggttcaggtttatgagaaacccctaacattcatccctgggcttgccccagaccatttcttcactgtgcctcaatgcttaatccagctcactctccccccttttttgtttgttgtttagtctagacactgcgagacactagagttgggcaaaaacaattgctaatggatgcatgtgtgtgtatgtgtgtgtgtatgtatttctcactacatattaatgagcagtatgaatagatcaaagaaatctcaattcttccctttatttttctgtcttcctgcaaacagatattaagaagtgtctgactacagatagagcaagcaaaatgcaatgttgtcaaaggcatgagagaaacctgaaaagttatcacagtatctgtcaattactaagcacttattatggaaaaggcattgtgccagatcctttgcatgacttttcttctttaagcattacaacaaccctgcagtaggactaccaatattcccattttacaaatgaagagattcaaagatctttagtgatttactccatatcacacagcttatcagtagagaatcttgatctttaactgggatcccaacattcttggtgttctttttttcctgaatatttcactgatttatagtagggtcctagaaaagaaggaccttttatagttaatttaggtcaaggtagaggtcaaaggagaaagggtggatgttggaaacagtgcccttgcctggaggggttggagcctgtatccacacacacagtcttgaccagataaccctacacctttaattccacactggcctgaggtctaatttgccttcttgtgtggatatctgctcttccagcctttcaaagagaaattttctgagtactgtattttaaaaatcttcccatattcttaacagtctatgctaatacaagtccctggtaagacagagagcgcatgaacttagaagtcagatttctgcctgaagccagactctgctgcttactagcttactgggcagccaggggagggtgtactgacctctctgactgtcagttttctcactcatgaataatgataactaatgtttgtgatatttattaagcacttaatatattccaggtgctattgtacttgctttaaaactattaactcatgtaatcttcctaacaaaattacgagatttattatctgtctccttttaccagaaagttgaggcacagaaaattagataatctggattcaaaaagacatttcagctcagtgcctctcaaacgtaagagattttgtcctccaggggacatttagcaatgcctagagatatttttggttgccatgactgggaaatgtgaccggcgtctagtgggcagaggccaggatgctgctaatcagcctatgaggcacgggatgagcctccctaacaaagaataatctggcttcaaatgtgagtagtgctgaggttgagaaaccttgttctagctccagaacccaagctcctaactgctgtactgcctcccagttgacatcatgacaatatgctgctcacggagttcttacacagataaaagaagattaattaacattgaatatcactcattccacacctggcagctagtgactttccattaagtagctttccctcctcaccaaccttgccttctcctctcccaagaaaagcagggtccaaggagatgtagagagctaacttctgcctttcagaatgaccagagaacaacacagttccagtatgcagtatggcttttgtataaaaaatgtctggagtccattattagtgcctgaatttcccggcttggctgaataaccactgtttatgtttgtgtttacagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggtaagtgtgccaaggtgtatccacttggttctgaatgcatgctcgggggcgctaatgggataagaccactgcacatatgcagtcaccctgggcctaggcaaggtggcaagctgttgacccctctagaacaaatagcacattgcagcagagtgtcatcctgatgtttctctgggtagaaacttctgtgtgaagaacaataacagctgtggcatctgttttatgtaaaagaaaagaggaggtgagttacatgcagatgaatttgtccatccatttttcaaaggcggaagtagacaggttgcgtttacgatcagtggattctggaggaaaaggcattagtggaataaaaatgattcctaaaagatgttacctagtctctgtagtttgttgacatgcagagttttgttggaacacatttcgtcccttactgttaatagcctgaattgatatttaaccatcttttgctctaaggtgtgtgtttgaataaggagattttacagctctgggcagactcttttatgtagtaattcttttccaacaagtaggagtaataaacctttgtaaaaactaggggttttgggttttttttttgttttttggggggtttttttgtgttggttttcaaagaaggtatcctggaatcagttgctttttttcctgagcgaagaaaggcaagctctttttgacactaaaaagagcatttgcttttaaccttgagagagcctgtttgtattcaaggcaggaaaagaactccttaaaagaagaaggaagtaaaacttgatacattataggtttagggcatgcatttccttggttaacagactttttaaataacaatatttttcaaaacttgggaataaagttaagtgccactagcagacttcagagccaggaaaaaattggatgagctccaaatatatttgtcttaatacaatgcaactttgcacttccgaagtgctaataattacacttgctgtcatttattgaaaatgttcaatgtgccaggctctactctgagcactgtacgtaaattattttccttaatgaaaataagtatcacgttaatctatggttttaatgcatccagggtgctacgaagaattacattatgaaggctgggcaccgctgaacactctggagagttaaaattgggaaaagataatagtcatcatgtgttttaggctcttactgtcagcattcttgtgttttctatacattttgattcaaagagcttatttccaacatttctttcagagtttaaacattttcccttcaaacacccactttccaaaattcaccagttcaagaagccggttgaataactttccgtataatttaaaataagtctccaaatgcaccaggcatctgctctttactgagtgtgacactgtactaggaacaggtgaggcacagggaccacagtgaagggcgagacacagagtctcggccctggtggagtttgctgtccagtgagagaagtgaataaataaacctgcaattgcaatgcaagatgccaagtgctgtgctgggggagcagagtgtgggggagatgccagatgccaggagaactgggctccatggcccagggaacattccagcaaatgcatgaaccaggacctgaaagttacgtgcccagaggcggtaaactagtcgtcaatattcctgcatatgggagaaactgtttactacttgcgcctgagtggagaaaccattctcattattggtcataggcttctaaggccattttgaggttgtgattttttaacagtcatgtgtttcttttgcttgggcatccaaagcctatccattggctcagttaggagaagattgagttatttatgggaagacaatgaaggaatgtgttttactcatctttggacaggtgtccggtgactcatccaaatccccatcttaatcaagtaaaccagttcagcatagaatagccagccctccaatgtactcagccataaaacctcgacacactcaatctatttctagtctaagaaaagtgaggaaaagttttggagttgtgatttattaactcagctttctttattgaaaaagaactcttaggggtagaacctcaatttgagtggaatgtgttccaaaatgagatttgagtcagaaaatgggagcttgtgttaggaacatggcaggtatctaatatagcaaagcccttgtgtaatattttcaagttataatgatctctcagaagacccaagaattgtaactgtcttcctttctgaataagtgaattcactccctcagattcaccagtgaagtctgcatctgattttgttacatgacaaatttccatttttttcagtgatattgaaatttgaaatactgagtgcccactttgtactatgtacatgagaaacacagaaaagttatgaaatagccatttctccctcagcctgtgaacttatggatattcagatgcatatgcctgcaaaggtttttaacaacaacaacaaaacagccttctgattgtcaaggtttcttttctgactcccggctgcatagttctgtatttagggggaaaaaagcaattgttctataaatgtaatgggacaatccaaccctcagaaagtaacatgaataaaacttctcaatcagtggctttcttggtgggagtaccacattgtacatggctggatgtcagtgtattgattcagaattcttagggtgaattatgccttgggctcagccgcatctactgcctccctccagcagcccttccccccatttttatggcttgctccctgctggattggaattccagccacaagcccacagagctgtgaattgggagaaagatgccaccatttcatcctgggggaaacatacaaatcttctgtgttttcagaacgacaatcttatttttgtgccttataaaactacattcagggcaaagcataattaaaacaaggcaagaattcatgaacaaatgaagcgtttactacataggccaaagaaaagataaattatatgcctgaaaggtttcactgagctgtgattcatacaaaccaatgtgttggcagggatgaggtttttttcctctccccacaacaactgaaccagagctgtaagatatgcatttaaaagattcaacacacacacacacaaaatcacataatgcaaacttgacctttattggttaaaaataaaacccaccacatttctgttatcaacacagtacttccagagttgtgtttgtgttgagtgggggtgtggggcgcataaagtgttgccatgcagagtttcataagatgaagaatgtcttttttcttttaaaagtgtaattaaatcctgcaatcgttactttcgcactaaccttgtgcaaggcatttgaaaaataaatcatgtttctcgtctgtcaaggagtgtataatctagtaagagacatagtattttaagagacattgtgataagtgcatcggtcctcagattggctcaggctactaataataagaacaatattctgtgttttcacttctcttcttttctctcttgaacacactccattcaggctcttgtcacagccaccatgatgtttcaaattccctaccatcaccctggctgccaaatcctataggtctctatctttgtcctagtaggtctgacctgcaagttgaatccgacacagtgactgagtgggccacaccttgctgtttgaaacaacatccttccacctccctggtactcttccatcatctcctttgctggatctcaccctctaaatgttggacttccccagggttcacttcttggctatctctaactacgcttatttccttgaaggtttccctcagtcccaaaggtttaaatactgctatgggttgacaagttccaaatttacatctctagccgggatccatccctgaagtccagacgtgagtctcagctgcctcctcttccacatgtctacttgaatttctacatccccatttggctgctcactgagtatctcaaccctaatgtgtccagaatggaactcttcattcatcgcctaacaatgacaaaaacaaaatgcccaccagtttaattcacggggttttccatctcagtgaatgacaagttcatcctgtctctactgtttagtggtagaattggaattaaagaactaaggtctccagagtcctttcctacatggtatttagtagtgaattaaacataagcatcatagtcaagtagcctaggtttcctctctacctctgtcacctactggctgtgtgatcttgggcaagctacttcacctcctgagcctcagtttcctcatctgtaaaatggggataataatagtatctagcacattctcacattgttcacacttttagaagttaaatgagataggccatataaagtacttagcacaaattgcattttgaaagaagaaaaagagaaattagctattaccagtattatgggttttctccctgtcttctacttcacattttacttttattttttgcctttcccttccatagtcctcaacccaaactcacagagatagcacagttgactctaatttaagagttgtataaccaaaggcacaagtcctaacttgggtgagaaaggtataaaagttgtaaaattatttttgaaacaatagaaatgttagtgtccatgcccataagcctcagtttctttgtctgacatttaagggtttccacaatgtttcctctgcctattttccaactgcattttccacccttcccttaaatttctccagtcaatatggccaacacctgacctgtgcaaacgccatctgtctcctggtattttctctgcctatgtccctttctctctctgtttatcaaaaattgacttgatattcagtgccaggttctccatgaagctaaccagatatctccactcttggatgatttcggacagcatgaatccctctcgcattttaagtcaaattctgtgattaaatcattttgtagaaatcagctcattgagccatcaaatcttaccagggaattcctgtattttcaccattttacagatgaagaagtcaacagttcagagaaagcatatcactcctgacacacagctaaaaggtggcacagccaaaattgtccatctccaaagcccatagtcttaaatagtcaacgtttctatttttgccaattatttgaaacttgttcaatgaagttacaacttgaggcaatgaaattcaaagatgttagcatatgcaaagttgtaaatacccaaaatcccaagtgaaaaataaaaacaaataaaaagaattacccaatttcaacattagaaggccaagtgaattattaactgttttttattttgtgttgtttctgccttatgtccacaaggccatgccttttcaactggtaaagagaactagccacccaaaagactttgtcagtgcaaagggaaaatccatcttacattatgcaagttttggagtaaacaaggtcctcagctataccactgggattttgatgcatttagcagtaagaaacgcttaatatgagatgtttgcagtggcagaggtgatgtggaagtgttaggagcctgggtgacctaggtatgagtccagactctaccactaaatagctgtgtggttgagttaaatgacaataatagccccattttaaaataattcattatttctaggctgtgcagtaagcattttgcatacattatctgtttttattgttaaaaaaacccaacaaggtaggtatttctattgccattgaacagaggagagaacttggggagaacttaagttacctgcgttaaggtcgcaaagctaattagtggcagaagtggaatcgagatccatctgtcacctaagcctgttatactcaatcatttaaaaacctgtgttttcatccacaaaaggaagctactacctgccctaggggtttttgtaaagttagaagataatataggccatcagtagtagtcatgctaaataaaactgtatattttctaaattgttagaaacttagaaatgagtaattatgaaatagatcaaatggcttttcagagtgatggagtttgaatagtgtatcatttaggggttggtaatatatcatttttactttggctgcaggaaacacacacacacacacacacaacaatcaattaatagtggttcacttaacaaggaggatgtactatttcttgcatgtaaaaagaaccctagaggtaggggagttcaggttggttcaacatcttcacagcccccacaagcccgcctcagtctttctctactggtgtcctccattgttgcttagtccctaggcttagtcccttgtggttttaacatgattccaagtatgcaggagtacctctctttattgtgcttcacagatgctgcatttttacacattaaaggtttgtgacaatcctgcatcaagcaagtctgtcagcaccatttttccaatggcctgtgttcactttgtgtctttgtgtcagcattttttagagataaagtttttgttgtaatttttattttaagttctggggtacaaatgcaggatgtgcaggagcccgggtgacgtgcacgtgtaccccagaacttaaaataaatgtgtgccatggtggtttgctgcacctatcatcccatcacctaggtattaagcccagcatgcattagctatttttcctgatgctctccctcccccaacccccgacaggccccagtgtgtgttgttccccttcctgtgtccatctgttctcattgttcatctcccacttataagtgagaacatgcggtgtttggttctctgttcctgcgttagtttgccaaagataatggcttccagctccatccatatccctgcaaaggacatgatcttgttcctttttatggacacatagtattccattgcagcactattcacaatagcaaagacatggaatcaacccaaatgcccatcaacaatagactgggtaaagaaaatgtggtacatatacaccatgagacaaggtatttttaaattaaagtatgtactttttttttagacgtaatgctattgcacacttaatagactccaggacagtggagaacttttatgtgcactgggaaaccgaaaaatgtgtgtgactctattgtgatattgactctattgcagtgacctggaattggacgtgtaatatttccgatgtatgtgtcataatgtcctataaataagaaaggagtttcctaaaatttatcctcagagccctttggtgaaattgagtcacgtgtctgtgtcaaggtgcaaatagctatcagccagcattttcagtttcttcagtagaaagaaggctcttccagcaaagaggacatgccacagatagaaaccagatttatcttctctacctaacattgtctggaaatcattaagtgaatggagcaagtagaagctgctacagtatccacctatggtaattcatctgagtgtatccattacattagttttctaatttaactgtgaccccatagtaagaactagattttacttgagctgatatacatgcgcatacatgaaacaaagaattcatgaagtaatactattcttgcagcatgtaacacctgcagggattttgtattcttttctattctgtttgatttgtttactgctggttttgacccactaccttatttttaaatctgctaatgatcacagtctgaaatttggagaacgctgttctgttatctgaccacttcgacacattgagacagttatcttaagagacgtgaccattttttatgcaactgagtattcccaatgcctagcacaatggctggcacatgttggcatccaataatgtttgttaaatgaacctgacaagaataagggtggtacacgtcatggttcaacttttcagactgttaggatgtattattgcaacgtcattatctgctctgcctaacacaagttgaaatagaaagtcattgcaaaatatgtggtgtatacgatttcacttaaactttagaatcatagtacaagtctacatttgtactatctacttggtattttaaatttggtctttaacatgtcatggcgttaatccattgaaatatctagtaaattgttttttgcaattaatttgtaaaataaattttgagttatcattccctctggtattgtcccatctgactcgccccctcagaagttgtaacggctataacttatcaagtttactaagtcacggagaggtaaagtaacttgtgcaaatcatagtgctagaaagtggcagggtggaaattggtcaccgatgcccacacacttaaccactgtgcctataggttcaaagagatgaaacactttaaaacttttgaaacatcttatatctttaaaaaattctaaagttagttgtattagtcagggttctccaaagggacagaactaataggatagacgtatatgtgaaagggagtttattaaggagaattgcctcacattatcacaaggtgaaatcacactataggccgtctgcaagctgaggaggtaggaagccagtagtggcagaagttcaaaagcctcaaaagtgtggaggccgacagtgcagccgtcagtctgtggccaaaggcctgagagcccctggcaaaccactggtgtaagtccaggagtccaaaggccaaagtacctggagtctaacgtccaagagcaggaagcatccagcacaggacaaagatgaaggctggaagactcagcaacccagcttatcccaccttcttccacctgctttgttctagccatgctgccagccgattggaaggtgcccacccacattgagggtgggtcttcttctcccagtccgctgactcaaatgttaatctcctctggcaacaccctcatagacacacccagaaacaatactttaccagccatctaggcatccttcaatccaatcaagttgacacctaatgttaaccagcgtgatagtactttccaagttggtctgtggaacgttagtccaataagatgggcctagaaatagggctctgctatggaatagtttcagaaaatctatttgctttatagtctctactgaagattcacaatggacatccacctactaaaggctctgagaagtcctgcagcaagcacgcctgtttcactttgtttaaccaagtgtttctcaaacttaatcatccatgtagctgttgggcctctaacaaggtagctcaattttccaaggaatggttcttctagagaacgttgagctaggcatttagaccagaagttgtatgatgttggctgtgggtttgaagaagtaaaataaaataaaaaacataaaccagaagttgaaaactagccatctgtagaaggcctctagccagagatgcatcttacttggcctacatagtgttttaaataatattttaattaattaattatatttttgaattaacaaagttgatgatattttaaagcaataatatgtcaatacaattctatatttcagacttccccataatgggtagttttgccctatatttccagacagaatgtgagttgtgactgtcccttaagatggggcacccactctccagttcaccaaatgattcccagcagcgcagccatgtaggttgtccttcgtcataacacttgcattggtatttttcttgggtacagttgagaatcaagtaaatacacccatcatggaccactttacttccttcatccttcatagcacttatcagaatttgaagctacttagatgaccatctgtcattccagcctgagagtcaatcaggcagccagtgttaagcaatatataaaaggggtgggaggctgggcgcggtggctcacgcctgtaatcccagcactttgggaggccgaggcaagtggatcacgaggtcaggagatcgagaccatcctggctaacacaatgaaaccccgtctctactaaaaatacaaaaaattagccaggcgtggtggcgggcgcctgtagtcccagccactcgggaggctgaggcaggagaatgacagagcgagactctgtctcgaaaaaaaaaaaaaaaaagtaagtggatactttcatttattcatgcaacaaatatgagtatttcctttgtgccaggaatgattttagattccccagcaggtagaacagtgtacttcatgggagctttccttctagtggagagaccaacaatttaaaaaagaaagagaattaacaagcaaacacttccagagtttagaaagagctctgagtgaaataaacagagttttgagatagaaagtagacaggagagtgaaaatcacaactgggtgaggaacagaaacagagaagtgtttaaacagtcagtgaatagcatgtgactttttctttctttctttgcacgggccaaacaattcttagaaagtctgcaacctaattctggcagcattcaaaactgttttctcgctttggggaagtgtttgttaaatagatgacgaatgtgttctaggctgtggattattagttttttgtatttaaaggcaggttttctggtgtggtttttgtttgttttttgtttttgtttgtttgttttccgtaacattgggtatttttcctttagtaaatgtgaaatgctgtcaccagtctggaaggttgtgcttgttaggaactaatcatggaacagaagaatcttccacaaatcccttttgcccagtgtggcttaccctgggaatcactcttcactcactctgcctgcagcagtatttttccattttaaatcacacatattggccgggcgtggtggctcacacctataatttcagcagtttgggaggctgaggcaggaggatcacttgagaccaggagttcaagaccagcctggccaacatggtgaaactccatctccactaaaaatacaaaaattagccaagcatggtggtgcacgcctataatctcagctactcaggaagctgaggcatgagaatcgcttgaacctgggagatggagattgcagtgagccgagatcgcaccactgcactccagcctgggcaacagagcgagactccacctcaaaaaaaaaaaaaagaaaagaaaaaaaatcacacataagggaactatacttaagagtgtgccaactcatgtgtccttaggactatccccaaagcaaagcctgctgccaaaagggaaacaagagaagaacattttattgcttaattctctacccacattttacttgccattggaactcaagttgacaaattcacttacccctcaagcagaggagttgctgagggagaaaagagaaaatgtacactagctttatatgggaagcaagtgtgcgttgctttcttagatagatttctttcccccctccccctatgtgaacaacagacaatgctttatttaatcttacaaatgtaacatctccacatcagttaataactatggattaatgatgatgtaccatgctaaggccctgggctagacttctgctacccccgtgtgagatgagccttaagtatcctgaggttatgtccacagggtagtaaaacaggtagtgatgttgtgatttacagtagagagtatcacactggataattggtccaacccggcttggttcaattagtataagcagctgaaattaacattgcctctctcttccccaaaagaggaagaaaaatggctaagtggaacatttttatatctgtgttatccagactcaatttccatctcagaaaagatgccagaggacaatggaaatctagatttcttggttttatattttcatgttattttatttccctctgaagtcttagataatttcttaatcaactacctggaccactaagaagcttgtttccaccgtggcgctttggcagtatgcaattttaaagtcttcaaacacacatgctttctgaatgagcaaatctgcatttaagaatttattgattgataggtcaggagggtgactatagtttactgtacatttcaaactagctagaatagaataagtcgaatgtttttagcatgaagagaagacaaatatttgaagtgatgaatatcccaagtacacgaatttgatctttacaaattacatgaatgtattaaattatcacacgtaccccaaaattatgtacatctattatgcatcaataaaaaatgtttaaaaataatgtattgagaacatgatcaatattttatgcatggggctttaaaaaatttccagtattgtctgtaagaaaaaaagctgaaatgatccaataggtctttcatattgattgtggcacacccttacactagacaccgtaaacgagggtgacataaaaatagaattggtcaggtgaagaaagtgatagtataatgttaaatgagaaaagcagatttcaaaatagcatgcagaagaatctcctctgggtaaaaatgatctctgccttcctgtgccatagctctgtcatcccacccaaagagcagcgtggaataaaaaattgcaaattgttgacagcagttgactttcagtaatagaataatcgatgcatttcgttttattctttgttatctgtattttctcttttttataaaaggagcactgtagtgaaccaccaatctaactaaaagtaaaaaaatgccaccatctaggtaatttctcgattcctcctctagactgcattaagaggctgaggattcctgagctgtgttaattagaaattgccacaggctgctagcaacagttcaacaagaggttattttcctctaacaataatttccaaactatgccacccagagcttatgtgacaattcattgttcagaaagaataacaactttttaaatatacttatagctaatgtgtaatcatctccagcaggagatcacaaagagaaatgttgtcctaagtgggcagatttgaagccctttcataattggatttcctatggttgtgctgtctgtgttctttccctgtttttgccatgggcttgaaagatgtgaatgcattataaaaaaaaaactactcattgaatttttatcagttgatgtgaattgggtaggagtagtggaaaaaataaaagtacagaattacctacattaatatatatttattgaccttccttcagtggctttgagcactgtagtaaaacaaacttaaaaaaaaaaagagtttgggcatggtggctcatgcctgtaatcccaacactttgggaggccaaggggggtggatcacctgaggtcaggagtttgagatcagcctggccaacatggtgaaaccccatctctactgaaaatacaaaaattagccgggcatggtggcacatgcctgtaatcccagttactcggaggctgaggcaggagaatcacttgaacctgggaggcggaggttgcagtgagacgagattgcaccattgcactccagcctgggcaacatctcaaaaaaaaaaaaaatcatagtctgcttaggaaattctgagattctgcaaaatatttttagtattggtcttcacattccttcctgcttgcatattaatttgctttcctttctaggcaaattgggggacaaattctatcttcaaaaattaaccaaaccctatttttcttcctgaatctgacaatggctacacgcaggtgacagtgttttcagaagaagaaaaatgaagacttcgtgattgtccagagactattgttgtccagcaaatcgaaccctctgtgctcgcgtgatattctctggggagaggaagcagagccttcccttttatcccaggcagcatggggctcaaatttctgacagatggaaaggagtggagtcatgagtttctgtaccattcaacatttttcacacaaattttcttgtgttcacctgtactttcagtactgattcgtggtgttaagactaagagtaaaatcagtgctacacaatgaggaaatctagatggagtagaggcatcacagatcattccagacaaggctttttaagccttatcttatattttcactttaacaatgtagatctgcttaaaggagtctgaagtccagctgacaatagttgaaagaaagtgccagaagttccatatgggccttattacagacaatcaaattatgataaggcggcattatttttcaacatgacaaattgtaatcactttagcagtgttcctatctgtttgctctttgaagccaacaaaaaagaaaatatatataaacttctcacacagaggtgaaaaacaagctaacaccacggacgcctgtttgcttaaaaacagtttccaggtattttctggagaatgtttctgtttccgtataatgttgtttgctgagaatgattcggaggcctgatgagaatagcagcagcacctacaaataacatgtttaaagcacaggccacacactggtggcctgaaggctggactctcatcacaactgtgcttagcttggccctcttgatgtttttaaatttttttagttaatcatgcatattttgctttagtcttaattttaatacgtaacatattcactctgttcaaaacaaaaaattataaaatgccacccagtagataattgctgtttgtatttttaatgtatctttctagggttcctttgagcatatataagaaataaaacataaattctttttctttcttttttacacaaacggtaacataatatgcactctgttctattccacgcttgttttcagttaacaatactttctgtatctgtagggagcttcctcacttgtaatgcctgcagagtattctgttgaatggttgtaccatgagttatttaaccaggaccccatttaatgcccattggctggcttccagactttcgctattaacctcactgcaatgaataaccttgtacatttgttatttcacacgtgtgagtttaggtttatcctctacatcaactcttagagatggaaatacagggtaaaagaatatatcctttttacagttttggtacacaatgccactctgccctccatcaggattgaattagtttatacttgtaacagcaatgcatgattgccttcttcacacaagcttggccaatgaatgtttttgtaaacatttggatttttttacttttcaatcttccttttcatgacttctggatttctagtcatacacacaaaagccttctcaatccaaaatgaaaagctgttttccatgtttccttgtattatttttaatctatttggattttatcctggtagagggttgagttgtgacaccaagttaatttttttccagatggctgctctgtttttcctacatcttttatttaaaagttcttcacttccatagattttaggtatcatctttatcatatactaaattcctatatgtctttggaattttaccaccttgttatcatcagccatacaacgtatgcatgtatgcctgatgctaacatatgttgtatggttgatggtaacatatgttgtatggctgatggttacaaagtagaaaaatatacagcagagaaaaggaataaagtggcaggaacttaaaataggaaaggacttgctgagaagataatatttgagtaaacatctgaaggaaaggagatagaatcagtgcagcacagcactgaaaaacctttggcctctgaaatcagctgggcctgggatcaaatcccaactctactttatgaccttaggcaagttatttattctttctgtgcattaatttcttcatctgtataattggaattacaaacagtgcatgcttcatgggatcgttgtaagaattaaacgggatctttttaacaagcttagcactgggcctgacacataaaggctgatcatttttacggttatcatggacacttattttgtcattacacactccttaaataattcatggctgcaaaatattccatcacacattgttatgggttaatttcacatgttaaaaccacatgcgaatttatttaactgcagatcccaaaagttcaactttttaagtggttcttcattgttgctcttccagaattatcctatcaagcttttttttttttttttactttttaactttgaaattattgtagattcacatgcagctgtaagaaatacaacagttatccctttatccagcgtcactcaacggtaacatcttcagacctgtagtgcaatatcacaaccaggatattgacaatgatacaatcaaatagagaacatttttatccccacaaggatactgcatactgactgttcaggtgcatccacttccctctcacccccatccttttcttacctcctgcaaccactagtctgttctccattgctatagctttattatttcaagaatgctatctaaatagtatcatacagtgggtacccttttttacataggcttttttccccttcagcataaatctctggaaattaatccgaatcactgagtgtcttggtagatattggtccttttcgactgccaagtagtatcccatgctgtggaagtaccagtttgatgtttggttgttccaactttgaggctattgtaaataactttgctataaacattaatgcataggtttttgtgtgaatataattcttcatttctctaggagaaatgaccaggagtgcaatcactatagttgcatgttttatttatttatttattttaagtttttgagattggatcttgctctgttgcccaggcaagtgcagtggtgccatcttggctcagccacccagggtcaagtgatcttcccgtctcagcccccagagtagctgggattacagacacttgccaccacgccctgcctgcatgtttaattatttaagaaactgtctaactgttttctattctgcctgtatccctttacatttctaccagcaatgtaaagtgattacattgtaaagtgagtaatcgagtttcttgcatccttcccagcatttaatagtcactattttttgctttaaccactttgatgggtgcatagtgatgtctcgttatggttttaatttgcacttttctaatggttaatgagattgaacatctttatgtgcttatttgccatctgcatatcctctgcaatgaaatgccccctcacgtcttttgcccattttctaattggattgttttgtttgtttttaatgttgagttttaagaatttttttcttttaaatgtattctaaatactagtctctcgtcagatacgtggtttgcaaatattttctcccactctctagtttctcttttcatctttttaacaggatcttttacagggcaaaattttttagttttgatgaattccaatttattatgttttctttttatggattttgcttttggtctttggtcttttatggattttttaaccataggtctcagaaattttctcttatttttttcctaaaagttttatatttgaggttttatgtttaagtccacgatctcttttgagataatttttatataagatgtgagacttaaattgaggttctttcttttcctctatagatgtcaaattgctctagcacaatttgttgaaaagactatctttattctgtagaattgcttttacacctttgtcaaaagtcatctgggcatacttgtgtgggtcttttctggcttctctattccattggttctatatgtctatgtctccaccaataccatacagccttgcttactgtagctatataacaaggcttgtgatcagatagactgattcatcaatttatattttaaaaaattattctaaatcctttgtctttccatataaatgttagaataacctcatctatctctacaaaatgtcttgctacaagtgctggaattttgacaggaattgcattaaacctgtatatcaatttggggcagattgacatctttactatgtgagtcttccaatccatgaacattgtgtgtctctccatttatttaggtctcctatgatttctttcattagcattatatagctttcagcatacaagttttgcacatgttttgtgagatgtaaaccttagtatttcattttcgtatgattattatggtattgtatttttaatttcagtgcccatgggttcattcctagtatatagaaatctagatcatttttacatgtttatcttgtattcttcagccttgctgaactcaattattaattctaggtgttattctgttgattccttgggattttctaattttgaaaataatgaaattgtctaattttgccatcttctctggggacagttttatttcttccttttcaatgtgtattccctatatttattttcttgccttaatatacttcctagaacttccactactatgtagaatacaaataatgagagctgacatccttgccttgctcctaatcttaggagaaatgcattcagtctttcagaattaaggataatgttagttctcaatttttattttgtagatcgtctttatcaagttgaggaagcaccctctgttactgtcttccttagagatttatcatgaatggaggattgaattttgttgaatactttttctgcattcactgttgtgatcatgtgatttttcttctttagtctgtcactattgtggataacatcaattgactttcaaatattaatcaagcttgcaaacctatagtaaatcccatttggttatgatgtatacttcttttgacatattgctgaaatctacctgctaatattttgtaaagaatgtttgcatctatactcatgaggcatattgatcagtagggtatttttcatttctttggtgccatctttatctgtttctggtaccaagtttttggtaactatctttataaaataaattagtaagcattccctcttctgttttctaggagatttcatgtagaattggtgtaattcttctttaaacatttcatagaattctccagtgaagtcttctgggcctgaagacttctttcctggaagtttttaaattatgaattcaattttcttaatagttatatggatatttaaatcatttatattatattgggtcagttataatagtttgtgttttttgagcaaatgttccattttgcccgttatcaaatttatgtaggtagcattggttatggcattctcctatccagttttgtacctgatactggtaatctgtaccttgactctcttgctctctcttttttgttgtcatctgttgtctctactaatagaggtttttgctgctgcttctctctgtctctcccattatgctgttgatttcactcactgggctttttgttttcattattatacctttcaattctaaaatttccattttagttatttttatatcttctatttctttgctggggctttctattttttcatttgtttcaagcactgttacaattgttaattgaagcattttattgtgactactttaaaatctttgtcagaggccgggcacagtggctcacgcctgtaatcccagaactttgggaggccaaggcgggcagatcacttgagtttaggaatttgagaccagcctggccaacatggtgaaacccatctctactaaaaatgcaaaaattagctgggcgtggtggtgcacacctgtaataccagttgctcaggaggctgaggcaggagaattgcttgaacccggtaggcagaggctgcagtgagccaagattgtgccattgtgccattacactccagcctgggtgacagagcaagactccgtctcaaaaaaaaaaaaaaatctttgttagataattctagcatctctgtcatctcatttccaggttgacatctgttgattgccttgttttattatgtttgaggccttcttagttcttggtatggtatgacaagttatcttcaattgaaatctgaccattttcatattatgagactgcatcttgcttaaactttctattttagctggctgtcccggacaccattccagcagtactggggctgctacctcattactgtcaggtggaggcaaacatccaggtttctcaccagcctccattgttggggggcgggggtatactccttattactactgggtggaggcgggagttttctgctcacatgaccttcactgataccacagtggaggtctcattaccactggctgacgctaactccactgggtctcttctcacaccaccccagtggggagagggaggagcatctcattgctcctgggtggggttggaagtccaggctccccatgtggtccccgcggacaccatggtggggagggcttattaccaaccggtgaggatgagaatcccagctccctacttagccccacagatgccatcttgcaggggtattgggataacctattacggtcttgtgaaagtggaagtctaggctccccacttggctttctctggcatgggagatggtgagaccacagaatgtcctgtggtatttggctggagtagtatggtcattgtctaaaagttttctgtcttgccagattgccctttcctggtcctttagtcagagagagtaggctttcggaaaggatttgtgagtatgtcagagcctataggtgtttccaggttgctaatttcttcaactccaagtctggggtacttgaggcaaaaagaaaacccaaggaattcaccatcgtgtttttcctcgggtcctcagctggtctgccttctcttctccacctttcagaatccttttatgtatgttttctctataatgtccagggttcttcattgtccttggtgagaggaacaggagaaagtgtgtgtgccccatcttcccagaagcagaagtcttatgttattttttaatgtcaatctaagaagaaaaaaaaaatatttcaaagtaagggcttaagttcaagctgagaatttcacctggaaaggccataaaactctcactcaggaagagccacaggcaaacctactccttgccctgggccggcagatcttgctcctccatagctactgtctgtccaaggcaggagacattactgcagttgggaaatcagggaagcagagaggctagagaagatgtcatggggcaatgcagaaaggcagcgggctcctgtgttcctggagttcttttgaactgtgtctgctccagtagggttctttctccaggttacggaagtactcacagctttcttcctcattcagagggcgtccatcatggcagatcctgatggccacctagatccatagggtccacttgatattttagtaattcctagtcccttcagctgacatcactgtattccattttgttttgagaaagttcaatagatatcccctgtatgtctagccctggaaccacaaaaaagaatcattgccttgcagccctttaggaaacccaatcaggacaggagctgcgggcaacctagacatagccccttttattttctgtgatgagcactggggagcacgtgggctgtcagaccggagtagctcagagcagtggacccaggctggggatcagaagagctacctccttgcctccacgccaacttcagagaaccttgcctactgtctaagtagccagcagcccatcacctcaccctccgtggccttgccttttcttttctccttagcagccctcaccacctgagtcatctgtgagatgtattagtttatctgtgtttttgtccacttcggttttttcccttgtgagaatttcagctccccaaggactgtgagctgtactctcactgcctccatcagtgggaagcacacagtagatatttgatcaaaaatttctctcctaatctttcatgacaccgtaggcaagtccccagacttgctgtgattcaaaagtcctgttcaatccaacttttttttttttttttttgagatggagtctcactctgtcgcccaggctggagtgcagtggtgcgatcttggctcactgcaacctccacctcctgggttcaaacaattctcctgcctcagcctccaccgtagctgggattacaggcatgcaccaccacgcctagctaatttttgtatttttaatagaggcggggtttcaccatgttggccaggctggtcttgaacacctgacctcgggtgatctgcctgcctcggtctcccaaagtgctaggattacaggcgtgagccaccatgcccagcccaatccaactttaaaactttaatcacacattcattataacattcatcccaattcctgctagaaccaagctctgccttgaccatggcctgaggtccttgcagtctggaagaagggggacttgctttttttcctcttctcgtcctcccctaatgcatgtgagtttagggaggaggggttaaggggaaagggctctaggctttttgccttgcagattgttctctctgactctccatatcttctccgttgtgggcatccacatgatgtttctcttcagggaataggtggggacttctccacttcaaaattatgtgatggaaccctctgctgcttctgctgctgtttagcccctttgccctgtgcccaccatcctggtaaggtagagtgaggctgcctgagcccaaacaccttccatggcacctactccttaaatgtcagtcaacacttcctcagtctgactccaaattattgttataaccatcttgcttttcataacccccatacctctgctgaactgaataacctgccccctaaaccctccccaaacccatccccacctcatctttttctgcatttctcacatgccttcctccatgtccacttgacagaaatttctccatcaccatcccgcattcctccctgtttctgcgagtctacttgcaacctatgctccatggccttggggaaatgctgcttcatcttcaagtctccctctcccttctagttcagtcactcttgaccttggtgcacactggaatcacctggggaggtctaaaaatattgacatctgagcctcgcctccaaaaagactaatgtaattggtcggggtggaatctgggtattggcatttgtttaaaaagctgcccaggtgattctaaaatccagttatgctgagacccactgggctgatgaaattaacttgtcttttttttctttttatcttgagacagggtcttgctctgtcacccaggctggagtgcaatggcacaatcatagctcactgcagccttgacctccctggctcaagcaattctcctgcctcagcctcccaagtagctaggaccacaggtgcatgccaccatgcctggctaatttctgttttgttttgttttgttttgttttgtttttgctttgtttcatagagacaaggtctcactatattgcccaggctggtcttgaactcctgtgttcaagcaattctcctgcattgacctcccaaattgctgggattacagatgtgagccactgtgcttagcctcacttgtctttttatcagagtacttgtccctatctactgacctttatccaccataaggctccaagcatctaggagagaagacagtgtcagattcatttttgtaaatctcacagcttaccacagtgctcagtaattaaattaaacacaataataatagctaaccattactgaatgcttcctctgtactgcacattctcctaagtcctttatatggattatcccatttactccctcaacaaccctaaaaggcaggtgctactcatcaccccacttttacaaatgagcaaattgcaacctagagttagggaaagtgcagtactgcagaggtgtagatggcagagcagggattggacctgggcagctggcctctgcacagcttgtatgtagtcacattgagggttaggatttggggagacacaaactttaagtccacaatacacagtgaaagcataacttcagagcccatgctaatgctgtgtggcctctgcacagcttgtatgtaatgtaactacccccacatagttactgagtgaggatgaattcatgaatggtgctcctgggcaacaccttacttaggcctgtggggaatttctcagtctagatttatgtcttgtgccactttcataatgactcatcttcaagacacctgttcagttattcatgtaatagctttatttaaagtttactttatattgaacttcacctacacaaaaatatccataatatgaaaaggttgatgctggacatatttttctagtgcacattgtcttagttcaggctgctatcaaagtaccatagactggatggcttataaacaacagaaattgatatctcacagttttggaggctataagtctgaaatcaagatgccagcatggttgggttcttgtgaggaccctcttctgggttgcagatggccagcttctcattgcaccctggaatgatggaaagaggactagaacgctcgctggggtctcttttataagagcactaatcctattcatgggggctccaccccatgacctagtcatctccccaaggccccacctcctaataccatcacatcagaagttaggatttgaacacatgaattttggggagacacaaactttcagtccacaatacacattaaaagaataactgtgtgtgtgcgcggacataccacctaaaataaaatcgccttcctcatacgtatatcaacactcatctgctataaatagaatttgcagccatccttctaatcaaccagcttaaccgcttggatcccagttatacctcagagttagtttttaaaagttcaactcatattagaacctgtttttaaaaagtacatctcttccaaagcaaaacacttttctcccagaattaaccagaaaacctaacaagactattaagaccatggcttttatttgcttttagttttatgaagcttcagctgctcatgaggcatttcacaagaaatatgcttccatttagaaagagtcctggggctgattgaaacccttgtagaatatgtgtattattgttacttttaaaatactcaccaaaatgtgctttttgtatttttgcagccatttcacaaaagccccatttttaatgcaaactattccaacctggcctttggtgttaggctggtctaagtgcataatctaagtaccaactgagtgctgagaactgtggtatagaaattcagagaaggggacagagtccatgggtggcctgacccagaaaaacgtcggtgggagagggagacttgattccaatcgtgaagaatagatttcaaaagggaagacagaagctggagagcacagtgtacaaaggcatagaaaaaagaatttactccatatcctttcatcctttaacaaatgtttctcctgaatctactctgtgtcaggaactttgcaaattgtatggcattttcattgcttttttttttttttttttttgtctgtttggctaacatttattggacacttctatactaggcattatgctaaggaatttacatgcattatttcttatggaaactcacaacgaattataccaggcaaggtttattattaatcttgtgttccatgagacgaccttgtctcagagaggctaagaccccagctggggttcctcaacctgtgagtggagctgggaggtgaatatggagtctttgtcaggcactggaacttttatcaaccacttgatcttgttgtgaatgagacacacgcagtgcctgtcctcaaatgcccagttgagcaggtgatactggcaattaatcaattatgattcagtatgatgggtactgatgagaggggaattaggaaaacaaatagcagtaagagataatgagcttcaattcttgtttgcaaaattactcaattgaatatcagtctatgggaaagaaagagagattgatcattgacattcattcttcccttcatttattcatttataaataatgttcataatcattatcactaattaatataaaaagatctgctacacccctagaacaagatttattattaattttggtgacaaagttcatatttcaaatacacttattaatttcaaatttagggagctcacttcttttcagacctgatttgatcctcattgctgttcacatgataatgtagctcaagattcatgcatcaccaaaaacgaactcacctgtagccagctacaggaagtcaacactctctactattaacagagtagaagctttcagctaagggagagttacaggaactggctttgccctcttgcctaaaacagatgaaaacttggacaaaaaaaccaaacaacaatttttaagactgttttaagatatcaggcaacaaggataggtgttctctgagagacgggacataagagataatccctgtgtctgctcctacctactgccttgagagggtttccagcccatagcctaggggggaggaactgaggcagagcccagcaggctccctgagcccaaggtggccagagttcatagacaaagcatcagaggagagagagagatacacagagagcaaactccaagggtctgtcaaaggtcctcacatagtatgaggcagagagctgaccaatatgttcatatgaggaaactagcaaagactgaagggggaaaaaaaaaaaaccaaccaccagaaaggcatttacacagggccagagagagtgccttctctcaccagccagactagaaaacctcattattaataaggcactgggtagagtagtcacagggtctttcctcattagcgagaaaatattagcttcctagactagacacgattttggtcctacctaatgtaactgccaatgggttatttttgcccgctgcccagacagagccaatttatcaagacaggggaatggcaatagagaaagagtttactacacatagagccaattaaatgtgagattagaacttttttattactcaaatcagcttccccccaaaattcagaggctagagttttttaaggtcagtttggtgggcagattgctaaggcgtggagaatgctgattagttgattgggggcagaatcataggacatcagagatgtcctcttgtactgagtcagttcttgggtgggggccgcaagtccagatgagccagaccagaatgcagggtctgaaaaatatctcaaacaccaatattaggttttacagcagtaatgttatccataagaacaactggggaggtgaagaatcttgtggcctctggctgtatgactcctgagccataatttctaatgttgtgtctaatttgctagttttacaaaggtggactggtccccaagaataaagggggcttgtttggggaagggactgttattatctttgtttcaaagttaaactataactaaattcctcccgaagttagtgtggcctacccccaggaatgaacaagggcagcttggaagttaaaggcaagatggtgttggttaggtcagatctctttcacagtcataattttttcactcataatttttgcaaagtcagtttcacgaacaaatcttaaaagccagaactaaaaggatcaaactgattttaagtatcttaactacctccaaaaacaaagttcaaaaatatttataggaacaaaaaatatccagccacccaaacaggtaagattcacaatgtctgacatgcaaacaaaaattaccagggaagcaaagaagcaggaaaatgtaactcatgatgtgaagagaaatcaaccaaaacctacccagaactgacacaggtgttagaattggcaaaaaaataaaaaggattagcataaatgtgtctcatatgtttggaaagttaagtagagacatagaagatatatttttaaaatccaaatcaaatttctagagataaaaactacagtgtgtgaggtaaaaaatacactggatgacattaacaacagattagacaatgcagaaaaaaaaattgtgaatttaaatacacagcaatagaaactatccaaaaggaaccacagggcagtgggtgaaaaggaagagggctttttcaaaaagaaggaagaaaggaacattaatgagctacaggataacttcaagtaggctagtaggcaggtaattggagtccatgaaaggagagaaaaggagagaagaaaaaatatttgaaatcataatggctaaaaattgatgactgatactctcacttggattaaatcatttgttcattcattcactagtaatttttgagattgtaccatgtgcacaagtctgggtgctggggaaacataagggagaaaaagaaccttcattggtttctattccagtgaagggagaggaacaaaacacaaaatgacaagtgagagttttaatataattctcagtcttgccactgagagccagataactctttgtcctgggcattgcaggaattttagcagcatgcctggcatctatcctccagataccagtggtaaatcactaacccgctactcgtgacaatcaaaaaaatgtctccagacattaccagatgtccttagggggaagaggagccagtaatatattagaagtgaaatctactaggagaaaaataaagcaattagcagcatcagatatgccgggatatattatagcaacttaaagtagagtggtaaagaaagacctcgatgaaaacgtggccattggctcaggcgcagtggctcatgcctgtaatcctagcactttgggaggccgaggtgaggggattacctgaggtcaggagttcaagaccagcctggccaacacggtgaaaccccatctctactgaaaatacaaaaattagacaggcatggtggcacacactgtaatcccagctacttgggaggctgaggcaggaaaatggcttgagccagggagacagaggttgcagtgagtcaagatcatgccactgcactccagcctgggtgacagagtgagactctgtctcaaaaaaaaagaaaaaagtgacaattgaaaaagacttgaaagaagtaaggtcacatgctcctggcaggcagaagctcagcccagatgcaaaggtcctgaggcaacagcctacttgacatgttcaaagaagagcaagcaggtcactggggttacaaaagagtgacccagggggaaaataaaacaaaaaaaaacgggcaggaaagcaatgagaatggaatggaagaggggcacttctccaggaatgagcaggagggtcctgttgtcacaaggagtgaggaatgctacttaggcaaaaacaaattaatgcttacgcttgccaactgtggccttggacatgatgtttaaacctctttgggcctcagttttctcatctgtaatttgccttgcacaatcttggcaaagattagataagatagatttgtgaaggcacctcgtaactgtaaagctatacaagcataaacaagcattgtttaagacgtaaggatgacatggtttaaacaagttataagtgcagtactttttgggagagttaagttatgaagggtttttactggtggaatttatggatgtagtctatatttatatacactccctatgaggatcttggttttccaccacctggatttaatttatatgatgttacattttactgcacacactatataagtttagcaaagttgacactcatagccaaataatctatagaattttaagatgttcagttctgacaggcctgacttataatccccatattggcctctctcaagctgtgtgaccttagacaagtaacctaaactctctgagcctcatttcattgtttgaaactgttaattgtaatatttgtctcagaagattgttgtaaagattaagtgacatatgtttaatgcatttatttgtatagtggtttgcatgctgtaaatgtaaaatatttgacgtattggcattgtatattattctataataaataataatatattaagattaagcgaccttgttcaaattatactagcttaggaaagagaaagcactggtgtacatgtaatgcttaataagtagttgacgtaatttgcacatctgtccttacctaaatctcatgttgaattgtaatcccctatgctggaggtttggcctggtgaaagatcacaggggtggatccatcatgaatggcttgggccatctccttggtggtaactgagctcttgctctatgttcacacatgatatggtcatttgcaagtttgtcccaccaccccctccactctttctctcttgctcctgctctgaccatgtgctgtgcctgctcccacttctccttccgccatgattgtaagcttcctgaggcctcccagaagccaagcagatgccagtcccatgcttcctgtaaaggctgcagaactgtgagccaatgaaacctcttttctttataaattacccagaatcaggtatgtctttataacaacgcaaaaaatggcccaatacaatcgtccattaaaatgagttgaattgtatctcagtggttgggatagtcaacccatatcaatttatactgcttgtccagacactgccaaccccagaggagaaagtataaaatccaggagtctaaatgcagtgccaccatatcccactctccactactgagagaaggggtcaaaatagaaataccaagtcttctgtgggcttctgccacctcacacactgcgaattgttagaaatcgcttttgaggaaacagaagtgtctcctttcattctcctctaagtaagggaactggcagcatgggggcagggagatggtgtggagaaggcggaacccacagccctgggatgaaaggaaggactacacggggatgaaagggagggcgaagagtgaagacgatgctcaaccagcaggtgagagtcgagtccgcctccctcactccacccacctccagaccaagctccccactgccaggccacaaccacatgcaccaacctgcccagcccggatacgttttaggtctcacttgtcacaacctccggtgcaccaaacagcttctcagatgcaccgatgtacctgcaggacctctctgttgaaaccttctcattttttgcaagaatattcatcaagtttatataatttgcatacctcttgacccaaaaatttcatttttgataatttacccaaagaaaatatagatacatgagtatttaaaaataaaagtgtgagatgatcactttactactgcttataatactctagatgtacaactatacacactgtgaatgtccatcaataaggatattagacaataaacaatgttataaccaagcaatggaataaatgtcacctgagtcgtaaagaatgaggcaggtttagctgtgttgcaatgggaagtttctgtactactttgtcacatgagaatttatgctggtacagatagcactattctatgtttgtaaaattttcataaatgatacatatttattgaatgccttctgtgggcctcgctgtccttggtacttgagaaaagcactgagtgaagtagatattatccctgtctttgtcgagtttgtagtctaatgggagtatgaggaaaagcacaaagactgagaagtaaacagaactgctgacacagcaaagatttttaaaagggcaagggactctggtggagacgacagtggtgggaggacagccttagatgaatgtttagggacaatctctccaaagagatgacacttatgaccttaaggatggatggaaattacctacgggcagacagaggagcagaatgtttcaaacagagagccagaagtttggaaataacctgtggtatgtttgaaaaactcaaagaaagtgggccagaaaatggaatgaaggagcacgtggtacagagaggatggagatttaggcaggggcagaccatgttagacgttggagatcctgcatcagagtttgggcttgactccaagagctgtcagaagctactggagggtggtaaggagtgggaagatgggatctgttgagtaaagaatgtattgtgagggtcaagagcccaaccagagacaaggccagggctgttgcagtcagaaggtggagaggcagtagcttcctgtcctggggtcgtgagaggtgagatggtgaaaggaaggcagattcagaacgcatcctaccctcctgaggaggtcggggagaaaatcagttcccctatcacaccccttgcacagatgaacctcatatctcaaaagcaaaatagttatttttaaacaccagtactttttctttttctttttctttttttttttttttttttttagttgatataatccaactctgtggaaattgtgggaaacgccatctctggggataatgtacacatcatagataaggagactataaagatggaaaatatcgataccttacacaacttctttgcagaattggaagaaaagggtttttgtttgaaatgcaacgtgcactgctgtgtttgttaccctttggctccaaacaatgtccctccaaccaacagcaaatgctgaatatgttagaaagagggggagggaaggaagagtgactcttataatctcatgattgttctgcacgcctgtgggcagaagaagtatggctggaattagggggtaagagagaaaggggtgtgaagcaaaagtatgactttgagagttcacattcagcaagtggcaactgtgacaactgttttgcccctaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtaagcagttttctcctcttttcccctccactctattgctcaaaagttttgttaattctaagaataatgcacatttgaatgttattgtactaaatgaattatcatggtgctgttggagcatgggagagaacagggacaagatatgcttcataagaaagttgtgttatatcagacttttagcaagagagcccctgaagctcggaaccatggtataagcagtggatgcccaaatcatgtaacatgggctgtgttgtaatggaattctattgcaattgaatgtcttatgttcattgatcataaaaataattgaaaaatatctccctgtgttgtggacatctcaaagcagttttgccactcaagtggcaaataaaatactgtagaaatcattcaaaaaaaaaaaaacctgaatgaatgaatgcatagtgaagcagactgtcccaaatgtgtttgggctattttcaaatatcaagactaacctcaaaagaaaaaacaataaatgtcaacagaatgtgccacaaacaccagagggttgcacatgtgtttggagtaatggtaaaatttattggaagtctgtggtcttccaggagacaattttgaatgtggtcaaactcttggtaaatgtataagatcagatgtatctcattataagatattaattttgttaacttttgtattacccggcggtcctgagatttctattgaactaaaaatacttctcattttattcttgacctgtatggtgaactggaccaccctaaagagttatttatctatgaaataaaaatcactctaaagagcaatgatttctaatatttggctttctcaaacttttaaggtttcacctaacaaagctgaaacaaaaaaggacccagaagacacggtaggtagttggaagtgtgtatgtatatatttgggtttgcgcatagaattggatttggatttgtgtctgcctgcttgttttttgaatacatatatgtgtgtgtgtgtgtgtgtgtgtgtgtgtatcatatctatatataattagcaatttaatagtgctgttaggttgtcattaaaatattttatttacattaacagtagttaaattaaaattttactggaaagcttgaaagacgtgccaactctggctaaataatatcacaataccaatttcttatatagcataagaacagaatactaataattatatcatcatcttagtctttttagttgtgcgtagagggacccagggaatatagtaaaaaacagtccatgtaaagtagaagaaagcttttcagtaggacgtggactctaaaaaaataaagtagaagaaagctgctatatttttgttttctaaaaaatatgttatttttcaatgtaatttgaaaactaaataaatctttactgcaaaggcagtggtttggtgaaatagaatagtttccctggggcacctgccaaacggatggccatgcagaggcgttaggacacgctagagagcctaggttcttcactgtcatccaagaattcagcccactctcctcaaaataaacttggtttgaaataccatcttcctagagatgttctccctttacactggacaaggctcgttacctctagtggaatacacggtttaagtttcacgggaaccatgaaggaagtttaacttggtgacagataagtgtcttgggtccttcttctgatatcggaaagtgctttgaaaaacagtgggatcagatacatggcttggtttgccccctacatctgctacccacatgtgaaggagctggctgtgaaaagaggatcctagattttgtctcaaaagacctgcatttcagctccagttctgctacttgatagtggtacaatcttaatctgtctgaacccaagtcttcatgtctataaaattgggacaaaaaaattctttgtcctggaccccaaggttgaatgaaggtgtggcattgttttgcaaactgtagagctctgattaaatgtagcgatccctatttcaatgatcacagccaagattggttgaatgacatgactacatttgtattgtatttcttggtttcctcgagaattttcttcttccattggaaaaaaatatgtatctgaagcatctacatgcattttcctataaagttattcatttgctccgaggtcatagggtcaagttcaatgaatggttggggcaaaacgtatttcttttggttctatgtcttgcgttgtttgaagccacatagcgtaaaaggctctaaacagtggagtatgggaatgtgtgtgtggcttcccaagtgacctgatgcactcattctctttagctggtcatggaccaagactcctccctgacccagaatgtggtcaaaactgaacgtacccagctgataaaatctcaccgtcctgcccaggaagctgtggggtcacattagtggagctgggtctcaaaagcgggttttgtgaatgtaggttgtccatgacacccacaaacagatgtgttttctacaaacctggttctcataccttgcaattttgatatcttttctactgaagttcttggattcatgcttttgaagtctgtattgttttcagcccactaccttccctacacgaaagtccctgacatttgtaacttgagccaacaatcttgagtggttgtagccaggctatttcggtttcgatctccctctactttgcctcagtggattggttcacactacacattttctctgcctggcgggggtctacccatctagaagtgaattgaaatttttgcaggtgatattgcttccataaagtttctaatagtgaatcaaaggagatcgatttgagactaaaagacattcagcagcagtctttgctttgactccaggatgaaaaagaaatattttgtctgcaggtattttttactttaccatgtagcaatagcatttagatatctacaactatcaagtagagactgcattatcttctcctgttatttgtcttcagcaaatggagatacagagttttgttttgttctgtcttgctttgaggtgtgttcatctgggtcatttaaataggtcactgttgaaaatcactgtatatctaaaattgtgaatatggaagtttaaaaaagataaacatttacagggtgttttgtggttagaagaggggatggtgtaccaacagttaattgtcacagcgtattaatgcactttaaaacaacagaaaacaaaaagaattttgttcaaaaacaaagttctgaggttgtgactgctgttgccccaaaggcatcgaaagcagaaagtgtctgtgatggacaagctggtcagaagacatccgagatccaggctagaggcaccaagaaaaagcacctggatagccccaggctaggactcgcctttagaaaattctttaggcataaggtctgtatcttattaaagtaggaggaaaaacaagaactctggtcttcacaagacatgtgccatcctgagcccacccagctcctctccagtaaaaacagagccttgggtggtggggatcattaaaagagaattaaagatgatatgaattaaacttcagtgatttttaagtccccatagtcataaacatttcaaacaggtgtcttcctagtgcggaccagggttctggaactattcttctaacccagtatttcccaaatgtcaataacttgtgtaccaccttcaccatttttgttagatgtactattatttgatatttttacattgaaattgacctattttctatttaaattgtatctttaaaagaaactttatatcatatatagaaaatcagaataatttttcctaagaggaaggtaagcattaatttggctaattaaaaagacattacattctagctacctcatttgtattaagctctgaatctgatgctctttctagctttattaaaaggtgattaattggccaatggtagaaaaatgttaaagatgtaccatcaccagactgagactttctccagaatgttagtagaaggattaaatgagagttggaaaaggagaagtggtttcactatttgaatactatgtaatatcatatttctgcacaatctataatcttctctgatccaccaatggtatgcttcctacattttgggaaatactcttctaacctcaagtaataatgttatctttctgtggtctgtttcatctatttccaatattaactaagcttacactgaacccaaataaaagtccaggcggaaaaaagcaatgaatgaaggcagagcatgtttcagctccatgtccttgggaagttaggacaacactgaagtcagtttgggaaatattatgcttccaatgtctaagaagacgccagtgtttgtctgaaaccatcagtttaaaggatccctgaattgggttagcatgcttgaaaatttgtttaaaatatcagccattttccaccaagtcaaaagcctgtattaaaaaaacttccctacctggatgtcacagtcccgggattgtatatgcaaataagcactccatagaaagttctcacagctgaatctgtatttgcgtaagcagactatgttatgaagccacctttcaatttccatacaggataattttgttctgtgaagagaaaagaatggggaatgataaatattgcaacgggggagggaagattaaaatgtgctccaacatcacataacttagtaactgctgggaaataacttagtaactgctggtgaaacgcgtcatagatctcataggaaagaatctagtttaactcccacttggagcttttgtaagtaaggggccttgaaagtttaagaagtgtatgatgtttccccagatctgcctttcattatgacattcacttcatgcactacaaaattttacgtctgcagtatctcttgccaccaataaagggaccacccaagttcaatgttatcattcctagggcttcccaaaaactgttggcctcccatcttgtcactgaggtagatggggaaaagacaggattctggaagagtgggaagaggccgcgggaacagccttctggaattctgtaacacagacacaaggacttcagggttttgccttgagtggcattcagtgtatttttttatgtaagtgtaaatcaaagtaagggacacctcccaaatgttctgaattcttatttacgcagcagtttgttagagctcattggcttttacctctgcacctgagatagttcatttctttttctcttttgattatttctgttgtctctaaagataggaaagtagggcctttaaataaccagccagattctctcagtgacattatcatgattttaggaggtgtgatactctccatttccccatgggtttgtcacctggaaaagaaaacgagaaattcaagcaaattgaaggataaaactattttgctattaaaaaaaaagttaccaattctggttaattctggggctttatttctctacatctctatgatccttcttataaaaagaattttctcagttcaaaaagtagggaagtctgaaatcagtaagtgaaatacatttagtgtcagcttttgctgaattggaaccatttttctcggcctaatggcatgtgatgtctcagaatcaaactttttcatgtggccaccactgtttggtgacaactttagacacaaaacagagcattcctttagaatgcctttgccatgccccaaaatgctcccctctctcctcaggtttccccagtgcccaccctttctgtaaggcagctgaagtattagcaagcagcatgcatgatttataagctctaccattcattcattgtttttggttcttggtgtagtgtttacatcttactaacatctcctctctcccacacccaatgtgaaaacaagacgaaaatttattaagaaggtaaggtcatttgacatacaatctccaaattgaatccactagaatttcatgggcagggccaccaggtaaaatatacaggactcagttaaattcaaatttttgataaacaagaaataactttttaatttaaatataagtatgtcccatgcaatatttgggacatgcttatgctagaaaattattctttgctgatcttaaattaatatttaatggaatatctcatattcttattctcatgtgctaaatctggcaaccctattcatgagattgcctctgaaaacacaattaaaatttttgtagtctcctctgtaacgcaaacaaagaatatccagttggttgatgctggcagaactccatctgggggacttctttgggaaggcaggagagtggtgggcaggaatgaaaagactaatggtgttctgactggtactctacaacccagtgagcaggggtgggtggctggaaatatggcatgacaggatcttgtgtgggtgtctgtctctggtccctgtcatagactgtaattattaattgaatgactgattgtctattttgtgccagaagctaggcctgatgggaattggggacgtaatcatgaccaagactttcttggtcttaggatatgatgatgaccaagactctagcaaaagagatacatattcaacaaacaactacacaaataaattagaattatatagttactataactgtagtagggtcatgcccttgtaatgtttttgaagggtttctggatatcctcccaatgcaaagagaaaaaaaaattggtcacttccctatgaaactgatcagtatagatgtgtttcccaatctttatctcagtatcagccctcaccatgatacttttttagactattttttgccctaatcacccttccctccacgaaattttaatgtaacaaatattctttatacctgttaatgcactgtaattctttaggggagacacagaccatgttaatatctaatttggcataacccttctcccaagaacaaatgcaatattattttttgttgtatattgcccttgttgagaacggtggtatagatttccctcactgatgggtggaatagcccagggagcaggaaaccttgattcattggaaacagtgtagtatggagtcactattaatgcttgggtttggggatcagactccctggattcagctgtcagctctgccccctcattagtgtaactgtgggcaagttacttagccaccaagcaactaaatttccctgtctgtgaaattggcataaaaattagtgtcttcctgtaagttgtagcatttgatagtaccattgggaaattacagctaacagtaatttattggatatttcaaaacagctagaagagaaaaattgtaagcttccaacacaaagaaaggataagagtttgaggtgatggaaattccagttaccctggtttaatcattgcactttgtatacaggcatcaaaatatcacatggaccccccgaaaatatgtaaaactatgattcatcaattttaaaatacaaaaaataatcgttcgtcataggacttttgtcaggacattcaggtgcttaaaacagtgtctgtcactgttaccttttattcttgtcatcaaataaaagtttaaagttggaaattatgtcttcaagatgcaacagtggtccagggagactaagcagagagagaaagggtggtggctgagcggtgaaaacggccaagtatgtaatgcattaggtaaactggagctgtcccaggtaaattctggcactccaggacctggggaccttgttttttgtaacctctatgtgactctgagtaagtgggctaaatgcacatcaaagggaacccttgagccagaaaaataacacagcatttagaaaaggtacaaagccaagccacagaagttacaccaaaatagcgtggggccatggagccgcccttctaatgacttcggcagattgatgattggcttaaagcaaccagagccctttcttagagatggggatgaggtcagccccaacccctggattcttggtctaaaatggaccactgggcaaatggagattctcccaggaaagcagaaggagaggttgttgttgaagtagccacgcttggccactctttgctccgatacttgccgaaggaccttagggcagttgttccctgtgcgtggaaaactctcttcttcccttctctggttaattttcagtcacccttcagatcaaagcacaaccatccttttctcagtgaagtcttccctgattttcatgagtggatcaaactccttgatttagctttttatgggattgagaggaatagcctcaaatcgcctccccactcagtagcacttattacagttgaaattttacatttatttgtggaattatttactgtcatcctctccttgaggacatgtaaccccagcacttagtacatatcatggctcatagaggacactcaaagtggattttaaatgaattattgaataatactttctcttattttctgaaaaagaaaacaagctacttagcatgtgtgtgttaggaggaggggtacttaccctttaaccagtcccctttaatttaattaccgtttagagctaaaatagcaccaggtgctcaagagcgtttgggacgtttgtaatgcagaatcttatgagctcagccattttgacttcactgtctataaaatgcaaaggttattgtaaattccaacattttgccattttgtatacttttaaatggaactggagctattccagtatcaactatcacaaaattcatttccagacgtcagttctttatcttaacttgaacttagaatctgctcaatggatgactccttcttagtattaaaaatttcagcaaagaagatgttgtgtcttgcatcaaatagtaaaattcatgttatttgcaaacatcctttggagaagcaatatgctgcctgggaagagctctagaaaggagccagaagttcagacttgaggccaggttgtgcccttgttcagcgttgggcagatcattggcctcagtttccccatccatgaaaattcatgcattggatcagatgggctttaagactctttccaggatcaaaaaatactgtcaaactttctgaatttgtccatattctatattttttttgagatggtgtcttgttctgttgcctaggctggagtacagtggcacgatcatggctcactgcagcctcctggactcaagcaatcctcctgcctcagcctccaagtagctgggaccacaggtgcaagccaccatgcccagctaattttttattatttgtagagatagggtttcaccatgttgcccaggctggtcttgaactcccgacctcaagaaatcttcccacgtcggcctcccaaaatgctgggattacaagtgttgggccaccacacccggcccataccccatttttattgcaatatattttttcttttagtcagaaaatttattcaaggatattacatccctgggaatttaaagggattgagtcataagtatccagagcaaaaaaaatcataaaatgaagatgtttaggattaagaggttaggtcagatgaacctgatgttaaaattatgagtaccaatattcactcatgtcaagataaattctgactataattctcccaactcttcctttatctcatgactcagtgggtggcagagcatagaaattaacacccccttgctgaagaaatcagatgtcctggaattggacttcagtgcagctgctcagagagagagacagaaagagagaaaggagatacggacagagggagagagaaaaagacagagggaaggaggcggaggaagggaagaagggaaggaagagagaggaagagaggaaataaagaccgaatggataacatttcaagaagttttaattgtggagtgtagggctgcacctaaaagtgaagaaatagggtttgtggacactcttccaattcaaaatcccttcaccaagttccagcctagttgccttttactaactttatagtctaactcagtcatccccaaagtggagtatggagaaaaatttcagaagttctatatttaatttaactctcctttaatttctaattttgatcagtaagatgatgcatgtttataatatatacataaataagtatgcatgtattgaaggtggaaattcaaaatgtttttactgatgggaacttgattgaaaccatttggagaccagtggcctaaataagaactccatattctaacagcaaagggtctcttaccaccaccttgattcctaatgagttacttacataaacataattaataatgcttctatgtttattttttgaaagaaaaatatcttaactttttctgagattttaacacaagtccacattcacagtaaaaatttttaaaatacagaaaaatataaagaagaaaattaacattatgtataacctcagcccatgtttattaaaaagagatcttccatttttaaaattttgagaccattttgaatgttttccctccattttttttaactctttagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaaggtaagtctgattttcaagcgttagagagtcgtccgggcggggatgactccagaacttatttctattgggctaactgttgtactcaacaatgtatggaaggtgtttcttcttcttcaaaatgactcggcttcccattgagtagaagccttctaatgtgttcctaggaaaaatgaaacgcctgtcatgttataaacatgtgtttcgtggggaagaaaaggaaatgaacaagtagaatttttcattctttgagtgacttcatttcatgacagagggttgtggtatttcatgatttcattttccttctgaaatggtttaaaaccctgacttcttcctggtctctttgagcactcttactctggcaagatgaactacctaggggctgtctgtcttcactcctccccagccagacagaatcattcattatcagccactaggtctccactatccttttagaaacctagggtgtccatcagttcaccaccagggtaggcaaacactgtgctctatgacaggaaaagtcaaaccactgtctgattttgttcccatctgaggtctgagtggtgcaaggacagggagagtggggctgagttattctagatctattccttaattatcattgctgagcaagccccagctgctacacatgtgcagagcttttgtctgttttaaatttggccaaaagatgagcaagaagttggagatgagggtgtgggtggaattcatagagctggaaaaatctaacttcagaatttcatcaaaacatctatcgcacttggcacaccatgcaaagcagatgatgaatgcagatgccactgtggtgtcagctttactccgtcgtccagaatccagctggatgcggggccccttgcctgtttgcttcctgtcatacagaaaccttccttccaggttcttcccagaacacagtcttcactatttcataaaaactttggatgatgtcagctgacacattctgttgtaatcctttttcttcatcacccaccattacttatcttaaaatatcttttaccagcaatataatagaagaaacaatttccaagtgaggtatatgtgtatattggagacaagagagaagacttaagtggcccatatctgaataattttagttaaataattaccatgtattcatatgcatattcaaggtgtcttaggaaaaatagagttagcacattaaatttgagattaacgtatgttttgctcaaggttaaataagcatattttgtttaaaaaggaatctaataaaaagacagtattacataaataatggttctgatagtagataaataatggtaaatttgggtcctccaagaagcagacaccaagacagaattgacgtgcaagagatttattggaggaagacatctgtgaaggagaagtaggagtggcagagctaggtacagagagccttcagactacagagagttctgaccatctagcaagaaagagagagaaggaaggagaagtgggtggagaaagcctcaaactgaaggtggtgctaagaaagtcctgaccaagccaatggagaatcatagagtacagattgcctgttccagaggcccacactggaccggaatgaatggcccagtactcctgtcgtgcccagtcattggtaggagcccccagggagaggagcagaagctgaaggcatgacaggtggggctgtctttcttgcaggaatctgagcagcacacttccatggctgctacagatgatacaatatggtaaaaaccacataggtggtgtgccagtggctaaagtttgagaaacactgatgtaaaagctaaaagtttgaaatcagacagctctgactttgagtctcagtttgtctctatgagctttcgtttcctcacttgtaagatgcaaatgataatagtacctatgtcatacaaatgaatacaaatgaagtaaggattaagtgaaataatgatggtaaaacctccaacactggacctagtacaaaagtgcccactgaacagtgttacctctcatctatttcctccgtgctcaggagggctgaagaactaaccaggccgacgtctttatctttctatactgtccagtttgagaaagctgctaaactattgcctcaagtgcttatttaatgtttggaatctacaagagatacagtggttcttctttgaagttcaagctattcctttgaaaaacaatgtcaggacaacttgacattcatctccctaatgatagaatttcatttatttcagtctcactgtcttttgagccactatttagctttatttagtatatcattaaaaatatgaagttaaaagaaatcaaaaaccaaatcccctgtgtctctccttcttgcacccaatcagaagaaaaggctcttcgtcaaagttttacttattcaacaatattgtaattactttatttgtgctaagtactttatttgtgctaagttgttttgtgctatatagtttgtgctaaatactaggcattgaaaaagtagcagtaaacaaatgtctgccctttcctagcttatattcttgtaagaaagcttatattctagcagaaagcaaaatgaggacctttgttttcttttctttaaattacaaagactatgattataaaatcacccttgtaaatttttgaagagttttgaaaaatgcaaagggaaattctaggaaattcttacattttcttatattttcactgataactaacctaacctctctttcttctctcatttttagttgaaaagctttcaaacatattgattttaaagtttataagcctgtagttacagacagcagaaatgaatttttcccagaacaggctatggatatgaaagtataagttgttttgatttatagtctttattgctagagtagttattattataaaataaaaaaatacctttaaggaaaccaatttcaaattatgttgtactttccaaaaacgtgtttaaaatgcagttaactggagtaaatatgccatttattgttctgagtaaattggattctcacttgctctgtgaccttacataagttatttacactatttgagtttcttttcctcatttgttgaataagaggattgggatacacagtcttgataattcttgtgtatggcaaggcttacacaacagaatcagaaaggttgagctgtgtatccctggacaaattggttgaccactcaaagaccctcctttctaatctgtaaaataaggactgtgtttttctcacagtgttgttataagaaaccaataattgtacatataaagcacctaatatatagtatgtgctcagtgaatgatgtcatcatttcttcaagtatgaacaatcagtggtcatgactaaacacccacgtgtggcttctggtgttaacaccacctaagtacaaaacaagtataaaattcatttgctagcatcaaaagatttgaaatccatttggaggaacatgatacacacacacacacacacacacgcacgcacatgtatttgtaattaataattgatatatttggaatatcttcaaaatatcccttttctgctttcctttgggggagacaaagagtggagtgggaaaataatgtgcactctgaagccacagagacattatcaaatctcagttctgacagttactgactgtttaaattttagtggagcacttaaactcttgagcctcagtttcttcagttataaaattggccaatgacatctatctttcgtgtttattgggaggatcgagtaaaaaaaaaaaaaaaaagaacgccaaatgactgatattcagtgaattataacccgattctgaaacaacgaaatttgcaatttagtattactctgtggagtacaggtaacaaatgctacggttgtttagaaaagggagcaatcagtgtacgtcaaaatagacttaagaacttaaaaaacgtatctgaatcatttgggtgatttgtttcaaatacagattttaacaccttcccatggggattctggttaagaaagtctgggcatatgtctgggcaattatggaagcacttgaaagatgggctgaccaatctgggcttaatagaaaatgtcttagggctactgtgaagttaatggactcagaagagctgtcacatgatcaaaatgatgcttttagaagactcactaggaacagggcaaatgctggcttaagtgttaccatatgaaagtcttttaaagaaaccttaagaattgaatttgctctttaaaggagaggaaactctgttattctagtttctatggataggttatctgctgtttagctccccattcttagcaatataaatgtccaaacaggatcccgtagattttaaactagattttttattgtcactgttaatgaggctggacctcaactgtggatcatccaccacaacatactcattggcagtagaaaataatgaattgaaaaatgatattcctggctccctagctccaggcttcctgttatatagagaacatacagaaagaagggagaagttgccttcatttgtctttatgtatgagcatggaaaccatgcctaatacaaatacaagttaaatgtgagatccaggcttggctcaaagatgctcaaagaggacgctataatacatcagtcagctttcaaggagagtagagacacacctcaagccccaaaggcagatgtgatgtttgagtaaaagcaacagtttattagatgttccaatagagacctagaaattaaagaagattggtttccatttgaatactagcttggaatacaacataaagcacttaacccactgcctgacaataatagcctaagagtggccctataatgtgggttgtcatcactattatctctattagcattactatttttttcagctctgtgcaattgcatctaatgcatgctaagaagctggaggaatgcaagccgacaaagaatatttattaaggaacaaaacatattgcaaggagctgtcttcgggaagccctctggaatctggcctcagccctgtttattcaaaatttttatcagttaacttggacaacgaccaagttaaaagaacatttatcaagtttacaagctgggtgggttcactagtgcagtccaaaatataaacaatatgaatctcaaaataacggcacaatgggctgaagttagtatgacctagaatttttggttttcaaaggtcaacataacactatgttatggtacttgggtcatcaagattttaactgagacccacattgtcccctacaccattccaactttggaacctaatataacctattagttagcagtgttaaaaatgtctgtttataaggggttccgtagcaaacatacatctggcccaagcagacttaagaacatttcaaaagcaacatagaattactcaagaaaaattctaaataggtctagtagatctagccagtgtcatttcttcccaacatttataaaaattgctgttgctaattgaaaatataccatgtgcaggtactgtgctaagtgctttacataaacaaaataaatatcagcaattttcatagaatgctgaacatacatgaatccatgcccacacaaatcccatccagatagttctaggaatccaagataggtgatcatgaatcagcctgggctgccatatgtccctactgggtggtcacccccaagccacaccactgccaccaccacagccaccaaggagatgatccgtgccaatttatcccactcatcactgctgttgggactcccaagcccacgagagttcacctgtctcttgcaaggcagcaggcagaaaaccttttccttccatgttgtgcttagctctggaaggagaatcccgctgcagctgcttggaccccagagtggccccatttggcaagacccactgtaggcatccatacagccctttttctccccagtagacagccagttcgagagtagctgagctggaatgagttgttctaccagccaccagcaccctacccagaaccactatttcccacaagccctggaggttgctgattctggagttcttattgctcctggtaaattctcttgctagggtccatttcttgaaacctttatttttgctctacttcaatacattctggcttgtagaaaagcctatagaccactgtaccctaattccagacatggtttgagttgttcctacccctcccccataaacataccttccaggatctccaactcccatgtaaatgagggtcttcatgtaagtaccaagaggaaccatgtgggtttgactccagccaccaggcttcagtgagtcacagctgtgcttcagccatgattttccctacacaggccttattttattttttccttaaaacaacgctatgagcagtagatagtctaacagtcagcctttgggtaagtgaactgaggtgcagagaagtgtgattaatttgctcaagattgcatagctgaaacactgaatttgtacctgattccacagtgtatggtactctagacttgggttctgagcagattttcttttacatgtgtcaaacactaaagggggatcagaacctgccctcttattatccatttttgaattcttattttaactggatatttcaacaaccactaacagaaggctacacttgcaggccagtgtgcaaatgtacaagaatagttcaaaattatttagagtgactcttggacacaatctgagaagcatttaatcctttacatagtgcatttatctcctgttttcattctataagaagtctcttcttgatattcacaggcatttattactgtacaaacacctgctgatctcttttttaaagaaagacttaaaaacaattagaacttactgcatgttttttatctattgtactttttaatacgtactactatttacagcaaagatgttgatatgacatttgctgtaatgataaggcatttcttttaaaatatatttaagaaaaaaatattaagtaaaaatatatttaagtaaaaagagagtcagtttaaagaaaaacatcaactgaatagaggtggtacatggacaggtcaagaattagaacatggttttttgttcttgcgatagttgactgagaatgatgatttccaatttcatccatgtccctataaaggatgtgaactcatcattttttatggctgcatagtattccacaaaaaaccaaacactgcatattctcactcataggtgggaattgaacaatgagaacacatggacacaggaaggggaacatcacactctggggactgttgtggggtggggggaggggggagggatatcattgggagatatacctaatgctagatgacgagttagtgggtgcagcgcaccagcatggcacatgtatacatatgtaactaacctgcacattgtgcacatgtaccctaaaacttaaagtataataataataaataaataaattaaaaaaagaattagaacatggtatgaaaatcattgaagtttgagagatgctcaactggattatttcccaaaatgagtgctttgctaagtagtctgactttaaaaatataaaatagcaattccttttgaaaaagacaatatttataatgccagacttaaaacatcagaaagatgtggaggtctgaaaccataatgaagatttaaaaaatctgttcagaagcagccccttctattcctcaccatcatctacattggtgatggaatctactccaagttcccagttgcttctgaaatatagtgagcaatgaacaaccagaaactttctagacacaggcaatcaaagataaaaactagtcttgttgcaataaactgggacaggaaaaagggtatgtaaacctagaagtgctgttcttaaataatggaagggttttctcagtctaatataaacagtataatgattcctgaaacttttgtgggccggccttgaggaggtctggctttaaagataccatttggttcattacgtgttcatggtattaaccagtgtctgactaatctcagagaaaaaggggtgcagtttcaagaaagtatctgatatggtttggctgtgtccccacccaaatctcatctcaaattgtaatccccataatccccaggtgtcaaaggagggacctgataggaggtgattggatcacgggggaagtttcccccatgctgtcctcttgatagcaagtgagttttcacaagatctgatggctttataaggggctcttctcccttcgctctctcttgcctgccaccatgtaagatgtgcctgtttccccttccaccatgattgtaagtttcctgagtcctccccagccatgtggaactgtgagtccattatgcctctttcctttataaattacccagtctcaggtatatctttatagcagtgtaaaacggattaatacagtaacactactgctaatttcttctgaacacattacaatttcctgataatcagaagctttcagaaattcagcaatctcttttaggaacatttttgtgcccagagaaacttcactgtgggaagaagataactagaaataaattatgcaatctgaagatctcatctagagagaataattctgtatgtgaagaaaggaattcacacgattgccgaaaaaatgtgtttctgacccttgaagtcatcatagcaggggaaaatttggcttttagatgtaaaataaatgtattaaaaccatttccaccactttctagctgtttaactggaacaagtggcttcacctctctgaacttctatttcttactctgtaagttaggatcacaatacttaccattttggggtgctttaagtgagatgatatataacgcaagatgcctagtgcagaagatacatttgtaaatatcacttcctgtcttcccctcccctggatgccttaaaggaaaaaaaaaaataggacttagtaacaaaatggatatagacagagttcttaacttgtaatccaagaggagagacatagaaggtctatgaatcctgaaattatttgcaaagtatattgtttatgtgcatttctctgggaggagagtccagatctatcaaatgagtctcaaagtggtctgtaacatccaccaccatccatccagaagtttaagaaccaccaaaagaaagatgcaaaaatgaactccaaagttggctaactgatagaatgattgtggctttgacctttgacagaatcgggataactcctatcccacttggggcaggactgtatatgccagaattactcctgggagtaaaacggtgtttgaatgtggatatgtaggactgcagctctctagccttccacagacatgttttagtcaaattgaactttgacctaatgaacttggcctagactgagggctgacgaaagcagcggcccctgctgctggcccctgtgctatggtcagggtagggcttggaccctgcctattgtattataaagcctgcttgctcaaaaggacaattgaacgagtttctctgcacttattaccagaattttcctgagtagcttctttgttttacctaacagtgactctgtattgaatgattaattgcatttctctcttttcatcaactactaaaaaatataaaggcaagtacattgcttacctacagcagttagcattttctgtgacaacgcttctgcttgctccatttgtatcctggctgcatctgtgttttaattttctctttgttgcattttaaaatacataactatatatatatatatataccgttttcatttttgtaagtctcctttctttttagaaggaggtgtacctaggcaattcagtgtccccgaacgcaccccaagactgtgagcccaactaaccctttgcttttatgtaacaattttgttttctgtaaccttttaactctcacttttgtttttatcttcctttagtcagttaaagaggactcagtccccacaggtgcggaggagaatgtaagttacacacaccacggcagaatcattccattctcatcttccgccatgttgtacaattgggcattttcagctctggggtcctgtgttcttgcatgctgccagtgtgattcgtttgttgtagactctcttatcccgtatgtgattagggacgcatggaggataacattggatgaatttttgtaactctcattgaatcagtgcaaaataaatgcaaaatcagggcacaaatttttataattgttatcagtaggggctgaaagagtctactacacgtaagaacagctttgcgcttccttgagggataatgatgctccgccttctgcttcattccaccttgactgctcgttcactcttatttccatggtgatccagcttcttactaactttgggcggtacccagggcagggagttgcatcaggcatgagaacatcttgcagcaacagacgctgagaatgtcggtctcaggttagagcgctgacttgacgggtctacctctgagatagagacgttgagcctcacagttttcctggcttttaatcttctagaggaattgtcaaaattttcaagacagttcattcatccccgaaagggatggtgctatataaaacatcacaaaaacgtagcttccagggagattaataaattgacctcgtgagtttcagacccaaaacaacagctctctgccttgaaagaagtgcgcagtctttgggaaatttttataagtagggataagtgaattcacagctccttgagatagaaaccgaacattatcatgttgccaaagcaaaacttgttctgggtgtcccttatttacttgccataaatagggcgtgtgtttttatttttatttagttatgggaactgaacagatgttaaacatccaaacacgtttctgaaatgttgtctgtgatgtggaataaaaattagaatggctgtgttatgattcttattggaagaaaaatcttgaaattgtgtccggagttggttccttccggtgggttcttggtctcgctgacttcaagaaagaagccacagaccttcgcagtgagtgttacagctcttaaaggtggcacagacccaaagagtgagcagcagcaagatttattgtgaagagggaaagaacaaagcttccacagcgtggaaggggacccaagcgggttgtggctgctggctggggtggccagcttttactccgttatttgaccccgcccacatcctgctaattggtccattttacagagtgctgattggtccattttacagagtgctgattggtgcatttacaatccttttgctagacacagagcactgattggtgtgtttttacagagtgctgattggtgcatttacatccttaagctagacacaaagtgctgactggtgcatttacaatcctttagctagacacagagcactgattggtgcatttttacagagtgctgattggtacatttacaattctctagctagacagaaaagttctccaagtctccactcgacccaggacatccagctggcttcacctctcaaaatctgtttgttggttttactgcccttccttccttcctccttccttccttccttcttttctttcttgagccaatcttagcccagcaaagctcaggtctctcatcattccagaaagttctcatgaattactattttatagaaagtcaaagtttctattcccgcaacctacaaggaggactccacaagacttctttctacgaactttaagtttaaaagctgcccgtaaaatctgtagcatctgttagctttgaggttctgagttttctaaagaaaaactttttggatgtttgtgtgtagttgcttgtttaaggaaccctgtgtttcccgcagctcagatgctaaaatgcagagttgatctctaacaggcaaacaggagatattctattttctactgtgaaattttaaatagaaatataaacaggaattaaaagttaaattatcgacaccaaacgataacacaaaaactgatgatagggacataaaataaggtaaaatatttgttaaataaaataaagaagcattataaaaattgccttaaatgacttaacactgcaagcaacattttgatttttaaggctcaatatttcatcttctttttttctgtttgtgtgtttgtttgttttcttgagacagagttttgctcttttcacccaggctggagtgcagtggcgcaatctcggctcactgcaacctccacccacccaggttcaagtgattctcctgcctcagcctcccaagtagctgggattacaggcatgcgccaccatgcctggctaatttttgtatttttagtagacacagggtttcaccatcttggccaggctggtctcaaactcctgacctcaagtgatccgcccaccttggcctctcaaagtgctgggattacaggcgtgagccaccactcccagcatcagtatttcatcttctgacagcctatcacttggagggaatgagactgatggttgtgacgttgatcccatcatcttcaggccacacctcttgagcctcagtttactcatctgttaaatggcgataataatatcacctacactttcgggttcttgtgaaaattggagatcatgtctataacgtgcttacttcagtgcctgaaatgtaggaggaactcaataattttagggatcagcaaactgtagctcatgggccaaatacagcccacaagctaaaaatgatttttacattcttgaatggttgaaaaaaaatttaaaaagaatattttatgatgtgaattcaaaattcaaattcagtgtccagaaataaagttttattagaacacagccatgctaattcctttacatatcatctatggctgctttgttgctaggcaacagagttgagtagtttcaacagaaacactgattggcagggactttgcaggaaaagtttgccaccttctgcagtaattgttagcaaattagcaaataagagacaacatagtgagtgagcatgtcccagtaatcggtgattttctttcctagtgaaatgatacagctcacagctgactcagtgtccatgtggattgaaggaatgtgtaaaacagagttagctttaatttcctcctctcttaaataagagagaaggcattagtcaaaacaatgtatagtgctctacaccttcacaacaggacaattagatatgattaaccatattacaagagtgctttaaataacgacttctggctaaaatgtggttgagtttattctttaaaatttctctacctacaactttccagaactaatctatcaacggatgcaaggcccacttgtatttaaaaaaaactaaaaaacagagtgatgtcaacatttctcaaagtttctcacagaaagaaaaataaggattttgaagcctgtggaagtttagtgcttttcctagaatgtgcttctggtcctatcagaaataaatctttttttaactcttgaaatgatagaatctttcagttgtaataaaaaaaatattttgcccattggttaattgagttaatgttctaatgaaaaaaatttctttccttccaataacctgtaagaccatggaaacaggtacttctgttgtttatctctcttaataagtaatctctcagttgcaagtgaaagaaaacccaattcaacctggattagaaagaaagtggcctttactggctctcattactagaaagttaaattgctttcaaataaaatttaattcagggctctccttgggttcagccttcttggcctggctacatgctcagctttccaacatcacatcactcagtccaaagtaaatgagctatttgtcaagtagcaaccctgcatgtcctggagtttgttctgtttcactgactgaaatgcattcacatgctgtattcgtcagcttttgccaggttgtgttgcagtgacaaccaggtcccaaattacagtgcttctcaatagcaaagaagtttgttttattttttcttttctcactcatgctacaagccagctatcagttggctttggctaacccatgtggcctcttcctgctgaggtcagtagagaagcagcagtcccttcaataaggacatgcagttcttgttgcagagagaaaatagtggcatgggtgaatcatgcaacggatcctaaagcttctgctcaggcatggtatatgtcatttctacccatgttccattactaaagcaagtcacacatcaatgggcacaggtgtgtaattcatttacaggaaggtagggtaaataattggagaaataatacaatttgccgcatgctgtcatttctaaaccaaccacagtcaaggagcttgaccatgttgattggtttagacctttttaattggcttaatccaaattacatagtcttgaagatgggaaagattgctctcccaaagcaaaattagagtgtgtaagcagatgagagagaatagttactgagtagaaaaaaaaaaatctgtgggaggtctttgtaatcaatcacattaaaagtcctatcaaaataatctttaaaatattctaaaataaaaacctttaatgttaatatgacgttgtgcatgaagtttaaatggacgaaatctatttgccataaatcaatttccaaaagccacagctctagtaaaaactgtataaccaaatttcaagaataagtgtggtataaaatttgaggcaaaaagggaaactcttcactgaaatgtatattgtcaatgttagatgtacctgccatcttcatgcaatgtctaccatatcctctacagaaatcaagcaggggggatttaattctaaaatgtagcgcacatctgactttaattatgtccattcatgatatccaaaattaaaatgtgcagatgcggtcatatgttctaaataggaaacaactttttccaaagccctggcctaggagaaatttggaaaattatccaaataaaaattgaattcctatgtctgtatatgcaaatcagatccttatttagccaagattgttctggatttccacactggatgtcagtggattttccttggctactaaaagccagcttcttggcctgacttcaaaggtagtggaagtctccagaagtactatatttttttacctactgcaatagttgtgttctggagaatggacttgtggcctaggatttatgggttgatacctctcaacatttggaaaggctcagcaagggaaccactggcatccaaatagaattgatttacagagttattgccatacaatctgatcattttatttatgagtaatttttcctccaggtctttgcacacgaagaaagaactcactgcctcaaagacagaatacttctgaacgcaaactctattccttatctacttaagagctattttctatttctccactcttctacccttagttttaggcaaagttgccaactttatacccccaaagtatttgatcatgattagtctaagttagtaatctcattttcttcactagtaagtagcctgggggtaagtggcctagctctgacccatgaaatttaggtaccctgaggtaggggatcaaaatacagatgtttatttggtgcaagtctttggctgtgaccttccttctcagaacattggattgaggatgtgatatctggaattgtggcagctattttttaaccatgaggtaacaaataaaatgatgaaaatctagcatgccaagaatagtggagccaagaacaaagagccaaagttgttagagatattgtggagccactcaaccaaccccagaacttcttgttccatgttttcattggttaagccactattagatacattgagttgccgcagaaaatgccatccttattgtaatgcctatttatctgtggtaagactctggccaaatcattcaattgttcactctttatctatagaatagggataatgttatatttcctaagctgtcgaactatcttgatgctatttataaaaaaatattaaacacccggtacaataccaggcatagcaagaagtagctattaatataatcatctctaaatattggatatgtgcatggtgcctaatccagataattcatgctcatggactaaatagctctaacattaacacaaataacaaccactagcattaattgagtgcatggtgctaagaacttgacatgtattgcctgatttaatatgcagacaactttctgatgtgtatgcaattcccaccgagaacagagaacacgaaaagcacagagatgttgggcactgagcttagatgagggatatagatgtgatttagagcccagcaagttgttctggagcttgtcctctatgaccacgagttagattgcctatatttcagcctcacctgaagggctcttgtggctcacacttacttttcggaaatgcgattgaattaaatcagttcaaaatgtggaaatccatgtccatgctctattgccattctcagtctctgatatggctccagtctccacctcgtttcctaaagatagattggggtccaaagccaacagcccagcagcagacccttcctcacaaataggttttgtttggccaatccagcatttttaatcatttaacatctttagatgggacagcttgactttactttgtcatcatccctgtcactacttttggtcttaggtctggtcaatccatgctgatattctctgccttgcctcctgaggacttttgagtttgtaaccccccaacttccgtttttgtttacaaaaaagaaaatactagaaattgtgtcagtagcttaagaaatttaatttagcttaagaaatgtgatttagttgccaaatgttggggtgttctgcatgctgatttactgatgggcaactccctgaatcaaatggcaatacagagactaagggttcttctcgatttggaaaattcgggtcattttgcaaaccaatggtatgttctgtatgatgggaaagaaaatagtttctcagcagacgatatttttggaaataactaagtccccttcccctaccccctgacaccaagaacaaggctccaagaagctaggggtctggcccagcaaagacaagtgggaagatgcctttgactctatggtactttccagggaggcagcagatgaaagccatgtggtttaaagggccagatagtaaatatttcaggcttcataggccatttgtggtctccatcccatacattttatcttttaaaatatttcttccaacgctttaaatgcgtaaaatccatcaggcgtggtcgcgtgtgctgatagtctcagctacgtggcaggccaaggtaggaggatcactcgagcccaggagttgaaagccagcatgggcaacgtagcacgacctcatttcttaaataaataaataaaattaaaaggtaaagactatccttagcccaggagccacacagaaacagttactgagctggatttggtagtattttgccagcccctgcctgaggaaacaaaggaaattaaaaaacctctcctggccaattcactctgtcctgtggcagggaacaacacaaatgcagaaactgtcccagatgtgactggggccctgtacaaatggagtgaggcactgcaaaagaacacaagttgagagcagagtgtggtagatgggcccttccatccaagccgccacagacactcagaggcagaggaaatcgagctcactaggtacagtggccagggccgcgaacaacttagccatcagtttcttgccaagttcatttttcttctgaaagcataaacttcaattaagtgaaatggcaaatgactgttctagggaaaaattagatatcgcttaatgaggaagtcaattaaattcagtggtttttacactctcctttctacaaagaggacagtttctttatagttgcaggggaactggaaagagaactggaagctgtcatggttaccgtctctaacgttggactcttaagaaaatgattattcctggtttctagacaggccaaatgtaattcacctacgtggcagattaaagaggtgggcttactagatttgattgggtattgagcatgctctgaatgacagtccccaaaaaggacctcttatctgttcttccccttggggaagggattttgccacttccatgtcaatgtggcagttgagcttggaaattggtgcgttgtacaacataagcattacttctccaagatgtgcctgtgtagaaatggtcatagattcaaaactgtagctactatgtggacaggggggcaacaaggaccccactttgtaaaacatgttttgggggaatgttttgtttttcattttcttattacctggcaaaataatccaggtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatggtaagccccttacttccagtataggaaacctaagatacctagagcggcttctgggaacaatgggctcatgccacaggtagtaggagacataattgtagctggtgtgtatggaatgtgaatggaatatggattgcatagtgagaaaattccctttcttccttctgattcaatcatacagaaagtctcagtttattgctaatattctttaacccttctttaatgcctgctaacactttttaacaaaaaaagaggtgcccttgggttggaattttttttatttcaatagttgtgagcatacaagtgatttgagattacatggattagttctttagtgtgatttctgagactttagtgcacctgtcacccgagcagtgtgcactacagccagtatgcagtcttttatccctcacccttctcccaaccttctcccctgagtccccaaagtccattatatcattttttatgcttttgcatcctcgtagcttagcccccaattatgagtgagaacatacagtatttggttttccattcctgagttacttcacttagaataatggcctccagctctatccaagttgctgcaaaagacattatttcattcctttttctggctgagtagtattccatggtgtacataagccacattttctttatccactcattggttgatgggcacttaggttggttccatatctttgcaattgtgaattgtgctgcaataaacctgtgtgtgcaggtgtctttttcagataatgacttattttcctttgggtagatacccagtagtgggattgctggatcgaatagtggatctacttttagttttttaaggaatctccacactgttttctatagtggttgtactagttcacattcccacctacagtgtaaaagtgttccgttttcaccacctccacgccaacatctatttctttttttcggccttttaattgtggttgcgtccaaattttggcatacaacagcatctaactggaagttactattattgcttactattatttatttttaaagtttccttctcttggtggtcaatgatactgcttttcttattatggtaatgatatgaggttttctttgaattacatttgtttacataaagaatatcaggcattttaaggattatgtatcaaatagtccaagttatataaagatatggcaaaaattctgaaggtgacgtgagtgacacaaatttggacaaaactagcttatagataaattaaataaggaaatgacaacataatattccaatagtgaaatatataacttagttgatgaattagccatgcttttaatttgtgtagaatagaaagaatgtgatagatatatttactgtttataaaaagcaatgcacattaaatgactaaacagccaggagcttaaataatataatgcaacaaaacctaaatcagttggagaacaaaaaacaaaaatgcatgtaaaaggtcattagtttaattctcttttaatgaaaaacaagaatttcattatagtgtgactttattttcaggagtatttggagtttaatcctttgagaaagcaactctctaatttcacaggctcaacctgttaaggaattctatctagcccacaaaacaaaacaaaacaaaacccttgccaatgggaactgaggcatattagaaataattatgttagaaattgttgacaggaatcattttcttttcctgttatattctcatggagtaaaaagtgtagaatcagttgtgggcggcccatatggccaaaaccccatctatctcattggccatttgatctgcaatttggcagtgaaaatggagattaagacttgagattttttttaaaaccaatttttacatgatgccaggaaagaaaagaacatttggcctgtttccggcaactcatctaacttacaaatgggatccccaaatagctcatcataatattgagagtgatcagcttttccatttctggatggaattgagaggtacagaaaaaaaaaacagtaaatagaatgatggtctcttccaaataaccaacatgaagctccttcatttaaaacagggaaaagtacaagaaactccaaagaaagcatgaaaaaaaaaaaaacctctaaaccactcacagcatccatctaaaacaaattcttaaattctaatgaggtctcatattacttaaatttatcccccagagctatctgttagatgctgtttgggaaaagtttttggcagtagaaaatgggtaagtctaaattctgagggaaacaaattgaaaagaaaagcgtcctttggaatcaattcgctataggatagggatgaaggtaggtgaggacacacttttccccagcaatccccaatggattcttagaattggattccatgctgtccattgttcttattaccagttgcccacgaaaaggcctgggaacacgaacattatctttgcaaaatttaaatcctgattgttggaatttactttaaaattccaggtattctaattatcgtctttttttctgttttgccttcattacaacactatatttatactgtgattaattcaaataaacaaatgaagagttttccagcttactaaagtccctaccactccctattgccacacccagtctagctcactcatttatgttaccggccctttccctgtgggtatttgagtttgcaatccctgatagagaaccgcctgattctttagaacaacttatttgaatcatattgtctggatttatcatactcaggttaaccattgctcaatggatggacatgtggtatgttttcaactttttgcatttcatgcattcactttttcaacaaataattattgagtgtccactatgttccaggcacaagggatacaacagtgagcgtaaacaggtgcagtctcccccggcggagaataaaacagacatttagttttaactctatcctcatattcagtgagcacacaccaagtgtctcacccacgttatttcagctgcttcgcaagcctgtatgaagatcctcacacacttacttctatgcacatgtgttaatgtccccattgggtagatttctggaagttggctctagcaatcattcttaggaaatactttttagtaacatgttcatagcttccaaactgattcaaagtcttcggatttatgcaggaaagaaaaaacctgccctaacagcttgaaaatagagacaacatctggcccatcgctaagggttttttgagcggttggggatgttgagccaaataaataaacgtttcagacaaattttggatattgttagcaaaatatcgatttgtttaaataattgatttaatggaagagagaactcagctgcaaaacctatgctttgattcaccaaatcattgattttctgctttctatcctttgcatttccctcctttttcttttttttttctttttgagacagtctcgctttgtcccccaggctggagtgcaatggcacaatctctgcccgctgcaacctctgcctcccgagttcaagtgagtctcctgtctcagcctcccgagtagctgggattacaagcgtatgccaacacacctggctaattttgtgtttttagaagagacagggtttcaccatattggccaggctggtctcaaactcctgatctcaggtgatccacccgcctcggactcccaaagtgctgggattataggcatgagccactgcatccagctagagatctttttctctctagaaatttactgctcataaaaataaaaatagaggccaggcgcggtggctcacgcctgtaatcccagcactttgggaggccgaggcgggtggattacgaggtcaggagatcgagaccatcctggctaacacggtgaaaccctgtctctactaaaaatacaaaaaactagccgggcatggtggcgggcgcctgtagtcccagctactcaggaggctgaggcaggagaatggcgtgaatccgggaggcagagcttgcagtgagctgagatcgcgccactgcactccagcctgggcgacagagcgagactccgtcttaaataaataaataaaaataggaaaagtatcatttttaaaataactatattttagggaaaggaaaacagaatcatgtaagtcctaacagtgcattcaacacatagagatgtagcacttcacagaaatcctgcgggctcctgcaggattttaaacaattgcgaggaatatctaagacatctgtcatgccctaaataggaaaagattcttatacatattaattcagctgtatgtcaagaaattgaatatttgaagtgctggtgtatttttataaagtgagtgggtagaatactgcattcatgtgtccacaaagcaggtaggcaaatgaaaccagaaaggtggtagatctagatacagttttatacttcgtcaatattaataacaccttacacttgaaaatgctttcctcctccaaactattttcacctaccttatttcatttactcctcctcatatctttctttggaccattagatttgtaagaaaatctttgttggaataatgttctcaggcttagagaaatactgtgagctttaataatgggtaaattaaaagtccaaatgaggaggcagccatgaaatcagagggttttttaaattaattacattcaatctagtaagtctaacaaaatctgttgaaatgtactattggaggtggaaagagggtggtctgtgacggtagttacaaaacagaaaaccgaaagtcttccatatgaaattcttctctgagcattaaaatgttaatactgatttgctctttaaggaaagatttctgaaggaagcattaatttggtcaattcctgtccctaccaatgacttgcattcctttctaccctaagagggtctctgtagtcgttcagcacttttcagttatcggcagtaacaacaatgagagctaccgtttatttattgtctgctaggcactttgcacgcagtatctcatttattaatagagaactctaggaaacaagtgctctctctgccccatgatggacatgaggacacagagactagtgagtatttatgggatttttccacggtccgggagctggtaagcgggagagccagaattccaactcagtttgttgttttgttgtcattttgttgttctaaagctcaccctttgactcatgtgtaattgctgcttcctgtgcttctgcagctggtattctcagaaaggatacgaaggtagaacaaccacatgctccattgttgtgatttctttagtaatgtgttctatggaagtaccattttgatgcattgagctgttgcacttacctaaaatgacaataagggaaaggagaagaaaattaatatatggcttacttaaagcttgcacataggttttctaaatatatttgtcactaaaacaaaatttaccttggctggggaattttgcctgactagtccaattccatttcaagtgagcattgtggtaaaatactaagctcagatccattacctttgttgatcctagaaattttcagtagatcccattcttggatttgttttcatgagactggtctgataaacaatattgcagatatagtcaccatatattaaattttcagcccaattctttttcttttaaatgtcaattgtgtttgaattatattgccatcaaaatacattaacattcccttcaaagaaatgtgaactgaccaccaaacacttttgctagatttttgaatagctaagtgatatacattggagatggttcaaacattcctcagagtatcaagctataggaatgcatgacaagatgaaagaaataaaaaatgatttcattaatatacaaggcgtgaatgccacaagtagattccatctcaacactgcaggctgaatgccctgagatacttcacctttgactgtcatgaataaaaattaactccatgaagaaagttgctcaatatcacactggaaaatctctgaaattacttcatagtctttaaactgttcttcaaagtattaaatagtctctggaagaattttagtctctttaaacagtaactttgctatttttgacagctggaaaaaataagtttctatgtttatggttcctttgaatacagagttcaacatgaattattctgatttgtctctgcaaagaaaaaagaaagaagggtagaagaaaaggagggaagtgagggagagagagaggacgagaggaaggaaggaaggaaagaaggaaggaaggaaggaaggaaacagttgttattaataataactgctgctacagaagtgacttcagatggatttaataagattctaagtgtaaacccaaacttcagtcacctttgcatacatacagctttacatgcctcaaaataagcaataaagaaaaatcactgaaaagtttgagatactctctctctctttttttttttttttttttttttttttaagaagttgaactttgttgcagtaatctccctgacagcctggaggtctgttttcatgattcatgatgtcagctgagatcagctgctgtcaacacagccttctgattcaatcccaattcttctccaagggctctcaaagaaatggggggaaagaaagcaaattgaaaccttaaattgacagagtccctaatgaatgccaaattgaaacaactaacgggaagtttagaattcctgtctcctagggggcaagtgagagaactttattctctagaaggtggtggagtgctcatgcgtgactcttcatgtccattcggtttttgcctaaaaagccattttgtgcatttgtttgttttttgctgctcaacattcccaaaggttgacagatatgatccaaagccacagtgtaaaggccacttgggaatgggcttgagtaggaagggctcttacgacacagcccgaatttggaggctgaatgaaatccttacgtgtccaaagctttgggtgtgatgggaaggctgacagagctggttatgaggagggaagaaatagccaacagttcatttctttttctaaaccttctcaagcaagactggcctttgtagaacaatgcacaaggcacggaggaaggaaaaacccactttccatgtagacagatctaaattttatggagaggacagtctgatctttgtttgtcaatcttagtgaaacctgcaccaatgatgttcctcagtacacggaacttccagacaccacctctttcacactaagcagtatattaaaaagagcacaacccttctgtaatcccagtgctttgggaggccaaggctggaggatcacttgagcccaggagctcgagaccaacctgggcaacatagtgagactctgtctctgcaaaaaaattttttaaaaaatagctgggccaagcacagtggctcacgcctgtaatcctaacactttgggaggccgaggcgggtggatcatttgaggtcaggagtttgagaccagcctggccaacatggtgaaaccctgtctctactaaaaatacaaaaattagcagggcgtgttggcaggcgcctgtagtcccaactacttgggaggctgaagcaggagaatttcttgaacctgggaggcagaagctgcagtgagccaagatcatgccactgcactccagcttgggcaagagagtgagactctctctcaaaaaaaaaaaaaaatagctggacatggtggtgtacacctgtagtcctatctatctgggaggctgaggcaggaggattgcttgaccatggaggttgaagctgctgttaatgatgattgtgccgctgtactccagcctgagtgacagaatgggaccctgtctcttaaaaacaataataatatcaaaaataaagaagagcacagttgactcctgatgaggggacatcccataaacatccacatttgagtttggtcatcctccatcttatccaagcttttatcattttgtttaatctaacattcagcaacttcatacagtgaatgctcaataaacgtttattgattgagtggtgcctcttgccttctaggggcagtatggggaggtggtttagagtgtggaatatggagtcattgcctgctgtccaacactggcactcaaacctgctagttccatggtgatgctagtatctttgagcttccatttccttgtctgaaaaataaagtaattccactatcttaaggttctgacataatgaataaatgaaataatgcaagttattatctcatttagcacaatgcccagcacttagtaagcactccactaaaaattatccttcataaataataatttgtattatctctaatgtgaacaccgtagctcagacaacaaagatacataatattaatcagtcaaaaagtatttgagtgctttcaatgtttctggctgttcttagtgcatgtgttgtggattcttacggtctgctaagagaacagccatggccataaataacagtggaatctggagtcttcctctttgccccatatggctgaaaccctgctctctatactcctcccttagctgggaagaggagacattaagcagtgatcaaacgtgtgggaattagacctgagtcaatgttgttgataagaaccgaacattttatcaccaggtttcttaggtatcaggcactaagcataggacattactaaatgcaccgttaaaaccacagaccccagcatgagtctgaacctgtatatggccaacttgctgagagcggtggtactcaaactcagacaatcctcagcaccacctggagagcttattaaaatgcagatcattgagcctctgcctctgaaagcttctgattgattagatccagcctgggtctccagaatttgcctttctagcaagttcccaggtgatgctgaagctgctggtcctggaatcatacttctagaaccattagcttagagtgtggagtttaaggagtcaagtccaaccccttttatccctgtcactggtgttgctggctatagggggtgctaaagggtggaaaatgaaatattaaacaaaactcatatctctatcaaggagagaaaaaaaaaaaaacaataaaacacccacagcctaaatattcccagtggaaggctactcatgggtcaattgttcattcagtcttcatttaatatgttcaactatctcctgcttccaacattaattggaaccgtcatcatttatctcagaattgcctaattccaggatttagtacttttgttgttatttttggaggccaacacttgaatttaattagatctggttagaaattgcatggaaatctctatatccaatgagtaacatgtttccagttggccttccatttgtcttgaccccaaacctcaatgataaatgactgagatcatccatttcagaactttcttgcattctccacgtcactgtacttgtggctgaaggccattgtctgtttgttattttagtcagtgaaaggggatggagggatcacccactcagaagaaataaatgggaaagactccagctgccaagtaagtgacctcgaactcagtttggtggtgggattagtggtgtattctcacttcttcacagtatacttttcaataaaattctcagccacagccaactcatttaatatctcaggattaagcacctactatatgccaagaactatgttggggtctgcagacacaagcatgaacaagctagagttcctcagctttatcctatcaaaaaactttcacacatgtgcttccctcttttctgcattaaaaatctcttctcacccttcactttttgccataaatgtcacctcttcaaaaagaccttccatatctgcctctcataactacatattgttcttttatttcatagcgtcatcacaaattgtaataattcatttatctcccctgtttcttctcatgtctgtctggaatgtctgtggagcaagaagtctccttcttctatttctctatcaccttgcatggtgtttggcaagtactagaatctatgtcttgaacagaataaagacatggagtcggggggtcacacagtttgctttcattattttctttattctaaagaaacatagctatgacatatttataactacatgtgttcctttttttaaataggatcatgcagctgcactctttttttaatttaaaaatacacctccacaaaaaatggcatcaaatattcttctagtagttttgacaatatagagaagtggctacaagaatgagtggtagactcaaactgtctggttcaaatcctggctcagccacttttttttttttttgctgtgtgacttaggcaaattgccaaatctgtcagcacctcagtttcctcatctatataaaggagctatgaaaagtacttccttatggggttgtcatacttagatgaatcaatacatgtaaaacacttagaacatttctggtatagagggctcaatacatgttagctactgtattagtcagcacgggctgccataacaaaatgccataggtggttgctttaaaagcagaaatttattttcttgcagttcttgtggctggaaaggataggattaaggagtaaccaaatcagcagggtttggttcctggtgaggactctcttcctggtttgtaaatggccaccttcttgcttgtgtgtccttacacggcagagagagaaagagaataagcttgccaatgtctcttcttataaggacactaatcctattggggcagggccccaccctatgcctttgtttaaccttaattacttcctattccaaatataatcacattgggagttaaggattcaacatatgcgttggggtgggggcacaactctattgttaacagtgtctatatgttactattactattatgctgctgatagggaatttccatcttataatgttgcccatatcacactcacaaatggacggtaatgactgtaaatatgtttttgtatttttatttccataataattggtttatcctacatttttaaacaggaaatatattgctttttactatactcttcatatttaagcttttaagacaagcttaaatatgatggtatattttgtctggaattttacagtgaaggaattatgccaataatcttggtgattctaaaattggaatgacatccatacaaatccaaataagctagaaacatccttctatttatacccacctaggagtgttttcagaatccaattgggaattttattttccggagccttggattcagacttgagaacactggtgtgtcctttccatttttagctaatttaattctcacagcaccataaggtgtcatttcttttattgctcccatagagatgaggaaactaggaggtcagtttatccttggtcacacagcaaggttatggtggaattagaaacaaaccaggtccttctgactccagacactgagttcttagccactcactgcatcttaaaatcttctacacaacaaaaacagttaacaaggcatttgaactgggatctctggtttctggcctttctgaagagcattgtggtgagaatttctgtttcattctaaggagagtatctgctctgggatatctattgtacttggacatccatatcttagcatttgctgcaactctgacagttggggtctgccagaagtgttcaagacatatattacagaagagcttctcaaggtacactggatgcctgttgcttctttctccaaggacttctgccctctgaagagcaccggtggaggccttctggaccggggagtctctgctgtttgtcttcccgcttacttctaaggggcgtgcatgattcactggtgtgaaaagaaagttctcctacagttgatgccttctccatcaaagctgctaccttgttgtagaactttttacctgggtacagtacataacttcatgaatcatgcttatacacatgtatccggtgggtcaagtgtgtttgccagttgccacaatcagggctttaaaacttttgaagtcaatatttaaaagttgacattttgcattttttaaaatttaatttcaaggttgtcttgaaacaacagaagctctgaccacactggggctgcaagcctacgtggtatctcttggctggatcagagcaactgttgccctttggacagggcatgtaacattcagtctcccctgctctaaattttctccccaacatcaaagccagccttgcttgaactggtgcttttcttatactggagaaatatttttttggacctttgttgcttttgcagctggagaaataagatatccacatggttattcttaccccagcctgcatttactagatttttggattttacagcctcatctcatcaaattattggaagcatgtgggattgtaaacctttcagtttgacaaaaaacgatatacattccaaactaataaaacaatcatctcttttaccaccatttcatgaagcaaaaggacaatttcacaccaaaaattagggtagatgtaattatgaagaaaagaatgggcatccccaggaaaacactcgcatgtggttgcaagtgggagtagccccttcaaagctggcttaagcataaaagggctccaggaacagctagatctaggaggcacgcatgataccatcaatgcctggtccctctctctctctctctctctctctctctctctctctccatttctcagctgtgattttctctgtgttggcttccttttcggggagattttccctagaaatattggtggttctggaagctccagtcttacattttcacagcttcagatctaacagaaagggaaccagcctctctctcatttcagcaaagctctgagattagctccagtgttatctgcatttggctatgctgagccaatcacagctggccaatcatatacaatgctctgattagtcaggcctaagtcacatgctcttgtctggaggtggaaatagtttgcctggaccacacggagtagatgaggaagaagggtgtttccccaaggaaaagccaagttctggttccagaataagggataaagagtgctttctgggatagcataaaatgtattaatgaattattagataactaaataaatgtccccaccatgacttcataagtgcacattttacctttttttatattcatttcacctaggattcatgaaaatgtagataccacccaacatttgaacatctctgttttaacatatttattcccttgctattgagagttgtcctgcagccactaaaaatgtactttgtttgaaattgctgtagacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctggtaggtggattttttttgcctcttctttctgggctctctccttccccaacaccatctgccccagtcagtttttcaaattctacatgtggctcttcacactgggatcccgggtctatcactcagggtttttgaactgctatgtgacttccagcaggttcaatccttctccattttacaagctgagaccttgagcaaattattgcctctctgaaccagattttttatctgttcatacataatgatgcctaactcatagagttcatgaaacaggtgagatactgcatctagtcacctagcacagtgcctgagacctagggagcaatcagcatgtagaagtaatcgtcatcatcaccatcaacatcatcatcagttttgttcagtgtcttgtgcgtagcagatgctctgggtaatatttgttgaatgaatgaatgaatgaatgcattattggctgattttatttacattatattataccaatttgacgtgttaaaaaaattagacaaatcaaatttaaacacactttatgttgtgagcaaagaacagttcatgaattgggcagcactcaaaacccaaagaggttcagagagcactgcccagtggcatgagcagtaagattttataggccaaacatggaagcaaagtagaaaacttatctgattgggtacaatgaggtgtttgccttatttggtcacgatgtgatgagttgtctgccttatttgggaatggtctgatcaattggttgcctgtgattggctgaagctcagctatttgtgattggctgcaacatggctatttgttacaaaaaaaaggatactcataaggtaggttttggtttgtttacttactaaatgtggttgcagtttgttacatagacactgggagtaaggagactgcctcaggctaaaggcctcctgcttatttaatttaacaggggtataaatgcacaattgtgttactccatggactatagaatcaatggctgctagatgcagaggaaatttttttactgcttgcaattttaggcagactggtggggaggtgttttagatgtgcttattttactctcctctacaaaatggaagcccctcttcaccactggactcccagctccatgagggcagggcaccacctttcaggttcaaggctgtatctcaaggacttgaaataggactgcataaacagcaggtgcttgatagacaaaggaatgaatggatgagattaaaataatagataccaaaatatgatatataaagttggaatacattacttgaaattgttacccttcgataaaacattgtactcaactttaaccacacttaacaatttctacttgcatgtttaaaaaatacccactttgagaatggagacactgaaagtgggtatccactaatcatttgatttacatatggaaaccactgaaatttcttcccttccttccttccttttttcccttcttccttctttcatttttcttccaaaaatatttattaagcattccatctaaagcacattcacactcatagcttctctctcctatcccacaagatgtaatagttccttattagcttcttctttctgggtgtagtgcagtcttcaaactaatcatgtagtccttgcagtggtttcattgatgtgaggaaggcagatgttgatgtaaagcaagaatgccagtttgtagccctgagagaaggacttcacccaagtgggtgaggctgtattggatttgccaacgcaagtcttctcaaaatgtactgtgcacacgaatcacccagggatctattaacacacattctgattgagtagttttggggtccaacttgggatgccacaaagctcctgattgatgctacaaaagctgctgatccagggatcacactttgagtagcaagttcctaaaggaccaggaaagatgttggggaaagtatttggatttcttgtagtttacttcttttgtttttttgagatggagtttcgctcttgttgcccaggctggagtgcaatggtgcaatctcggctcaccgcaacctccgcatcccgggttcaagcgattctcttgcttcagtctcccgagtagctgggattacaggcatgcgccaccacgcctggctaattttgtatttttagtagagacgggtttctccatgttgctcaagctggtctcgaactcccgagctcgagtgatccgcccgcctcagcctcccaaagtgctgggattacaggcatgagccaccatgcctggtcttagtttacacgtttttaacccatgatttattcattcatttaaaatgaacaccacccagggaatgatttacactgtggcttctaattattttaatagaagccagcctctacaataggtacgaaggctgaaaaagaaagatggtatggaaaagttcagatgatttctaataatctggtcattcacttaacaaatatttgtagaatatttagaatcctggcagtgagctagaccaggggtattaaaaatgcaacccttgtttctataaataaatttttattggaacattgccatgttcattcatttacatgttgtctagctgctttcacacaaaaacatgagggttgactagttgcatgactagggttgactggttgggttgactagttgactagactgcatggctcataaggcttaaaatttttgccaactggccctttgcagaaacatgtgccaagccttgaactaggcgctggaggtatattcagcaaacaaaggggacagggtccctgacatcaggggttcatattcgaaggggaagcatgcagctaaaaagtattagtagataagtttaaaaacaaggttaaaattattaaaactacaacgttaaaattacaaaattaaagacaaaatttgccaacaaaattgtaggtctgggagatcactgagggaaataaacaaggtcccgcgatagagtttgcctgagtatggatgggggggtgtgtgctacttttgcctgagtgtgtctggggggcagggtgtgctacttttaatcggtggatcccaaaattgtctctgaggagatacatctgagatgagacaggaaaggttaaaggtgccagacaggaagagagcaaggctctttcttccaggaggaggggacagccctggcaaaggcacgggggtgggaatgagcttagtgagcttagtacatttcaggaagagaaacaaggccgtggttgctgagggtggagaggtagggtagggggagaatgatggaagtaagattggagccgtgggcggggacctcctcatgcaggggctgtgcaaggaatgcagacataatcctatctgagcagggaagctactcacagatattaagtaagaagtcttggcccctgttgataacattcgaagattttattttgctgctgtggtggagaatggctgttgaaggtcattaggagctagttaatacaggtcatatttcttgggagagctgatggagattggcctggtgattcctgaagaagtgacaagaagtggacaggtttgagacactaattacagttctagacaccgagtccctcctctgggaccacactcctttacagacctcatctctttaggatggcagcatcccttcaggctgggactgcttctgccacacctcccagacacataagccaggcctccaagaagctgtgtcttttgctgaacattccacaggttgtcagagacagaggcagcattcagctcaggccccctagaccccaagtcctgcatcgtcccagtgtcacaaggcctccagcaatgatggaggacggaggggggcttccctgccgctttccaaagaccaagcctcgaagactttcaagctggacacattccccagggttgcctgaccgccttcctgggaggggaatgctggcagccgagcctgtcaccacccacagaactattgtggtgcctgttacccacaggaaatgagacacaccgcaggccgatccctgcatgatctttgtctcacagtgacgtcctcgttagtcaggtccttttttcctccttctccatcatgctacttgagttctaactgagagcaacccacttggttttcaaaaatctgaaaagaactggaaggaagcccttggaattcacaaagtccaactgtttgaaaacattttcctttctttttgagcaaagggacttttttgtttacaaaagaaaatgtcacaaaacctgggggtgtgtgtgtgtgtgtgcggatatatgcatatacgcacacacagacacatatgataaaagtgaaactattctgattgatggaagactgggtttctcccttcccctaagcaccacttctttgatggccctttcccagccttcccctttcccattttcatgagcccctgaagtgctagattgtgtgcagcgcaatctgcaggcaggtttagcaggtgaacaaatggaggcttgaaaggggaagacatctgtccacactggtgtgggctgaaccgaggcttgtgacaatcagcgcagtcactgcaaggagcctgagaccgagggttggaaagagcgggcagtgaacagaagagagccggggacaacaggtgagctgagggccagattccaagtcaaagtggccaggccgttaccgcatgacctagtcctaggtcatcttggagcctcagtttctgcatctgtaaaatagggtgaataataatcactgtccacctcactgggctggagagagaacaggtaagagaatgggtctggtttggccttgtgaactgtgacgtgtagtcctggtatataaggcaggaaaggggttgcatttatgtctctggcctccaaggtggagtcccagtgaggccagaagggcatgtgtatgtatgaggccagtgagtcaggtgtggtctgtggctacctgaagggcaggtgcccacctaaagggggtgcccctcctcagcaccagccacatgttaccttgggggactgcagacccattgtggcaggacctgtccatttagtcaagagaaaataacaaaggtggagaatttttaagagcaaatacctaatttttaaatgccagcatctaatttttttttaataaatgaagaaaatgcttgtacaagttcatctattgcaaagttcaggcccgtggcagccacttggccatctgagtttgctgtttagtccatcaagccccaagatcaagctcatggaacctaaaggatggaaacctcggggaagtaagctttaatagaggtgagttgactgggcagggtggagcctgggtgaaccaggatccacggcaaggcacgctgggcaaacagaggcaggatggatggctgccacccgtggccagcctgagaccaggctctagacacttgcaagaagcttgttcctggacttgaacctagctctcatctagtggctgagtgagcttggacctgtcatcttgctgagtttcagataccagatcaatgaagtgaatggtgctgacgtcacagggttagcatgaagatgaagggcagtagtgtacaatgcccttagagcaatgcttgtgaggtttaactagtcaggaaaggctattttgtgagtattatttagttagcccctgccctgggttgtaaaggtgcagagatgagtcgggcaccgctgtgccatggggagtttgtgctctaatcacagcaacaagcgattacaatgcacggtaaatggaggggttggggaatggcctttacccagctcagggttcagagatcggggacagaagccggcaccccacttactggcaggaatttgactgaagtggcttgggctcgctgggcttcagcagcctcctctgtagcctgagagcgacagtggcgtcaacctcgtgggctgcagtgaggaccgggtgggatggcagtctaagacctcacacagatgaggcagcaggctctcagcggtgagggaccggccagaggtcatgcaaccagaaagggatggagcatccccaaacccacagctgactcctgagcccaagcttttggtatttcacggtgtcctggtcatctcttgatgccccaaaactattaataacacaatgtattgtctgcagtaggtcctcaatatatgttgttgaatgaagtagtgaattcaactaccaccactaaaaataatcataactcttttatcacacttactgtgtgacaaagattgttcaaagtacattgcatatactaacacttaatcttcaaaactaccctgtgaattcccattttatcaacggtaaaattaaggcttaagtagagggttaagcaatttgaccaaagtcacccagctaggaagtggcaggtctggcgttcaaagaccagcaatctgattccttggtaaattacatgaaattacactacactatgtagtaaatacaatatactatactatgctagattatacagggcactacacagtctatgtactatatacatatactatatatgtgccctatatacatcatgtatactaaactacactctatttattatgctataatacactctatatactatattacatattatacgatatcatgtatattctactgcattaaaccatatgacactatgtacatatactagaccatacatactttgtgatagtacattatacttccctttcctatactatatactatagtgttctgtatatatcatactatattgtacattatgctttgctatactttatttactatactatacagtggactaaactatactgtgctatagttaccatacttgactatactatatatgtatactatatatactataaaatatacactaccctatattatactatcctatattaccttatactacactatactatctatatatactatgctacaatacgttattatactactctatactatactctctctatgtgtgtgtgtatatatatatatatactgtatacaatatataaatcttatactgtactaccctatactgtcttatagtataaaaggaggcccacaattgatccatgcagcaaggtggatgaatcgcacatccactatgctacatgaaagaagttagtctgaagggctgtgtatactctaggatcccatgatatgacatcctggcaaaggcagaactctagggatgaaaacagatcggtgcttgccagggtctgcggtggggagcggttgaccacaaaaggcacaagaaagatctgaggggggacagaaccatgtgacatgttgatttggatggtggttttagggggctatttgtgttggtctaacctcatagaaccaaatacagaaaaggttaactttactacttataagttatacttgacagaaacggtaaagtaataataataataatagtactcaggctagacatagtggcttacacctgtaactccatcactttgggaggccaaggtagaaggatcacatgagcccagcagttcaagaccatcctggacaacaaattgagaccccgtctctacaaaaaaaattttaaaattagctgagtttggtggtgtgcacctgtagtccaagctactggggaggctgacgtggggggatcatttgagcccaggacttcaaggctacagtgaacatagtcccaccactgtacttcagcctaggcaacagagtgagactttgtctcaaaaaaataaaataaaataattgtatctgcctgacaacattccttcacccacattcagtcaatgttaaggctaggtaccatgtgctaggaacctgcaaggcactgagacacgcagaatccttgcagcttccaatctggtgtagaagacagatgttagacaaataaattagataataagatcatttcagagagtggtatgttctgagagagaataaaatagggtttgggatggggggttgggggaaggatagcattaggagatatatctaatgttacatgacgagttaatgggtgcagcacaccaacatggcacatgtatacatatgtaacaaacctgcacattgctcacatgtaccctagaacttaaaagtataataaaaaaaaaagaagaaaataaaacagggtggtgaacctagatggtaactggggagggagctaaagtgaggtagaattagtaccccctaggtactaagtacattataagcatgaactcactttatcttgggaacaaccctctgagataagtttgtcatttccattttaaagataaagaaaccaaagcgcaaagagatgataagtaatttgtccaagatttcacaaagctagaaagtcatgtaactgggtatcgaacccgggcatctgactggagaccattctcttacccagcactgaggaatgagatatattaatttagcccaacacctagcacagagtaagtgctacataaatggccattgttgctgttgacattacagagcttcaataggctgccacgtctttctgtttttctccagggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaaccgtatctttctttttctgatttaataaaaaatacatttacttctaaagtatcttttaattttcaacttcaaagcagtcccactctatatctgagatgactctaacttctacattataaaatccatactctttctccattatcttctttggaagatcattctctcccagatcttcccggatttccttgtatatgggcacacacacacacaaatgtgtgcagttgtatgtttgcatgtacacacacatgcatgtatagaatagtgctgtcttaggccaggttgcttggagcagagcctgagatggggatttggacgcataggatatactgagagtgggctccgagggaaagggagtaagagaaaaagaagagggcaagaaaagagttgggcaagggttggtttcaactggagcatgaattgcaccacccagatagtttgaccttgagtcaagggagccagcctttgaaccctggtaggtgaattctgggctgccctgggaggtggggggatgggcaagcggcccccattgagctgagaagctgggatgcctaagtaactggaggatgagtgcattgacagtgtccactacagatacacacctatatgttcagatacatatttatacccatatttgcatatatatgcacatattcatatatataaatatatatcatgcaggaatagatccatgcactcacacagtcatatttacatacatgcaaataaacacatgtaactaacacagatccacacacacacattggctcacacaaatctatctcatatgcaattcatcacacattgatcggagataaacattgaatatactctcctgatgtggatggacctcgactctaaggacaagtttgctgcttaggcaaattacaccacggctttggcaaataggcatttggaaaatgtgttcagaaaaatatggtatcactcaaaacccaagcgtaagtgaggagaggatcctgagctgctggggcctattagctcccagcttggacaggtcaaattcgtgtttccaataaagaccagaggtcttttccttgcagctgggttagttttttcaaacctcctgaccatacctcgagattactcacacctgtgcctcacccagttgagaactatctcgtgccgcttagtatcagaatgcttaacttggcatgaagcaggaaaacagcacttggggaagccattggtgggaggcccatcactgccatcgtcagagcacggggtgattcaaggaaaccaggcagctgctattcctttgtctccaaacaccgtgggggttgtctgctgcaacctttggtgagctcctgagctgcagtccattgaggaaggtgacagtatcatttgcaagtttcacctcgctgggtacaggggctttttgcccagataagaaatgcccctaggcaggaggaagagaaacagactgagtagcccaggccagttacttagccagttactaaggcagatggagccctcccaagcccccactcaaacaaaacaaaacaaaataaaacaaaaaaaaagcctctttgctgagaatctctctgcaaagcatgccaacagtttttataactggtttcctatgctcctgggccaaaaaagagaatagtcttttaatgaaattgcttttttttaaaaaagcaagaaatgccagagagaagtaaagcgcatgacttactgggagaactctaaattcagttatggcttaagaaacaagttaatactccatttttgtgtttgtgtgtgtgtgtgtgtgttattgttgttgagatcccatttccaatgcatttacaataaatactaatgcccaccccttatgcagaactagagtgaaaaagagctgaaactcaccaataaacccaagaaagcctttaggacacagattcccagaaatgccatcagacagaacaagcagtgggggaaataagcaaagcaaaggtggcacacagaaaaacatgattaaaagagaaagaagaattaagacctgggggagggagcaaaaatgactttcttattattattatttatttacttattatttatttttaggtacacagggaagtgtgtcttctcccatgtcaagaagaagtggcctttccaggaatggagctattgagctgaaatggctgccactgcgcgtacacacacacacgcgcacacacacacacacacacacacctcccttccagttccagctgacggtgactttttgactggtaaccataaaagaattcattcaaaagggcagttgttcccagcagccagtgaggtccttcctgcattcgttgtcttggagaaggaggcacataacaaaatagaaaccaaaatgggaaggaaaagagaaagaaagtgaaattcctggtctttgttgtatgtatccccttgctttttagataaattatcaggggttta

SEQ ID NO: 16051 - DNA, 15853 bp, Human; identical to SEQ ID NO: 12121

SEQ ID NO: 16052 - DNA, 58879 bp, Human
  misc_feature (1)...(58879): n = A,T,C or G
aatgaagagaaaaagatggtggtatacttgaggagaaaatgactttttagcacctatgctgggaagaatagttgaaggaattggaaacgaaacaactaatgatatttaggcagtgtagaagtcagaattggaaataatggacttataggatcttcaatctgaggttgggattcattatgcaaatactttagcaatctggatataagattagagaaattgatggctgaatttgggatttcagagaagatgaaacagaaaatcaaggaaccaaggaagaagatgagctgagaaaaatagcaagacaattattgcagttctggctcatagagtttaggctgactaaggaaagaaagacaatcaaagcttctgagagtttagggaaaaggcacttgattctgatcccccacaaatcactgagactaaggagttgatgctgtatttggtttaaacctaggtgatgtattccctccctgaggtggagaaaactcacagctgagaagaaagttcaggtatgctaccatgaaaaccatgaatgcactagcagagaccactagttccctactttcttctagggtaagtgaacccctaatttttagcggtagaaataacaacttcatttcctaatgtcttctgtagctagacatggccatgtagctaacgagctggtcaaaggaatgtggacaaaagtggtgtgtgcaacttctgaactgtgcccttaaaaggaaggtgacattattgttttcctttcactctttttctgctggctggaatgtgatgtaactgcggtggtgagctgacttgaaccatgaggaagagactacatcctagggagggcagaacaacagaaggggcccatgtccctgaatgatctcatagaaccttcacaccagccctagtcctacataagggacaattaattaaacttgttcatttttcaaaccacttttaatgtgggtctctgtaacaagcatcaggacctatatttcacctatttcaggtgtccactaaaaaagataagctgggaatatatatgaccatagcataagacagaaagtagtaagcaataaatagagacacatgtaaaaattaaggatgtgtataataatcacctcaagtcaagctgggagctttcataagaggttgaagtttttgatccatgacagactccagactttccataaggtggtggatttgcaggccagggaatgtgactatgtgctcttaagaatcatccattgattttcctatcatttttctagaccttttgacttattgagaaaagaattatgtggcttatgataaaattggagtgaatcgcagacgagaaattattcagagtcctttcgttatctagagctgcaatcactaaataggtaaccactggccacatgtggctaattagatttaaattaattaaaattaaataaaattttaaaactcagttccacacaccggccacatttcaagtgttcaggggtcacaggttgccagtagctactgtattggacagcacagatagggaacatttccatcatgtcagaaaattctattggacagttctagagagatctaagagacagtacgtgtctctcgctcaccaatactccatctcgcctcagcctgcgtgcaatccaagcccagagactggtgcccaggctctaccacttcctacagaagatttaaaaactggtagtgccaacagaaattatttagcctagtcccgccaagaaggtgatgtggtaataaagtccaagattctgccacataagtcgggtcagcaagtcggtggcgaaaagagggccacgtcccagactttctgggaggaggcgggacaaaggggcggggcgagcgcagcgccctccgggtgggcgccgtcaagaggccgggggcggggccgagcgcggctgggcggggccttgagaggccggccgggggcggggaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagaggtgagaccgcgtcgctgcgggtgctgcgctgcgtagctgccgcgcgtctcacctttcccctgccccgacttgtccctccccatcccccgtgtttgcaaggaccgtcttggggtgacacctgtgacgcgagccccacctccggtgcctgtcagagggatgtgcttgggctgagcgcagggcctcctcaggagagcagcctgcggcccgcgggtgccgacctaatcctcagaggggccagaaccgaaccgagcattgcagcggcgctttcccagctcagctggccttcctcggtgtctcttgcacctcctcctcttcaagccggagaagggcttgctctgcatcccagtaaacctccaccgagctcttttgaaggggtgctcgcttttcctttccagagggagggtgtgccgctgccaggggagcgcaatgaagtgagcgctgaggggccgagggtctgtggggaacgaatgggtgcactttcccaggaatggcccttcacggactgctggttcctcttgagggagctgcttctgatttggactgttaaataggtaaatgcatttgcctctttttgtttgtctttagttcctagacttttaaaaggtcatagtatttataaaatgtaaagctgaaggcaggattagtccaggaaactgctgttgtgtgtgtgtgtgttttcgaagttaccaagggagaaatagaaacagatctccactcctttttcctcttttctcgcttgatcagcgatctctgaagctgtgtgttcctgtttttgtcaaaggaagcaccctctataaacttaactgtattgggccctccttatatccagttccatttgaattgctttgcgtttgatgagagcacccacacctcacagcctaattttaagtgtgtgtatgtgaattaaaatgtatgaaatttcccagaggattgtttactgtgggctatacttgcttttaaagtattttcaataagctttcttggcttgtttaactctgcaccaaatcaattggaaattactgtaaaatatccattatctgaaattcagttacctgaaactggaaacccggaaacagttttcagcactgatcacattctgctaattgtatatgcagtgtcccacccaaaccccacctcccctcaggttataggttttctgcagcttagtgttaatttcctgatcatctttgtgtctctcacaaaatcttgaacatgtgtatttattaggttggtgcaaaagtaattgtggtttttgccatcccttttaatagccaaaagccgcaattacttttgcacaaacctaatagtaaatgtttgcctgagttaaaaccagcacctcctaaaattaataaaaattatcttgcagaatatattttcggggattagtatccttttagccctttctacttactatacagctactttaacatgtacatgtgttgaaagtgtctgcaggatcctaagacctgtattccttttggaggatacagtttttctaccagcgagaatcagaacaaacttgattgaccctagtgtgaactagaatactgtgaaggctaagcattctgttgggggtcgtttagagttgagtagaaagaactataatctgtatttcccatgtgaataaaactttaaaaaacagagtgttacaaccttttttcagtaagtctgcaaagtttgatcatgaataatttatcttggttaacgcactgtaaaagttgtaaacacatttgtttttgattattcatctcagcaccttatttaatgtactcatttaggttactaattttcagaaggtggtgtggctatgagatttgtaaagtcagattttttttttctttttaaatttgggaaggatatatagcagtatttcctagtataccaaaactgctttaaaggaatgttctttcagtacttcacttttcttttaaacagtgcttctcaaactgtggtgtgctggagtatccacagtattcatctttaaaatgcagatgcctgtgcctcactggaaacttcatgtttaataagtgttctagatccgtgttttgcaatctttgtaaatagggatcttgttgaagtgcaaattcggattctgtaggactgggtagaacccagtattctgcatttttaacacgctttcctgatatcagtgcttctggtccatagacaacattgagttgcaaggccctacgtgattctgatatagatcatcaggcttgaatagttattacctaagaaaatatatactacttaaaccataaaatcaaaagtcagtcatataaattaatgtcttttaacttaaagtaagtcagagtttattatattattcatataggaactttttcatttaagagcatttaatttgcagggggatcaattgaaatttaagtgaaaatcaaattatagaaagcttcaatggcataattgttaagcttgtaatgcctatgcattactatatctgtacacttatgtgtatatttttacttttattatttttaattgacacataatgtacatacttatggagtacagtgtgatgtttcaatacctgtgtacaatgtgtaatgatcaaatcaggataattagcttatccattacctcaaacgtttatcagttctttgtgttggaacattcaaaatctgctcatctagccctttgaaaatatacaataaattgttaattttagtcaatgtatggtgttctagaacactagaatttattcctcctatttggctgtaatattgtatgttaacccatttttgactattggcctcttcccagactcttgtaatcactagtctactttctacttctgttagatgaacttttttaacttttacatatgagtaggaacatgcagtatttgtctttctgtgcctggcttattttacttaacataatgtcctccaagctcatccatgttgttgcaaatgacaggatttcattcctttttatagttgaatagtattccatcatgcatatataccacatgctcttgattcattcatctgttggtggatatctagattgcttccaaatcttgtctattgtgaatagtgctgcagtaaacatgggggcacagatatcgccaacatatttatttcctttcctttggatatttacccagtagtgggattgctgaatcatccggtagttgtattttcagttttctgagtaaactccatactgttttccataatggctatactaattacgttcccatcagcagcagtgtataagataactcctttctccacatctttgctagcatttgttattttttgactttttatttatttttgtttttatttttttgagacagagtctcgctctgtcacccagggtggagtgcagtggtttgatcttggctcactgcagtctccacctcccaggttcaagcagttctcctgcctcagcctcctgagtagctgggactacaggcgtgcaccaccatgccctattttttgactttttaatagctattctgactgcagtcagataatatcttattgtggttttgatttgcatttccttgatgattagtgatgttgagaatttttttcttatgtgtatattttttaacccaatattaaactcctcccctttcaaaattaataacagccacataaagctatatcagtaaataaaacatttcaaactcctactgtatgtttcttttgtgactgtgaaacaaaaaagggatggagacagagaagggaatgagaagggaaaaaaatctggcaaaagcctgttcttctatggtacctgagaggcaaggctttaacttgtttatgaatactgttttattccttaaatggtgcaaccctaagcttaatggtgcttgacctttaaatacagttttgcatggagtagtagatagtacgttttaaaaaaaaggtcaggaatttatattaactacctggttcttttttaaaaacatctgtgttgagatatgatttatatatcatataatttacccatttagtatgtacaatttaatggtttctagtgtattcacagatatgcccaacatcacctcagttttagagcgttttcatcacctcagaaagataccctgtaccctttagctatcatcccacgccttaattccctcatcccctctgccctcaactgtaagcaaccactaatctactttctgtctctagatttccctattctagactttatatgaatggatcgtataatacatggtcttttgtgacgggcttttttcctttagtacaatggtttctaggtctgtagcacgtatcaatacttcattcctttttatgaccaaataatattctatagtatggctgtaccacagtttgtttaaccatttgttgatggacatttaggtggttatgaatatgaccatgagtattcagctattgtgaataatgccgttaacattcgtgtacaagtggaattgctgggttatgtggtaactccatgtttaatcatttgaagagttgccagactggtttcccaaaatgggatgagttggaggcacttttttaaaaaattattttattttttcaagttctggggtacatgtggaggattcacaggtttgttaataggtaaatgtgtgccatggtggtttgctgctcctatcaacccatcacctaggtattaagcccagcatgcattaggtcttttccctaatgctctcctgtcctccccttacaggccccagtttgtgttgtttcaagttggaggcactttaaacagtctgaggttaaaggcctaaagaaagaaagtgcaaataataaaggagaaaagacaacttatgtaataacagattaaaagataatattcagaagtcttataatgcctcccttcagatgattcttaggggagggaataataagtttatttcacttgaggttatgttatatcagtgaagatagcattaggcagctaggactgctggatgggctagagatgtagctttgggagtctatcttaaacttattgaaaacactaaaccgggatctttgtggaaatctagtcttcctctagtggagtgtatgaaccaacagaagtgaatataataaatacaatcgtgtgaataaatacctgccataccaggtgatatatgtgtaattaaaaatctgcacaaggtacagaaacaggtgatatatgtgtaattaaaatagaaatagtatagaagactggggtgacttgattgcatagagatgatctttgaggccctgaaagtggttgagaattatcaagagaaagtagaataagacaggagacacttttgataaagaggaactgcgagcaagtttagtatctgctgttctaacataacaggtagtaaaagtatatataacttgttttcttttcttttcttttttttttttttttttgagacagagtcttgcgctgtcccaggctggagtgcagtggcgcaacctcagctcactgcagcctctgcctcccaggttcaagcgattctcctgcctcagccttccacgtagctgggattacaggtgcacgccaccatgcccggctaatttttgtatttttagtggagacgaggtttcaccatgttgaccaagcaggtctcgaactcctgaccttgtgatctgtccacctcggccccctagagtgctgggattacaggcctgagccaccacgcacagccttgttttcttaattctgttttctaatccttgggcctccaactttaaatgtgtgaattttttgaaaatttcattacgaattatctatgtttcagagggaaaaatttgtgaacaggtatttaaatgcattaagcatggaaaattagtagaaagagatttatgaagaagcgtgattcaagttgaccactttctcttgaaaccattaaatttaaggagttttgaatgaattatttttagatcctataaaaataagttattttatgaagttgcttgcgacagggatgctcagcttttcttgaagagattttcttagcctcttcccagcctctggcaaccactgatctgttttctgcctaaagttttgtcttttctagaatgtcatataggtggaatcatagattatgaaacttttagagtttgactttctttaacttaacataaagcatttgagagtcattaagtttgttctatgtatcaattgttaatgacttgtttattattgatttagtattccattgtttgtatgtaacagtttgttgatcagctgaaggacatttcagttgtttccagtttggggtatttatgaataaagcaatataaacatgtatttacaggcttttgtgtgagcatgagttttcagttttgcagcgtacatacctacaaagtagggtggctgggttgtgtggtaaatataagcttaattttaaataaactgccaaactattttcaaaagtggctgtaccattttgcattgcatcaataatgactaagaatgacagtttttccatatccttgtcagcacttgttattatcaattttaattttaggcagtggtgagctgaaggctggtcttgctagcaagaactgtatgttacatttttaggaattttatgaactagttaataaacagccattattaaaaattaaatgcaatgaatttaaaattaaatatatacctatgtaaagattatacataattttataaaatttttattaatgttataaatatgtaaaaataataaatatataaagctccttgctctctaattcctttactacatttcactattacctatgctcttgagattaattatgtctgttgtgtctgtatggtggaaggtacgtgtcttcgcaactctaccacagaaatcagcaaaagctaaaaatctggatcttctcctctgcagatctgattgctaaacatttaccagcacaacactgatttttagccattctaagaggtgtttagtgttacctcatccctttaatatatattcactaatgcctaatgttgctgagtatctttttatgtacataccatctgaatattatcttttttggttatgtgtccttttacatcttttgcttatttttttattttattttatttgagacagagtcttgctctgttgcccaggcttggagtgcggtggtgtgatctcggttcactgcaacctccacctcccgggttcaaaagattctcctgcctcggcctcctgaatagctgggattacaggcacctacccccacgcccagctaatttttgtatttttagtagagacaaggtttcaccatgttatccaggttgttctcgaactcctaacctcaggcagttcgcccttctcagcctcccaaagtgctgagattacaggcgtgagccatcacgcccggcctattttattttatttgagatggagtctcactctgctgcccaggctagagagcagttggcacaatctctgctcactgcaacctccacctccccagttcaagcgattctcctgcctcagcctccctagtagctgggattacaggtgcccaccaccatgcccagctaatttttgtatttttagtagagatagggtttcgccatgttagccaggctggtcttgaactcctgacctgaagtgatctgcctgccttggcctcccaaagtgttgggattacaggcgtgagctattgcacctgacctgttttgctcatttaaaatattgaattttgagaattatttatgttgtgaatattttttttcccagtcggtgacttgtgttttttgttttgtttctttgtttttgttttttgtttttgttgagatggagtctcgctctgtcactaggttggagtgcagtggcgtgatctcggctcactgcaacctccacctccccagttcaagcgattctcctgcctcaacctcctgaatagctgggactacacacacgtgccaccatgcccagctaatttttttttttttttgtatttttagcagagacaaggtttcataatgttagccaggatggtctcgatctcttgacctcgtgatccacccatctcggcctcccagactgctgggattataggcgtgagccaccgcgcctgcccagtgacttgtttttttgtttgattaaccgtatctttctcagagcagatgtttaacattaacatttaaaggaaagctatcttttctttttttattgatagtattttagatgtcacatatatgaaatcctttgctaactttaacccatggtcacaaagattttgcttatagtttcttccaaaagaatttggaattttacattgtacatttaggattcatgttgagttaatttttgtgtgagatatgggttgacattctttttttaaaatacagatacttagttattccagcaccatttgttgaaagtctagcctttctttattgggctgtctttttcagaaatgaactgaccatatatatgtgggttgacctatttctgttttgtttcattgatctattgagaatcctttcccagtctacactgtcttgattatttaatctgaatcttgaaatcaagtcgaatgactcctctaactttgttattttaaaaattgccttggctattctagttcttttgctttttcttataattttagaatcaatttgttgatttctactgaaaaatcctgctgagattttaattgggattgtgttgaattcagaaattagtttcaggagaattaacccattaacaatattgagccttcaagctataagcataatctctctatttatttagttagatcttgattttctttcactaatgtttgtagctttcagcatacagatctagcacatattttgttatgtgctagatctgtatgctgagtatttcatagtttttagtgcttttatttcttttattactttttatatttcccctttggttgcatgttgaccctgtatgatagcaactgttctaaacacttactaggtttagtaggtttttgtagagtccgatgattttctgtgtagataatcatattgtttgtgattggagttttatttccttctctcagtctttataccttttttttttttctcttgtcctaatggctgggtaggaccaccagtataatattgaataaaagtggtgatagtgaatattctttcctttttcatgatctcaggatataagatgttatctgtaaggttttttgttttttttaatgagcttaatcaaatgaagttctcctctgtttctagttttctgagtttttatccatgaacggatgttaattttgacaaatgctttttctgcattcattatgataatcatatagttttcttctttagtttattgataagttagattatattgatttttttttctttttttttaagccccaccctcagaatgattttcaaactgattcaaaaaagttgaatcagcgttgcattcttgggataaaccccacacaatcataatgtatttatcctttttatatattgctggatgcaatttgctagattttgtttaggcttttgtgtctgtgttcacgacagatatttgtgttttctttttcatgtatctttggttttcatatgagaaatgctagcttcgttaagtgatttggcgagtgtttcctcttatttcatattcttgaagaggttgtgtggaattagtcttacgtcttccctaaatgttgatagaatttactaatgaagtcatctgaattgtagttttgtttgttggaaggcttttaacgacaaattcaattttttaaatacaggactgcttcatggtgaactttggaagtatgtatcttttaaggaatttatccattcagtctcagttgtgaaatttatgggcatactgttttttgtagtacttatcatcctgttaacatgtttgtggagtctgtggatggtaaacttttcttttttttcctgatactggtaatttacatcttctgtttatttatgtattttgatttggtagaggtttgatatcctcttaggatcttctcaaacaattaccttttgctttcattgatttttttcctcctgttgtttctgttgtgaatttcattgatttctgctctgttttctttcttctgcttgctttgtgtttaatttgctcttctagtttttttttgttgttgttgttaattttagtttttatttttatttttattttttttgtagagacagggagtcacactatgttgcccaggctgctcttgaactcctggccccaagtgagccacttaccttggcctcccaaaatgctggaattacaagtgtgagccactgcaccgagcctggttttctagtttcttattaaagtagaagcttggatcattgatttgagacttttttccctactcttgctgtttagctatgtatttccctctaagcacgactttggctgcattccacaaattttgataaatgtggttttgttttcattcaatttaaaataatttctagtttctcttgtgacctcttatttgatctatgagttatttagaagtacattatttaatttccaaaatttgaggatattccagatagctattactgatttctggtttcatttggtaatggtaagagaatgttttatgctttccatttttttaatttgttaaagtttgttttatggcccagaacatgttctattatggtaagtgttctgtgtgcacttttgaaaagaatgtatatatagtctgttttgttgggtggagtgtcgtacaaatgttaggtcaagttggttgatatttttctgtctttccctgttacctatttacttgttttatcaattactgagagaaaagtgttgaagtctccaagataattgtatatttttaatttttatttcttgttttagttcacttaggttttcctttatgtattttgaagctattttgttacatagatgcttaggattgttttgtcttcttggtaaattgacccttttatcatataatgtccctttttattgatgataatatttcttattctgaagtttacaccctctgatgtttagcacaacagctttcttgtagattgtctgcatgacatatcttttttattgttttacttttaactaatttgtctttcaagcaggttttttttaggcaacatgtgtgtagttatttttatatccagtctagccatctctgtttcctaatgggtatatttaggctatttatttaattattgatgtggctagattagatctaccgttttatttgcttactgtttttctcttcagtttttttccttttctcctttcttgtggattactttatgtttattagtatttcattttatctactgggtatttgtttaatatcattatatttaaatatatattttagtggttgctctgcagcttaaaatatacatacctgagttaatattatacttcacgtaaaatgccaagctttacaaccacataggttcatttaccttccctcctttacgcttggaagtcattgctgcgcacaccaatagcatagttttgcagttggcaccatcctcaggaaaagttaagacagaataaaaaaaaaaatggcaaaatggatccttgtaaggacgggccattttttacattttggctccctccttagtcggcctgctattttttatttttatattgttgctttttgtattctatccagaacttttagtgtcagtctgttggggagggaggctttagtggtccttgttgatcttgtttggaatccaaagtgccactttttaattgaagagatactagcaaaaaaatcttaaaattttttatcctgcatactaccaggtgatggtgtgggggaataaaggaatattcatttattaagaatacagatgtctactcagttgtatatcttggacaactgtagttctgatcatgaagaacctgtgtcacaggcagagaagccatcagtattcttttccaccataactttctcatttggcagtcactgtccacactcctttccatccactagaaaatagctcttttcctatttagtaggaacctggaagaggcatggagaggcaggacaaagataagtaggtttttgcaacctttaaagattaacagctcccttggctgggtgtggtggctcacgcctgtaatcctagcactttgggaggccaaagcaggtggatcacttgaggtcaggagttcgagaccagcctagccaacatggtgaagccctgtctctacaaaaaataaaaaaattagctagacatggtggtgcatgcctgtagttccagctatttgggaggctgaggtaggagaattgcttgaacctgagaggcagaggttgcagtgagccaagattgcaccactgcacaccagcctgggggacagagcaagactgtccccccccaaaaaaaaaagaaagaaagaaaaagagtgatagctccctggcagttgagcggggtactccaagctgctgatggttggacacctgaaggaagtggattcctcatagcctctccatagtgatatgactgctccccagcagcctctacttgagttgcccactgccccacatcattcccattgtgcggtccactcttgggctctggactatgaggtgaaaaggttgtttttgttatataaacatgtttgtttttctttccttgtttctggtgttaaaactacgagtacccaaggtattagcaatatgaactttcagttatgataagaatacattatatgttgcaaatagtttacatgtattatagctgtatactgtattataatctttacttcaacagtcatgtctattttaaagaacttaagaggaaaaaataatctgttttatttattcagatatttaccatttttgttgcttttcctttacccaaggtttgctcttgtaatttttctttttagcataaagaatttccttcagcatttctttttgagcagatctgttggtgatgaatattcttaatttgtacttcatctgaaaactttatttcaccttcaatcctggaggatattttcactgttcataggtttctgcatcaataggtctttcaacactttcagagtgttattccactgttttgtagcctttgtggtttctgatgagaaatccacagttgtttgaattggtattcccctgtaaaaatacgttgtttttctctagctgcttatattttttccctatagcttccattttcagcagtttgaatctaatgtgtgtaggcatagtattctttgattttatcctcaatgaggtttgccaggcttcttgaatctgtaagtttatatcgttcaccaaattctggaaatttcagctactgtttctttaaatacttctgcagcaatctttcatccttccttctggaacattttggtattgtcccataggtccttgaggctttgttcattttttcaacttcttttctcaggagaagttatctttgttattcagatcagatattttctatggatttattttcagttgcactaacactttgctcttcaatagcaataacaacccattattctctttggtaacagctcattctgttattgagcttatgtgaatgttttgtttcaggtaatttttttttcagttctaacattttgttttctttcttctttttgtagcagctttctttttttgcagcagcttctgtttctttgctgagagctgtcatttcattcacttcaaatatgtttacctttacttcatacaacatagttagaaatgcttttaaaagttttaaaaaataatgcattcaacatctgggttatttctaggttgacatctgttgactgtcttttctcttatttggtcacattttttggactctttatgacaaataattttggactatatcttaaacatcccaaatgttatattgtgtaggctctgcatcctgttataatcctctggagactattgggattttttgtttatttttttgtttggtcaggcaatcaatttgcttaggttcagattccaaatttctgttttgccttctgtgggcagtggttctaatctcagttcagttttcaaagcttttgcctcttcaggtctgtctcatgcaggcaccactcaggtcttagtctgggactttgacagtgacctaagtatcaattgagttttccagtctgtgagaattgctgtgctgtttggctacacatgtgctgctcagggttgaccctgagatttgcacacattcattcacagaattaggggatccccttctccagttttttctctgggattttccccacattcttcagtttacaagaccgccccaccttccccaccacacacacacatacacacacacacacacacacacagacacacacggacacacacacacacacacacacacacacactcttcctctagcccgaaagatgaggtttcttttggcgttttatctacccgtgctgtagctcctgtagtgcagctccatgcctgggacttgctttcagcaaatctgcaagagaaaagagggggaaaaaaacagggatttattcatatacacatactccttagctcatatgacccctttgtctgattcatctggccataaagatgagatttctaccagagtttagctgtctctgtctctataccattgcacaggtctgtgactgaggcccactttcaggacaaaactattagagaaaagaggaaaggaatagactctctaccttttatgatctgtcagaatttgtttactttttagattcctcaagtacctttttaattttatctataggctttagttataatcagagagagaggctctagttggcttaccacttgtatgagttatctgttgctgtgtaacgcattagcaacttaaaataataaacattatatcacagtttttaagggttggaaatccaagagcagcttagctagctaggtattctcatccaaggtctctcatacaattgtagtcaggatttcagccagtgctgcagtcatctgacagctgaggaggatccactttttctttttctcaaagagtcttactctgttgcccaggttggagtgcagtggtgcgatctcagctcactgcaacctccgcctcctgggttcaagctatcctcctgcttcagcctcccaagtagctgggactacaggtatgcgccactatgcctggctaatttttttgtatatttaatagagacggggtttctccatgttggccaggctggtcttgaacttctgacctcaggtgatccacccacctcagcctcccaaagtgctgagattacaggcgtgagccaccgtgcctggccgaggaggatccacttctaagctcactctcatggccattaagaggaaccttcatatccttgccacgtgacctctctatagactgctcagcatctgacaacccatttttcccaatgagtggtcaaagagaaagggtaagcacaagaccaaccaagatggaagccacagtcatttataacctaatgtcagaagtgggggaggaagatagtaagacagttcactttggttgggcagaaaaaaaatggttttgggttgtcgcagcagaaatacatataagtgagagaaagggtagaagataggggaattggctagttatggaagatttgggtggtaagagagaagtaggactttgggaaaatatctggatttctgaattgggtcacctaccaagaaaagcagttgttccttcttcccagtctttctgccttttacttccttttcttgtctttttgcatgcagctagaactttcagtatgatgttgaaaagaagtggtaaaaggggacaaccttgtcttgttcctgatcttactggggaagcttcaaatttctcaccattaagtatgatgttagttgtaggctttttgtagatattctttatcaagatatcctctattactagcttactgaaagttttttatcattaatagatattggagccactctgccatatttttaggtggatgcactataggctatttcaattttttttttttttttttttttgagaggagttttgttcttgttgcccaggctagagtgcgatggcatgatcttggctcaccacaacctctgcctcccaggttcaagcaattctcttgcctcagcctcctgaatagctgggattacagacatgcgccaccatgcccggctactttttttttgagatggagtcttgccctgtcgcccaggctggagtgtagtggtgcagtatcagctcactgcagcctctgcctcccgggttccaaagattctcctgcctcagcctcctgggtagctgggattacaggcgcctgccaccacgcccggctaatttttgtatttttagtagagacggggtttcaccacattggccaggctggtctcgaactcttgacctcaagtggtacgcctgccttggcctcccaaagtgctgggattataggcatgggccactgcgcccagcctaatgttgtatttttagtagagacgagatttttccatgttggtcaggctggtctcgaactcctgacctcaggtgatctgcctgccttggcctcccagagtgctgggattacaggcgtaagccaccgcgcctggccctcaatttttatagtaatatagaacatctgattgacaaacttgtggttaattctttgacatatccatcattattttcttaaaactcagttaaatgatagtcattgagtgttttactgctagatactgagtaaagagtagtgaacaagatgagatactcttcctttctatgtacagcgtgcagtctataaaacagataatacttataatgtggtaagagaaattatgacacaagtaggtactctatggaagtatataggccaatcacccaatcagactcttctagagttacagttaaggttgtcaggagtactttcagaggaaataatacacaaacttgttctttaaattccttcaagtgaaagttgctaagttaaagagaggcccacttttgtgagaatttgggactttaagaattagttctcgagagaaaagaaagcctctttaaattttcctataagagtttgaaactacttttgaatgttctaaagagatttttgtgccattgagggtagtttacttaaaaagctgatgagaaaatcttattaattaggagtggcatcaaaagactattgatcctacaaaatgcttagtaactgttgggcgcagtggctcacgcctgtaatcccaacactttgggaggctgaggcgggtggatcacctgaggtcaggatttcaagatcagcctcaccaacatggtgaaaccccttctctactaaaaatacaaaaaaaattagctgggtgtggtggcgggtgcctgtggtcccggctacttgggaggctgaggcaggagaatcgcttgaacccgggaggtggaggttacagtgagccgagatcgtgccattgcaccccagcctgggcaacaagagtgaaacttcatctcaaaaaaaaaaaaaaaaaattgcttagtaactatacaagaaaatattgatacaatttgcctttaattaagaaattccattgcaaaatctaccattaagaaagtaaaaaggtaagccaaagattgggagactgaattattaatacatatctgacaaagaatttttatccagaatatataaggaacttctgcaaatcaataggaacaatagaaaaatgaacaaaatatttgaagagactcttcacaaaaggatatctaaattccctttaaacatatgaaaaattgctcaccatcattacttatcatggaaatgcaaattcagaacacaatgatacatactctacatgctagagtagcgaaagtgaaaaaaatggaatatatcaaaatgttggcaaagaattggagcaacaaagtttcatatgccgctggtgggagtgtaaaattatacaaccactttagaagatagtttactaataacttctaaagctgaacattcatctaccctgtgagccagctattccattcttaggtttatacaaacatttgtttacatgttcactaaaagatgaactagaaaattcatagcagcactattgatagtattaatagtaaaaaattgataaacatctaagtgcttattaacactagagtggttcaagtatggtattcacacaatgaaatattatacacttatgataatgagtggtctactactacacagaacaatatggaagaatcttacatacatagtaacattagggccaaaaaccaaacacaaaaaataagtaccatatggctctattttatgaagagcaaaaataggaataattgatccatactggtagaagcccgcatggtaaagaatgggagggagcataagtggaacttctaggtttgatggtaatggtctttcatgatccaagtgcatttgcataggtatgttgagtttttgaaactatctagctgtacacttttgatatatacagtttttttgtgttatacttcaataaaaaggtttttaaaagacctagttttggccaggcacagtggctcacgcctataatcccagcactttgggaggccaaggcgggcggatcacctgaggtcaggagttcgagaccagcctggccaacatggtgaaccccatctctactaaaaatacaaaaaaaaattagctgggcgtgatggcagacacctgtaatcccagctattcaggaggctgaggcagaagaatcgcttgaacccgggaagcagaggttgcagtgagctgagatcacgccattgcactccagcctgggcaagaagagcaaaattctgtccccccaaaaaaaaaaaaaaagacctggttttaactattgtaatacgaaaaccataataaagataaaagctacacaatctaggtttcattgtgttactcattatacgttagggttaaagaagtacaagagtggctcattcctgtgatcccagcactttgggaggctgaggcgggtggatcacctgaggtcaggagttcgagaccagcctgaccaacatggtgaaaccctgtctctactaaaaatacaaaaattagccgggcatggtggtgcatgcctgtaatcccagttatttgggaggctgaggcaggagaatcacttgaacccaggaggtggaggttgcagtgagccaagattgcaccattgcactccagcctgggcaatagaatgagactgtgtctcaaaacaaacaaacaaacaaaaaaaacaagaatagtcattagcttagatgaaatataaatgtcttgagaggtcacatttttagtttgaagcgatagaaattttagaataattggtcttaattcaactagtagtaagttttcctcttacagtaaaacagtgctttgaacttcttggacatgcaacatgttttcaggatctgttgagtcacgtggaattttggtgtttgggcatatctgcccccaccaggaaaaacaaacaaacaaacatggcaataacaaaaacaaaattagggatttttgaaaatcaaggacatgatgtcgttttggttctattgtatatgactgtaaaatattaaatttggtttttgttaattataactcagtatgacaaactagtacctccaaaaaggatgactagaaaaggttttctggccaggggtgttggcacacacctgtaatcccagcactttgggaggctgaagtgggaggatcacttgaactcaggagttcaagctgggcaacatggtgaaaccccatctctacaaaaaataaataaataaataaataaccaggtgtggtgacgtgcatttttagtcccagctaccctggaggctgaggtggaaggatcatttgagcctgggaggtcaaggctgcagtgaaccaagctcacatcgctacactccagcctgggccatagagtgagaccctgtctcaaaaataaaaagaaaaaaaaggttttcttttttaaatcttaagtgactttttgttaagaaagatgatgagttaaaagtgtgttattagttcattcttactctcagaggaggatatataaatagctgttcttgttctttcctccattcttttcaagagaatgttctatttctgtagtacatggtgacagaattacaacaggtaaacatgccaatccattacctattattgttcttttttaacagtcaagtccatcatctccagaaccagctagtcttcctgcagaagatattagtgcaaactccaatggcccaaaacccacagaagttgtattagatgatgacagagaagatctttttgcaggtaattgtcatgtatttattttttaataatggtcaattgcagtatattttctattagatagaaaatatctaaaacaaaactgaaattctgtgtaaagtgttagtggcagctcttgtaacaacttagaaggatggggaatttccagtcacatcactctatgaaaaatgtggactgtccagagaagcaaaaatgtggttctttctggctgtaagcatttgagaataaattgtatattataatttgattgggggcagtatttagatgcaaaagactaatcattgtgatgttcatactttgagaaatagcagtgattatacctttttattgcttagaagttgtcccaaagcaaaattaaactatggatttaaaaattattctatatttatgtttgaaagctgttttaataaattgctgtactatttaccatctgttccatttgacccacttttaggtgaataaattgatgcttaaggaatttgtttttgatacaggggcaggatttggtgtagttcatcctaacttaagaaggactctgtttaacaattatctgctttaaaattaaaattaatgttttaatattaaaaagcaacatcttccttaaaattaatgacacaaaaaatgaaaatggtaaattttattttgtgtgtttaatagcctaatttacctgaactggctttcattgagttaaaacttaatatggatggattcttttgtggctcataagcttgggattttcacactaaacatttttaactcatgaggttgggacttcacattaatctctaatctttgagattgcctccctcaaaccttgctacagtattggcacattacccatctcacatgaaaaaggaaaaagaaaaaaagataaaaaatgaataattatgttctcatctttcatagtggttcaatattcaaaccattctgtgtttttgtacaaacatgtttgaagacagcaatcctccatcacaaaactccatataatttacaccttgattcattccatgagaagttgtcactggagatgaattcacatattttattatgtcacaaaattaaaaatatgataccaaataccaatcatcttctctttaaaattttaagccacctaacaacttagagtcaaaatcaccgttaaccaaagttgtaatatttcagtatttgttattgtgtcctttcatggacttttttccaggcaatctttcaaagttgtttcatggtatttgtatcttatgctaaaagatgacacaagttctttctctacttaacaagtactaatctaaaattctgtgtattcctttaatggtatagggtcatacatagaggttttaaattatccatttttttaaagactccttcaccctatagtctcagatttctatgtagatgagtatgtttaaaccttactgtaacaacagaactgtgtctgtgtgtgtttgtgtacatgcaaggttttttttttcttaacagtatgcacagctgatcaaagagttagccaagtgaggactatacaatgatatttgcccacttagcttggttagaaaaaaaattaaaaacagtttttagacaggtctcactctgtcacccaagctggagtatagccatgccatcatagctcacagcagctttgaactcttgggcacaaataattctccaacccttgcttctcaagtagctaagacttcagacatgtgccactatacctggctaatttattcatgttttgttgagatgggatcttgctatgttgcccaggctggtcttgaactcctggcctcaaacagtcctcccacctgggtctcccaaagtattgggattacaggcgtgagccactgagcccagccagaaaaatcttcatagtgttttattctacctagcagtctatactaaattctgtgaatcaaatatggtgaatatcagtgtttgttttaaaaaaagagagagatgggaactaaagaacaataaacatagtcatctgtctcctttgttaacccaaaaatagaaacattttttatgctttagctttcatcttaaactcagctgtatttcataatgacatcattaagtgactgaagacctaatctgatcatttttgtatgaatgaatgagtattacacttggttcttatttataatacattttaacaggtgtagcattcctccttctatggaggagtatggttctaggaaactataatagggagcagcgtatgttactgggatggtgaaaactattgtccagtaatgagaaacctatactcgatttgtccctcctataccagaggagagaatatagatattgctgtagtgacattgacataatcagttcatacatgtctcaaagtatgtctccaaggaaaaattaatctttacagttagcacctatgaagcatcttcctgaacctttaggtctgctttaaattaaaccttatgaatttgtaatatattggtttacttaagctaaaaggtgtcatgaagaaaatttaagacagattatatatatatgttgaatctaaatcctacaatttttgaatgaagcagcctgttagtgtaaataacacaaaactcagtatcagtaaagtaaaatgtgattaaaaagtttaaatgactttatctgtactgatttcttaataaagttactatctctcacaatattttgcctgtgagtctgttgccaaagaacagtgcctctttcagattctggggtttttgttttgtttggtgcttgttgttttgcttattgttgtaaatatctcacacttgtagctttgatatactgctttttttttactttatcatattactcattggtttcatttctttacaaaaagagtaataaataccagcaatcatcacagcctgaattgcatataagcttttattttgttacggtaggcttatctatagcctgtttcaacatatatagtccattttccttcctctggttaccacagtttgaaagatttttagttattgatcattttcgcttttaatatgaaaaagtgaagagatcatctataccaagtaaggatctcatcaacatgagataaccagtaagaatagcttgataaaatgttgacgtgtataaccttatttcaggtaaatatgctattactgctataccttgaggtattaaaattaaaatggttcactgactatcattaccaccatcttgaacctctaagaatctaaggacctcaggttagaaaccactggcctggtcctgtgttttccttgaggtcctgccttcctttcctagtatcagttctacagactagcaaagttgtagtttacattatggccaccacttgtgattttccctttcctggctctgctttttgcatatgctattattccattatcatggaattctttcttcattttttctctacccatttcagtcttctcagatccattttgtaaactgttcctgatttttgtctcccagctcaactcaaattgtagtgtttgttctgtagctcatgtagcaattaaatgtcttgtaacattcttttcattgtttgcctgggtattatttaagtcttttattattatttaacatcccacatgcttttgtcttgttttccccaactaaattataaactctctgagggcaggtatgatattttacatttttgtgtgtttttctgttgcacttagcacaatgttatgtagcctgtagacattcagtttattgatttggtttgattttttaaaattattagtattagatttttcaagtgagtgggcattttaatttaaaacctaaacacctatttgttttgtgtcatatttgtgtatccaactaattaatatccagtaatctttaccaattaattgctttatattactaactttgtagcttttcctaaccagtttttaatccaagttaaaatagttgtggacagacttccaccataaaatttgtctttatatgtataaaataatcataatattagtgtaaataaatatttgaaaggtaagttaccacaagtataagttgttacaaatccaaacatgaatgtggaatcatctgcatcattgcttttctttcagcctgatccctaccactagtataattaagctaacttaataggattctttctaaaatcaacaaagttacagttagttttaaagttgtgataaataaggatgcataaaattcctttgtgataattatttttaaatgacattatttttatatttgtgggtaatataaaaatattttttataatccattaactgctatgtagaatattgggggtttgcttgccagtgttcttaactaacttgtttaatctatgtctagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagaggtacaggaaaatgtattctaaattaatatgtaaatatataccttttttccccacccaacatcactctgctgttagtcatttctaatcaaagccttttagacattttgggaaaagaatattggactaaattagttatgggatctggcttctatcttccccactctacccagtgacctgggcatatcatttaccttgttaagtgaaggagtttgtcatttctgattttatgataatagtgtgcatttcctagggtttctctgttggtcagatgatatataaaagtgctttgaaaacttaatcacaataaagtgatattttgagtaaatttatttgataaaatttgtaataaatactgttaatacttaaaggttgatattgaaaaagaagggaggatgtatatcagttaaaggtacattctcatgatttggcagtaatttctgacaaggtgaatttggaaaagaaaaattatacagagattattttaatggcaaaattatgtatttaaaagtcattcatggaaatatgtcgttaaaatgaccatgattaagtaacaaccacataaaaaatataaacaatctcgcaaacataatattaagggaaataagtaagacataaaagaatacttacataattctaatatatgaactttaaaaacagataaaagtaaagtacagggctagatgtcagggtagtggttatgttggcaggtaaagaatgggtagtaactggaggggaagcaaaagagggcctcctgagctgtagtgatgatgcttatttctgatttaggttctgattacaaacgtgttcactttgtaaaggtttattgaactgtacacttaaaatttatatactttttatgtaatgatttttaaaagttttactttaaaaatatctgtacaagaagacaaccttgaaataaaacaattatggttcaaaacactttgcatttagatagtgttagactattaataattgccttgaaaattttgcaaagttgaataatctctgaactttgtgcttgagaataacaaagctttcctgcagagctaatgtttggattgcttatttttaatggcatttacaagggcttctctgaagtctcgacatagggttgtcatttttcccacttactgctttttcactgaggtttatagtgctttccttcgcgtccagaagaacgtgtttattagataattagagaaatcttgatactaaagttgcttttcagtataatcacttctgctggtaagtaaggttctactggtaaaagtaatgactacctacctccttggtattaaagggtagagagagaactttgaaaaatgctagtattaaaattaattaaggaggtaattttttaataatctgaatctgaagattcagtatatagaacaaaaaattccacaatatttgtacaaaaagacgaaaacattttttctacatctgaggaattaacatgagattttgggctgggcgcagtggttcacgcctgtaatcccagcactttgggagaccgaggtgggcagatcacctgaggtcaggagttcaaaaccagcctggccaacatggtgaaaccccgtctctagtaaaaatacaaaaatcacctgggtgtggtggcagacacctgtaatcccagctacttgagaggccaaggcatgagaattgcttgaacccaggaggtggaggttgcagtgagctgagattgagccactgcactcctgcctgggcagcagagcaagactctatctttaaaaaaaaaaaaaaaaaaaattgttacttctccaaatggtctttttcgtgtgtgtgtgtgtgtgtgtgtgtgtgtgtgtgtgtgttttatttataaagtcaggaaatgtgaaagtttttattgtttttcaaaaatgaagtgctgggtggctaaattatttgttgtgacagtgactcttacagaaaatagatgataaaaattagtgtcatgacaataatttaaattataatttttaatgccaaaaaataatttatactttctagattgaagaagaagcaaatggagacatttttgacatagaaattggtgtatcagatccagaaaaagttggtgagtcaatacttattatattttgtatttactttttattagtttgttggttttgtatggtttttcttcatacatcaatatagtattaaatgagttttatttttatgcatgtgattttaatagtagtgtttgactttttttgcaggtgatggcatgaatgcctatatggcatatagagtaacaacaaaggtgagctttttgtgcttttaaaaaaactatcgagccctcattatgtgtagtatgaggatatggctatgattaaggtagaagtgatccctgtctttataaaggttaccacctaataaagattgccaagaagtaggtgcaatgagttgtgagtggtttgatatgtagtgttcagtgagagtatgcaggatgggacctgatttagacctctggatgcctaagccaagacataggtgagggaaatgatggggaggagggggggaagaagaagaatgcttgtgccaggtgaggaatttgcttgtgcaaaagccaaaagtgaagaaagcatcgtgctttctagaatctccaagaagtgatgcatgattgaaacgtttggcagtaagcctttgtgtattatgagcagccacattttaaggagtttggcttcatgctgagtataatggagagccattaaagaagttcaaagaagagtgtggcacaagtaggtttttgttttagaaatatttctttggcctcagtatgaattgggagggtcaaagtagaggtcaggatttccagttaaagggacactgcaatgattaaaggattctatgcctttaaatattaaaagagcatgtctgtcacagcagttctagctgtaagcagtaatactttatactaagaaaatggttctggagatgagcaaaataagtggcttcttgagttatgtaggcggtagaattgacaggacttggatgtaatgggtgaggaaggagaaggatgcctaggttattgactagagggactttgcagctgtgagagtgatccatggagaaaggcaacacgggcaggaacacagtgaggatgaggatgacagttgttaattcattggataaatattcattaaacacctaccatggtgtcaagctttgttgcaagccctggggtatagtagtaaacaatacagacaagggtggcatcttatagaacttatgttccagcagggggaaatagggtaagtttgaagtgctggtgagatttaagtggaggggtatttggatatattggactgaagctttgtaagatatctgggccagatgtaaagatttaagaattattagcgtaaatagagtgaataagaccagttaagatagaataatgcaaatacttttttgtcctattaagattctgtaaaatacatctatggtttaggttttttttttagttagaaacctatataccacattagttagatactctgcattcttttgcaaagtagatacatgtatgtgttcacaattatgtataacattaacttgtggaataattgcttgctattcaaaatttgaaacacctcttcttcacttgtagacatctctttccatgttcagtaagagtgaattttcagtgaaaagaagattcagcgactttcttggtttgcacagcaaattagcaagcaaatatttacatgttggttatattgtgccaccagctccagaaaagagtatagtaggtaagcacaaatttttcaaaaattaatttttgttactgttactagttcagttttaactgtatagatttgtggatttcttagtcattcactgtcaacattttataatgtgtagacataactgaatttaagtatttcatttatactaatcatgcatggattgaagaatgtattggtaatagttttattttctaacacttgaggatttttgtttatgtaatacagtaatgttaaatattgggtagaggccgtgtgtggtggctcacacctgtaattccagcacttagggaggccagggtaggaagatcacttgaggttaggagttcaagaccagcctagccaacatggtgaaacccctgtctctagtaaaatacaaaaagtagccaggcatggtggcacgtgcctgtaattccagctactcggtgggctgaggcaggagaatcacttgaactcagaaggcggaggttgcagtgagctgagatcacgcctgggcaacagagtgagactccgtctcaaaaaaaaaattgggttgaaatttatgaagttaaaagcagttggaagccctaaccttttagggtcactagattaccattttactgagtcacaatcagagaatacttaatattattaatatgttaacatttttctaagggatggaggtgttagaccctcactagccttggctcatataagagctatttaaattcatcttagttcatttcgtacctcaatttaaagtttaaaaacatttctacttttttttttttttttttgagatggagtctcactctgtcatccaggctggagtgcagtggtgcaatcttggctcactgcaacctccgcctcctgggtttaagtgattcccctgccccagccttccgagtagctaggactgcaggcacacaccaccatgcctggctaatcctttttgtatccttagtatagacggggtttcaccatattggcctgtctggtcttgaactcctgaccttgtgatctgcctgctttggcgtcccaaagtgctgggattagacgtgagccactgtgcccggccacatttgtacttccataagcaataaagacttagttaagaaactgcagaaaattacaaaagaggaggaaacctccataggcctaccattaaaagacatctgtcatctcaaaattttgtagtattttattcaatgctttttcagtcataggtttttatttacctttttcttttttttcctttaaagtaattatcttctctgtattgttcacagttttagtatatgtgctgctgaagtgagcactaccattacttttctttatacttagattaatctgaaagtttttttgttttttgagacggagtctcgctttgctgcccaggctggagtgcagtggtgtgagctcggctccatcatggtggctcatgcctgtaatctcggcactttgggagaccgagatgggcggatcacctgaggtcaggagttcgagaccagcctggccaacacggtgaaaccctgtctctacaaaaatacaaaaattagccaggcatggtggctcctgcctgtaatcccagctacttgggaggctgagatgggagaattgcttgaactggggaggcagaggttgcagtgagccaagattgtgccattgcactccaggctgggcagaagagcgagactccatctcaaaaaaaaaaaaaaaaagaattttgctgatttattttttcccccaagctggtctcaaactcctggccccaagcagtcctctcatctggcctcccaaagtggtgggattacagactggagccaccatgctcagccaaattttgctgatttttaaattattgtttttacttttttaaacattaggtttataaagcaatgttattggtaccctttacagtttcagaacctaatgtatttagatgaatttgttatattctttctttttttaaattcaaaaattgagtttagtggttctttaactttttggtctttcaagacccctttgtagggatggttcaatccaaagtgttgaaatctgtagggatggttctatagggacggttcaatccaaagtgttgaatcagggatggttcaatccaaagtgttgaaattacaggcatgagtcaccacacccaactgaaatacatttaatgtggattaaattgtttaaaacttttttgctttttcttgagatggagtcttgctctgttgcccaggctggagtgcagtggtgctatcttggctcactgcaagctctgtctcccgggttcatgctattctcctgcctcagcctcctgagtagctgggactacaggcgcccgccaccacgcacagctaatgttttgtatttttagtagagatggggtttcaccatgttagccaggatggtctcgatctcctgagctcatgattcgcccgtctcagcctcccaaaatgctgggattacaggcgtgagccaccgcgcctggcctgtttaaaacttttatgtgtgtgtgtgtgtgtgcgtgtgtgtatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagagtttgtgaaacaattcacatcccaattccggtagttcagtcagaggtagttgtagttttaggtgtcttattttccttttgaagccattgtattccattggaattttaaataaaacattaataggtgattaataagttaattaatgtgccaaactgaagatgtaccaaactgaagaattgtatggttttacataatccatttttaaaaggctttattggaatataatttacataccatataattcatccatttaaagtgtctaggtcgggtgtggtagcacatgcctgtaatcctagcactttgggaggctgaggcagttggattgcttgagctcaggggtttgagaccagcctgggcaacacagcaaaatcttgtctctacaaaaaattagctgggtgtggtggtgcgtgctggtggtcccagctactcaggattgcttgagcctgggatataggggctgcagtgaaccgtgatcatgccactgcactccagcctaggtgacagagtgagaccgtgtttcgaaaaagaaaaaaaaaagggtatccagttcactggcttttaatatattaagagttgtgcatacattaccacagtcaattttagaatatttttattaccccaaaatggaatctgggatcccttagccatcatcccctaatgtcctcattttccccagccctaggcagtcactaatttactttctttctctaagtatttacctattctggacatttcatgtaaaaaggatcatgcagtagatgatttttttgtgtgtgacaaattccttccacttagcatcatatgttcaaggttatttcatgttgtagcatatatcaataccttgtttccacagaatacatttttgaaaggaaaaagaacaggagaataaaagagaaaaatctgcagcctgaaattaaattgcccttacagaagtaattaacatgacttattttttaaatctgaagttataaatgactctgtgaaagagctttttctttcaatcattgtaaaaccagctgtgataagtaaataagaacatgctcttagaatctgcaggagggaaaacataacaaattcatggattacatttacttttatttttgtcatcccaaagtaaagaattttaattattgctcatgagaaatgaaaatgttaattgagcttaaatttattgatttgaaattccattatgtatatcgggttagaaacacattttaatttaccaggagtataaaatacaacagataagggatctttttgatgtaagcttttctgtaaacaaaagcagtatgggtcagaaaactataaacattttatctgttctctcatgttttaagtatttaccaagtaaagatgttaacatatcatgagatttaattcctcaaaacgtttttgctttttagataagataccagttacaagtttagggctgttaagttcaaattttgagtgtattttaaattatgaagaaatgattatgaaagactttcacagcaatataaagtcatcatgaatctcattcaacttcttcaaagggatgaccaaggtcaaagtgggtaaagaagactcatcatccactgagtttgtagaaaaacggagagcagctcttgaaaggtaattctagacagctatattttattactctcatgtttgtaccttaatataaatgtaattccattatatggcaaaactgtgttttaatgattaaattttttccaaagtaccacttggtggcttttaagactgctttaaacttttttaagaaaattacttctttcaacaaagtactgtataattgttctgtataatttttagtaatcctcatcaatagtctaacaaaataacacttgtttttctattatatgctacaagcaggagcatataatagaaaacatataaagacatgagttagctggggatagaattgtatcataggtagtcaccaagagttactaagaaactgctaaacttggaaaacatggaagttgtgaatggggggaaaaataaaaatttttggatgcaaataatcccactttggtcttatttaggtttctgggaagttataccacactcatgtactgtgttggatagtatagctaattatagttcatctaaattaacttttctgatgagtttttacttagtaagaacattattaaatacagtgagaagtacagtttgtgccccccttgtgtttgtataattgatttttacttgaatgtacaaaagtattagtctttgcttgagttgactatatacagttgaccctccatatctgtgggtgccttatttgtggattcaactaactatggatggaaaatatttgaaaaaaataattacatctatactaaacatgtgcagacatttttggtcattattgtctaaacaatacagcttaacaactgttttcatagtatttccattatattaggtattataagtctagagatgacttaaagtatatgagaggctgtccataggttattatgcaaacactacgccattttctatcagggatttgaacatttgcagattttggtatccataggatgtcctggaaccagtcccccactggtactgagggacagctatacttaaagactaatatatatgctctgttttcctttagagtacttgactctacacatttcctatagctttgaagacttgtcttccttgaagcagactaaaagggggacagatgggaggatgggaagaaccacacttccataatcttagaattattccttccttgctatgctgacaaagtgagaaaacaaatataaattatcttaaagcccagcatttaagacacaagttggtaattacctaggcttgaaactttctaatttcactggtttttttgtttgcttgctctttatttttctctggcttaaaatcagtggttagggtgaatagcacaggtcttgggggtggtatctatttctctaggtcacaaatttttttttaaactatttcaaggcaacttatttctagttttcagtagtaaattgtttaaatttcaagaaaaatggtacagtgaagttagatttgaacaatttaagaaaagctaaagaatatgtagtttaaaatcttagagaaggcttaaagatgggattatgtctgagaatctgcagttacccagaaaaaggatttaaattgcatcaagagaagtttaggttaggcatttgaattgattttattgtaggagaggtcatagactgaatatttttaagaataaaggtaaatcggatggttgccgggtctgtgtggatagaagtagacatgggagacttttcattttgttctgtactaagaaaaattcttctgccttgggatcctgtcgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctcatcttaagtacccagggacacaaacactgcggaaggccgcagggtcctctgcctaggaaaaccagagacctttgttcacttgtttatctactgaccttccctccactattgtcctatgaccctgccaaatccccctctgcgagaaacacccaagaatgatcaattaaaaaaaaaaaaaaaaaaaaaagaataaaggtagataatggtctgccttgatttcgcttagtctttcctgaaaatgtaaccatgaccctttgagagacctttcaagtcttatttttctatgagtaaatttgaagtatttcagatggcatgcttgataaggaacttaatgaagatttattgtaccaaggacatataatttgattctacctttacttttcttccaacttggctgcattgcatagtacttaccataccttcatgtactatgaaatgttgaggagagttttaagggatattgaaacttgaccctgtttgtataaagacactttctttactgataaatgctacttgttaaatggtaccatagtggaatttgcaatagtgaaaaaaagaaagaaacagtatagtatgagggaaaagttcattttcaattagaaaaaaatcactgaagaaaatataggcataaaggtgtagaagcaaaggaactggaatggtttcttttaatctaatcttaattcttctgtgcaagctaattttcctgtacacatttattttttaatctgtacaggattctaaaactgcatttttcttgccctttcatatagccagcttttctaaagtgatttttctgtgatatttcttaaactttaaacatcaaacaggtaccatctgtgggatacccaacccagttggatctggtgggttagggaagcatttttcttcgtattattttatttaatagtatgatatttacgtattcgttcaaacttagataatccagatgactaccttgaatgaaaggataaatatctggtattaaaggttaggaagagaaaaggagtggttaaatacccaagtattcccctgtgccacactcagtaaactaagcagagactgcttctattaagagtagccctaacatcacttgcttggttttcttgagagtgcttcagatctttagatcatattgagtgtattttataggtaaggatacacatctgcaaatacaaaatgagaaatttagagcataataataagtgtataagatttataattccttttcagttgaaacctgtgctaatactacacactttctgtgtgaccttaggtaaattacttacatgcatttgtctttaaagtgtaagtgtgaggctgggcgcggtggctcacacctgtaatcccagcactttgggaggctgaggtgggtggatcacgaggtcaagagatcaagaccatcctggccaacatggtgaaaccctgtctctactaaaaatacaaaaaattggctgggtgtggtggcgcgtgcctgtagtcacagctacttgggaggctgaggcaagaggcttgaacccaggaggcagaggttgcagtgagccaagattgtgccactgcgttccagcctgtcgacagagtgagactccgtctctaaataaataaataaataaataaataaataaataaaatgtagtgtgtcaggattgtgttcatttcaagcatctaaaaatccaactggcctaaacagttaatgtagattaattaatccactctttcaaatcaaagagtttggagtaggcagctgttcaggattatctaattcattaggaaattctattgcttctttctgatatctgataatacaaccttttctcaccagtctactgactgagtccaaaggtgttaattaactgcagtagcctcctaattggtgtccctgattccattcttggcacttctactttaatacagaactttacagtagtcattctaaaatataaatcagatcattttaacccctccccacgctggccccatgcccccattttactcaataaaagccagagtccttttaatggactacaagactttatatgacctgcacgcctcactctgttacccatttgatctcatatcctccgtgatcactcactctgctttaggccagactaaccttttgctgcttctcaaacaccctaggcattttcctaccttagtcttttcaactgcctgctccctctgcctagaatgctttgttcctaggtatctgcatagctaactcatttccttgttcaagttcgtatgttcaaataacatctttcaagtgaagcctattccagtcattggctttcttctgacctattctatttatattgccaccaaccacatcttaaatacttggtcccatttaccccattgttctgtctttttttcccatagcttttgccaccttgtcacatgctttatcatttgtatgtttattatgtttatagtttattgtctatcttgtactaaaatgtaagcttcaccagggaaagaatcttagtcccttttgctcactgatgtgttccaagtactcaaaacagtgcttaataggtagtaagagctcagtaagtatttgctgaatgaacaagtgaatgttatccaagacccaggctctttctacctttttattctcccattatgtgcatttgtgttttagtttcaagcaagataaatatttgtaactctgttgctctcaagcgttttatataacctgctttattttgttttgtttctggtaagtaaataagaatttgaaagccttgagtgatttttcatcagtaacttgaagtaaatttgaagaacaattactgagcacctcttattggatgtgatattgatcaattccattgtcttttatttctgacttttttcagtgtttctatttctccccatacctcttttcctgtcttcttcctacactcatttaccctttttgtcccgtgtctttcctttgtattacaaccatctctggtcttaattccgaattggcatatgtttataaatatttattgttttaaaatccattttatgtttctgttcttaatttcaacattatgtaaacatatatataaaagcatataagcttatatatgagaaacatatatataaactaaaaaatgcatacatgtattttttagtatatgtatttagtatatgtattagctttattttatgttgcccttgagaaggaaagttttattccctttttctggaatatcatttttcaaaattgattcttcagaatgctaatatgtagtagaatgaaaaagatctatagtcaattgagttttgtcaacataggatttaacaaagttaaactagggttattttctgtaggagttctcacaacacttaataaaatgctgtttgatatgaattttaaaagacaggaatatatatatatttcaaactttcttgatatggaatcagtctttttcatggaatagtacgtgagactagtattctacagaactcactttggaaagctgttttagaatataaattatacaaggtatttccacttaggtttgaaatattagaatatttccttttttttttttttttttttttctgagacggagtctcgctctgtcacccaggctagagtgcaatggtgcaatctcggctcactgcaacctccgtctcctgggttcaagcaattctcctgcctcagcttcctgagtagctgggactacaggtgcatgccaccacccccagctaatttttgtatttttagtggagatggggtttcaccatgttggtcaggctggtctcgaactcctgacctcgtgatctgcctgccaaagtgcagggattacaggcatgagccacctcaccctgccagaatatttcttagaggttaagtactagatgttttgtccttcttgggtttttgtttgttttttacaagtatctgagtgcctgctattacctagctgttgtatgcactgagatgagcaacttatgcaaactgccttcaagtagtactcagtctaaacaacgaaataacttatctgatatattgtgagagaacttcagtgttaaaattgtaagtcaaattcaagtggggaaataccaacatttcttaaacctgcaggattagtgttcttgctgcatcccttttttggcttcataatataggtagcaaaaatttttttaaacccagcatagattgtatcgaagatacctgttaaatgctctggttctagtataatgacttcttatgtgggctactgacttaaaacgaagtttagtatgctgtatattttatttaaatatataaaaacagaagttaacattttgatactgataaaatagtcatttttatcaatgtatagaatttgactttagagaagattatcacttttttggaaaccttaattttaggcatattttataatcttataaaaaggtagaagaaattactgactacatttattctaaagaaataaaataaatatgttattgcgaggaaaaatattataactgaaatattactgcatatggttattaacttggggaaagatagcaggtttttttttgttttttgagacggagtttcactctgtcacccagactggagtgcagtggcaggatctcggctcactccaacctccaccctccaggttcaaatgattctccttcctcggcctcctgagtagctgggactacaggcacctgccactgcgcccggctaattttttgtatttttagtagagatggggtttcaccatcttggccaggctggtcttgaactcctgacctcgtgatccacccgcctcggcctcccaaagtgctgggattacaggcgtgagccaccgcgcccagccgatagcagttgtttttaatgggattagatgagtaatcgagaatcatcaaatagttgaccttatttccttttatgaagtcatgattggtaatttattatgggtgacaggcacatgtgagcttttctaataaagggaaattgatttcatagtggtatttctaactttttcatttttattcattttatgtggtattcgtttatttgattttgtatggtatcaaattagataagacatttaccaaaaacagcaaaaccttaaaaatagaaatactgaataaatacctttgaagaggtatggggaaaatactgaagaaaatttagttcttgtcaagtgaggactaaagctaattgtgatcatttaaatatgctgacacgcaaaaaagtattggtagactcttccccattctgatgataatagcagtttaaaacttggttgagtggaatatatatagtaatattaatatgtttcttagaactctaaaattatagttgagaacatgactccacccaaagataaaatgatgcaacaaactcacatacccctttgcaacataatactttgcaatgagaagtttggtaagttatttaacctctccccactcccaccccttgccatttctctttttacgtaattatgaaaactggatagtatatcaattttcaaaagatgaacaaaaacctttttaattattaaattgctgtaagattctaagtaattacagtgagagtagtctaatacgaggtagtgaggacacttttttttcctagtatttctatttttttatcattttgttgaactgtaattcaagatgctactgataaaggagcaattttactcttaaatctaggtatcttcaaagaacagtaaaacatccaactttactacaggatcctgatttaaggcagttcttggaaagttcagaggtattatttctatattaaatgtttgtatatgaatgttctcgttatttgtcattgtaatgtatatgactatatatagtaaataattgagttaatagatggaataaagcaattattattattatgttttgcttagtgctttaattaccctgctaaattagtagcaaaatatctttgctttgatacttgtagggtgattagtccctttcttgaatacttaaaacaagatttaagagagtgatttataagtagtctaactctgaatgccctaagttgttcctcaggcatcatgttgaaataagtttattcagacttcattttagagaaagagaaagttgaatgtgtatttgcttgtctacattttggtatccttattaaggttttgaaatgcaaatttgtgacttgaaagagcctaaattctaaacatgatgctctttttatttgaaatgtttggtatatttttggctcctaagagcaatttgagttctagtttgcatttttttctttaaattacttgagttgcagaatttttaaaaaactcaaaattacacaaagctaactgagcataaggagatttttctcaagactttcttctttccttataaacggtttatttctgttagcaaacaggtggccagtgttagggtacttggcaatttcttaatatattttgacaaacagggtgtttgttccatctaaatgtaaacgtgcagaagaaaagcaaatggaaagtctattttttaagttttcctttgagaatgtacaagtagtatatttgagaaattagatctcactattgaaatgtatgagagtgaagaaaatacaacctcttttttaaaatttgtatgtgggggggaggggggaggaggggggatcacttttgtgcctagttaaacctccaggcttttaaccggtttgtttgcccttatttgtcattcaattccagctgcctagagcagttaatacacaggctctgagtggagcaggaatattgaggatggtgaacaaggctgccgacgctgtcaacaaaatgacaatcaagatgaatgaatcggatgcagtaagagctgatttttcggcttgaataatgagatgaattaatgagcccaacaattgcattttaaagctgtacaagtggaaaataggatattaatttgcttattgagtttagttctcagccacatcagttggccaccatggttataaggttaatttgttgctttaaaacaaggaatttagcttgctattggtaacctaatttacaatggtttgttcttcctaaattagctccatttttcatttttttcttagtggtttgaagaaaagcagcagcaatttgagaatctggatcagcaacttaggaaacttcatgtcagtgttgaagccttggtctgtcatagaaaaggtttgtttgccttactacttacgtagttagcaccataaaactaatgaaaatattttatttaaattttatgaaaataaatattctgaagttattgcagaagagagaaaacaatcatttaagacaatgttttctagttcaactttattatgtaaatttttttgttctattttgctttactatctagtttagaagtagaaaaataacgagcttagaaaattatttgttaactggtacagatgtgagctaaaaaaaagaacaaagaaaactatatttgaattttggattaaaacttggtcacttgattaactttttgttaagtatagttacagttaaatggatgaagaggtcttatcaattagtaactttgattataataaaaaaacttgagatttgaaaattgctttttgaaaattttttggaaagtatttgttttgtgtgtctatttcctgtaaaaccctttgaagtattttcttcatttttgaactgcaatattgaaaaacctggaggttttgctaaaaattcatagaaaatttgagttgtaatattttaatccacagtgaaattatagttttttggttttttaaagaatccaacaatgtaaatatcaattgtctaagacatttaataagcaaataatatgtaacattaccagcaatacattttattaaaataattatagaaacttattaatacatttattattgaaagtagtttgtaacagcttttgccatttgaattatatatatctcttagggaatgggcttttttggagaactttacataatgtagagcaacggagcagtttccacgcagtgtaattgttagtcattgacagtattcagcctgtaaacatctacttttctttatttgaaatatctgaaatgatcacattctaaatctttttagaaattctaatattttactgagattgttgtacaacaaagaaactaacagtaaaatttatgttaattgtgtatataattttacctttgctcctgttagctaaataatattctcattaaaattatagacattattttcaatgacaaatgtttaaaggccagaaatgtggtataaatcaattgtgagtattaccagttcttctcatattaaaaatatatttcatttttaggaatgggcagagaaacagtgaacactgtgggagaaaaaacaggaggcagatttttatattaaatgatttaaacatagttcatccctttggaatataagcagtgatttgtctgtgttttcagtagatctccgagcacttggcatttatgcctgaggcattttaacgactaattgtttcatattaattaatttaaaatattatttgagcaacttgtgcataagtaaaatttagagaaaagtggaaaaatcaatacaatattttaaaattttatgagtgaacactaaaattgcatacttttttttaaatttcagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaagtaagccctttcttgcatgcttctcacttgtgtcgtgtactttaaaaagtattttgtttcctattaattatgtatttacatgtctaaattcctcctatactagcatgaataaaatggcttcaagataagtatacataacttaatactttcttccctatgacttgcacagtacaatagatagaattaatgtttttaacaggtctaaggaatgacagataagatagaaaacatttatacatttacttatgtatttgcttatacaagtttggaactaactaatagcatttgtttgctcgttctagcactaactgaaactactcaccggactctattatcattagtaaagctgactgtgtaataaataggataaaaccagaaacgattattgcagtgaatatgtttaatgggggctttatcataaatttggatgtaatcagactttgtatcctcaaatatgtagtcaccatgtgtttatagatgagatgggactagattagatcataaattgtgttattgaatggtaatacttatataatagtccaatttctgaatagttgagaaagtaatccagttagtaaaaattagtattctgcagatatctgcagttttcagacagttaaactgaactgaacgttacccactgtatcatgtttcagaagatactttaagatctttgaatttttgttatggatattagttatcatggggtttgaggggtactgggtatttactttttaccttgaatttaaacatctagaaagttaatgagatcttgtttctttcttatgcaaaattttttcagctaaagtctgtgatcaagttaatactcatctacaatgagcatatttattgatggttctgttcttaagcaactggtgacatttattactagagcattcttagcacttcagaatggtgctttcttttatttggtaaaattaccaattttacttgtattttaccgttttaaatgttcctaatgctgttggtgattaatttctcagtatttagaaatgttaatatacatagcaattgtcagagtatatatacttcattatatataggcagcttgtgatgtacagagatccagtttacagatttgtcccacctactctcacttcttaccagagcacccaatagcatgagacctgttgtaaaaaagtgtgacacttccaacaaacccgtgggtcaaaaaaggggagttgggcagtgtctgtaagaatacatatctgggccgggcactgtggctcacgcctgtaatcccagcaccttgggaggccgaggcgggtggatcacgaggtcaggagatcaagaccatcctggccaacatggtgaaaccccggctctactaaaaatacaaaaatcagctggacatggtggcgtatgcctgtaatcctagctactcaggaggctgaggcaggagaatcacctgaaccggggagtcagaggttgcagtgagctgggattgcgcaactgcactccagcctggcgacagagactccatctcaaataaaaaaaaaaaagaatacgtatctgctaataagagctaacctggaaaaagaccccctggcagtgatggcctgcctgtgtaatggatattgatccctcaaaaatagctttcctcataccctaagtctttttgctgtgttactgtatttcctgaaattacagttatattcatgttttccaaaatattttctatagaacactggcaccaaaagatggattacagttagctaagtttgggaagttatgtatatagtatccctgtttgcgagattcagaatgccttttaaaagctcagaactggttaggagtgaaaaagaaaacaaattttaatccagaggcttctaaattcatttgaacaagaattattttccaccaaatatctatttacatatatggaacacatttgtggaaatactgaattaatgattcattgactaaaagagttaaagagctgtggtgaagttgccttcaggtaaattaagctctttaagattagtttctactgaaacctagcccagatcaactacacaaaggaattaagatattatggaaggaggtgacaggtaatttttatggtttttgtttttgtcctattctttattttaaactaattcacttgtatttgaaaaaataatgcacatacatgatagttctaatagctcagcaaggtaaatttgcctgcagaactaagacctgtagtctctgacctcagtcataaactgttaggttcttgtgtgtctttacagaattagctatgcatgtacatgaagctaattctccctctgtccatttattccttccatccccttctctccctcccttcctttctcaaaaaggaatatactgtgtgtagtgttctttgtctgctttttacacccactccacttaatagggcggtctccctatcaacataagtagatgtcctttttttttttttttcgcagacggagactcgctctgtcgcccaggctggagtgcagtggcgtgatttcggctcattgcaggctccgcctccgggttcatgccattctcctgcctcagccttccgagtagctgggactacaggcgcccaccatcatgcctggctaatttttttgtatttttagtagagacgaggtttcaccgtgttagccaggatggtcttgatctcctgacctcatgatccgcctgcctcagcctcccaaagtgctgggattacaggcgtgagccattgcgcctggccggtagatgtctttttaatggttgtatagcattccatcatataacatttagatataccttgaattatagtctagtcttttaaaaaatcaagtgttttgataactctttggacataaagattctataagtagaattgctgaccagagggtatatgcattttaaatttcaataagtattgccaaattactgttcaaaaagattttactttgtaccctaacctacctaaacctacatgtttctttttactagcacccaagaatgaaggttttttgttttgtaagttgccatttacttagtgtgaatcaagacatctttacaaatgataaaccatttgcatttctttttctttcttttttattgagatggagtcttgctttgtcgccaggctagagtgcagtggtgcaatcttggctcactacaacctccgcctcctaggttcaagcaattctgcctcagcctcccgagtagctgggactataggcgtgtgccaccacagccagctaatttttgtatttttagtagagacggggtttcaccttgccaggatggcctatctcttgacctcgtgatctactcacctcggcgtcccaaagcgctgggattacaggcatgagccaccgcacccagccctacatttctttttctgtgaatgaactcttcatgtcctttgcccagtttttgtttggttattatctatttcgaataggtgcttaatattaattaacctttggttttatccatatcgagcgtacttttctgatgatagttcttcaaattaggaatactttggggattaatatagagccattgttaggatcaaaaaacatcaggaattggaacactaaagaaaaagctacattttacccatttcaaaatattgcctaagcctggcgttgtgtcaggaaacgcctgttttcctcttttgtatagtacatggtctctgcaatttagaactataagagttggctgtatccttacaagcattgtcatgtattgggcttctttgaaccactagagtagggtcagagattgagggcaatggttcttaatgtttttagcactagaactcttcataaataatttttgtaggggatcccaatttataaaacatactaaaaaaatgtatttaactaaaagatggattccccaaggggtttaaacgctttattctttggctataaatactcagcacctcttcagaactccatgaagctgggcagcatattttcagattaactgaattacaatatgataataattaaaattgtagcatcaaatttcctgatgggccaaaaaaactgttagacatctgcaatcttgtctaactgagagcagcttgcatacaaatgtatgccataaattagcagagtaatggaggtcctaaatggatgatccgtgtaaacttatccctcttataatggttctactagagtggattagtatcttgacatacaaagggacacattgttacgatttaattgatttaatatagcattgttagaagtttgactggtgctggttcttttttattttctgttattttgttacaaaggaaagaaaacaaacgaagaaaaagttaatttgtatatttaagattaatttttttttcctgaaataacctgactttagtagtcttacctttatcatagctcctacatctgtaccacaataaacatgtcctggttctagaatactatgagataataaattggacagggaccaaattagtttagatttagcatatcaatggaaaagccggttgatgtatacattgagaacttaagcaaatattgaattaaagggcatgttcattagctttttccctgtattggtacatattttaaggaatcaaatttttactgaacagaggaatttataaatgaagaaaagatatggccctgttcccctaaagcaagactaggtctaaaatcttacattactttttggtggtcgtgtgtatgtgggtgtgtgtgtgtgtgtgtgtcggaagtgagagggattgtcttaagctttccaacatgtggtcgtgtgtgtgtgtgtgtgtgtgtgtgtgtgtgtatgtgtaggaagtgagagggattgtttgtgttaagctttccaacatgcggccggggacagctttgaatgcagcccaactcaaattcacaaactttattaaaatgtcatggccgggcgcggtggctcatgcctgtaatcccagcactttgggaggccgaggcaggcagatcatgagatcaggagatcgagaccatcctggctaacacagtgaaaccccgtctcttctaaaaataaaaataaattagctgggcatggtggcgggtgcctgtagtcccagctactcaggaggctgaggcaggagaatggcgtgaacctgggagttggagctcgcagtgagctgagatcgcgccactgcactccagcctgggcaacagagcgagactctgtctcaaaaaaaaaaaaaaaaaagaaaattgtaaaaaacactgatgacattttttttttaaagctcatcacttagtgttagtgttagtatgttttatgtgtggcccaagacaattcttcttccattgtggcccagggaagccaaagcattgaacactgctgttttaaatgatagtgactttttctgaatctatttgtgttagatatgttacttttggattttaataagggatgttttaggaaaaacgtggtattttaaatataagaaaagcagacaaaggagacagtaagattcacttaataatgtaagaaaaattatctgagaagacaaattaaatatagcaaagtggatttaaatacccatagataaggtgctttgactgccagtttgccctggatatcttttgtcctggttaatttaaaatgttcacgatccttaagaattcctttggaaaaatgctttggtttctggttgattggattttttaatgctattatcacatttttaaaaattgccatatgatataaatgctttttagttatacattttttccataatactaacctatcctttgcactttggtatagaaagcttaacagttaactacatttacatgtgtatgttatttagaagtaatccataatggctgtacctactgattattaagcatccactaggttaagtcactatgcaataatatactccttatgttatttctaatccataaatgtagacatcacttcccacctttcgtatttgggatcattacagcttggagaagttcagtgaatttacccatggtcatacggtgacaaaactaatattagaaccaaatttgattttctccaaagcctgctttttaaaaatatactacctacatatttttctcttcagatccctataggaacatgtatttttactgcttcatggttcaaaaagttttttatttggaataaattaaaataactcgggtttagtgcttcctggttcacccaatttattaacatttacttcatgaatgtttgattagtaattactaaaataattttaatatttctctaacatcaagccagaaagaggattcttagtgggttctcccatcctatccatcatttttttcatgagacttctaattacactaatttgtccatatttcatttcttttctctattcacttgcccttgctctgccagactccttgagagaagtcatggatttggttgacttattgtattaggatctttttgtctatttctttagttctgcagtgtatatataaaaaatatatatagtcctcttcatcttttgcccttttcatcttaagactgtctttttattcattttgttatattttacgttttgattgctttgcctttttttatttgctatggtaatttcttctaccacatatcttatgagtttttcccattttgtcttttcaatttcagacatgtttctaatacttaatatgcttctaatattatttagcgggaaaatttccagtgtaggtatgacactagcattttcctattaaagacatcttcaaagcataaaacgctgttataaatcttataaaccatatttaaagccctaaaggctagtgatgaaatgggttttgaatgtagtttttattctgaacatgtttcatccagtgacagggtttttttgttttaagcaaatgaatatggagattattttctttgatattggcatacttactttcagtatcttagtatattagaatagaacttaaatacttggttttattgttttcagtattataacacttctagtgttaagaaagtattttaaatgttactcttacttaatagcattatgtcattcacttatagggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagaggtgattactaaatgctttaatctctttacttaagttttgcatgagtcattcatatatacataatttttcataattttttgtaaaccattcaacacgtagctatttttgcatatttttatgaactgtgttagaattactttaacattttgatcattattattaaaatctccagagcccttcattacttatggaatggataaagaagcatacaaggaaaacagctaaaattaacctttacattaataattacacatttttattagatggttaattttatttcagattattattttgtgtctaaaaatggttttagagctagatctctcccacatttagctgtccaggcaacattatcccccatatatatgtattatatatggtattttagtgaatttgtataagtttattataatttatacacttttcttaccatgcttcaataaggaaattgaagaggtaggacaacctttatgttactaaaaataaatgtacctgccctttgaagagtatgtaccagtgttttggttacatagtgggaaaaatatcatttcattgcttaaatcttcagttattttagttgtttcattgttcactaatcacaacattttgttgtttctgtactgaatttaatatttattgatggtcttcagtagaccataattccacatttttttccaatctggtcattttaccattacaaaaatatttttaaaatgtttatcatgtaattttcctaatttaaaatatttccatcagcatataaattttgaagaacacatatccttggatttaacagtattgatatattctgaaataattattgatataaaaaagtaattaagaaaattacactatagcactgataatttattttgtggtgaattttatgcccaaaatctttcctcttagttatatttaattaagctttggacattgtagtttattaagtacagtattgaaatatcttaatattgagcaaatctgtggaatattaaaggaaattaagctaacatgcatttctattggttgacagttaaatgcaatttctgttgatgctaaattgtgcattgccaatattgagctttctcaggattttcaggcattgtgattaaattaagtgagtggtcttgacagtactatacttttttttgagataagcataaaatatttctttgtttttattagtgggaggcgaaagtgcaacaaggggaaagagattttgaacagatatctaaaacgattcgaaaagaagtgggaagatttgaggcatgtataataattttgcatttatcttaacaacatggtcacattttgctgcaattttgtggtaaagttgaatttagctttctactaacggactttttaaaatgtacttcaacagaaagaacgagtgaaggattttaaaaccgttatcatcaagtacttagaatcactagttcaaacacaacaacaggtaagccatttttgtttataacttaaacttctagaatttgtttttggtatactttcttactttaaaaagatgattaatgaactgggcatttaaactcaagaataagaaatggaagacagaaagccagtgatggtaaaggataaaagggtaaactaatcggaaactatctcacgtgttttttttttttttgcctctgcttaacactaaggcagagatagacttttcccagttttaggccatcagaaacctcatgggcaactttcccctttcactgtctttctagtttgttttccttgttggtcagacctgtttgagtaaattctcatagtaagttcttctcttccataacaaatagaacttaagctaaacactttttcagaattaaaaaaaaaactgtactgttttcatttttgctttattttgtttggggttggtggtggttgaatgctgcaagtggcatttatctcatttaccatggattttaatggtatattaaataaaaagataatcacagaaaattttcctgtatattttaatgtaaattagagtaacaggtcaagtaatttaatatcttgaaggatttcttccttccagttttaaaatatgtggatctagaatgtcatttgtgtaaaacataataggttgtttttgaattaagtggtatgatgtcttcaaattgtgtttaatttttatttaaacagctcataaagttaaatttttttaaatatgaaaataagtcatataagcttgtttttaaaggaattgttttaaacatgacttcagttgatatttcagtctgttctctggactattcaaggaagactgacagctaattctatccagtccttttttttttcttgttcagtattttcttttcttcctccttatatcccatttttttttgtctagcaataacataaactgtcaatatgctctgaattgggaaatcctgtcactttatgctggaaaaggtcattgtagttgtattatttgctttaatatatggtaacactgttctgtgtaaaattttgcataaaacaaaaaattgtacattaaaagaactccattattttacatcaaaaactaaaagtagccaggagtaattaatgttttaaataatttatatatgaaatatattgacggacttcagataaggaaattaaaatgattcctttaagaaccagacattggccgggcgcagcggctcatgcctgtaatctcagcacattgggaggccgaggcgggtggatcacctgaggtcaggagtttaagaccagcctggctaacatggagaaaccccatctctactaaaaatacaaaaaaattagctgggcgtggtggcgcacctgtaatcccagctactcaggaggctgaggcagggaatcgcttgaactgggaggtggaggttgcagtgagccgaggtcatgccattgcactccggtctgggcaataagagtgaaactccacctcaagaaaacaaaacaaaaaaaacccagacgttagtaaatattagtcattgttagctatttgtatggttttttaatgttgtttttgtttgtttgtttgtttgtttttgagatggagtcttgctctgttgtccaggttggagtgcagtggtgtgatcttggctcactgcaacctctgtctcctgggttcaagctattcttgtacctcagcctccccagtagctgggattacaggcaagcgccacattgccaggctaatttttgtatttttagtagagacggggtttcaccatgttgaccaggctagtcttgaactcctgacatcaggtgatccacccatctcagcctcccaaagtgctggaattataggtgtgagctacccagcccggcttatgtagatttttttttaatgctgtacaggatatatgcatataaatgacaaaaaggtaatgagaataacttatattttaattatcattcacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatatacacacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtgaaatattagtaacaaattatttgggtatttaaacattaggaatcttttcaaagcatttttaataggaagaaatttttcttctagatgtatataggtgatgccatgattccttaattattttaattgacaaagctgaactcattaaatgactaaatgaagcttaagttttcttatgaaaccatcataaatcaaagaacatttgactcttgattgtcttgggtaaagaagagaataattgtctttgcttgtttttaaccatctctattacaagtgcccaatttaagaattaggaaaaaaatgtatttatatacttttacaagtcccatggattttgttcatcttctcgttatcttcagaatctcgtactttgcatatatttaatttattcttgtcttttggttttttttcttttaaactaaaagtatatcatctgtgctcacagttgacaaggaatggtaccatgttaaaatataccatgatttgatgaataagcaagcacaacacaaagcaaatttgaagtaaactgaaatttagtttgccttgggcaatgtttttacccattctgtatgctacttagacagctgttatctaatccttaatgctgatgaaaatttaagtcatggctgggtgtggtggctcacgcctgtaatcctagcactttgggaggctgaggtgggtggatcacctgaggtcaggagttcaagactagcctggccaacatggtaaaactccatctctactaaaaatacaaaaattcgcctggtgtggtggggtgtgcttgtggtcccagctacttgggaggctgaggcacaagaatcgcttgaaccaggaaggtggaggttgcagtgagccaagatcatgccgttgcacgccagcctaggcaacaaaagcaaaactccatctcaaaaaaaaaaaaaaaaaaaaaaaagatgactggtgtcagagctatttttgttttttaaaaaatattcttacaaacacccctcttcttgagcttaaccaccacatatcccttccataggaacaagatatggtatgtgtaactaagtcatctctagtgagtcactggatacaatttatatatcgaagtatccttagcatgtgtttgcttctgctttagttgaaatgttaagccttctataggtgttattcatatttatactcccacagcccagaagagtggctgatacataataggttaataataagggcttgatgggccaggcacagtgactcacatgcctgtagtcccagcttcttgggaggctgaggcaggaggatctcttgagcccaggagtttgaggctatagtacactatgatcgtgcctgtgaatacccactaacctacagccagcctggacaacatagtgagaccctgtctctaaaaaaaatgaagacttgatgagttgaacagggaaaacaaaagtttgctcttctaaaaagaaactgaagcagaaatagtacaatcatcttttgttgcttctgggaatacttttcagaaacgaataattcatagtaatatatatcagatgctatcttgttgctccattaatattgagcaaaagataggcttaccaagaatagtttcactataatgatgtcctagtgttatatccacaggtatattacttaacaaaggtatagtttacacataggatggttattcaagttattattaaaatcttccattcagatgtggtacattagaatattcagtacctccaagtaaaataataaatattttcagccttgattaaactctagactcccttccagacttccatttcccttgcccacatttactaaaagatgagtgtgctggaaatttcaagtattatatgagcctctgatacctaccagtatttaaacaggatttaattatttcaacacttcacccatcaatcttcacttctcctgttcagataaaaatgctttcatcccaaataagtaaaacaagaacattaatagtgctaataatataatcttttcattggataggtctgagttta

SEQ ID NO: 16053 - DNA, 15659 bp, Human
gggacggatccgtgtagcaagacataatgggcactttttcatttgtttgtttgttttttagatggagtctcactctgttgcccaagttggagtgcagtggtggatctccgctcactgtaacctctgcctcctgggcttaaggaattctccgggctcaagcaattctccagcctcagcctccagagtagtttgggattacagacatgtgccaccatgcccagctaattttttgtttgtttgtttgtttgtttgtatttttagtagagatggggttttgccatgttggccaggctggtctcgaactcctgacctcgaatgataatgatccgcccgccttggcctcccaaagtgctaggattacaggtgtgagccactgcgccaggcctgggcactttctttagtagtttgaggagcaacatttttgacagtgtccttctgctcaagattcagatcccagataaaattaaaccatctagagagatggcttgattggccaaacctggatctcatgaccacttcttgaagtgggtaagtctcataaatgctcagtccttccactatgcaactgagtggggtgggtgggaagcccctcaaaggaaaatccggttgttcttactagaaagaaaaggaaaatggatgtgaggcagtcaaaatcagcagaggtccaccacaccaccaaaatgtggtgattaaatatggagagacagagactaacagaggtatgtgaatattgaagtatgtctggacaatagcccaatgatgagaccaataaaatggttaccaaaatctggttttgagtagtagtgttaaatcagaccatttagtaaccattttttgttgcaaagtttctagcactgcccaaaccctgagtggtatatgaataactcgtccattatgtatctctttccagtcagcataatttatcccccacctatattcttttctgaccactcctacttccttctctttaccaaaatctaaactctaaggctgtttcttcagcaacttctttgtttagattggaagataaattaaacagcatgcgatgttttactgactttcagtatttaacagaggtgatttaatttttttttaaatccaaagtcaaacttctttataagatgaaggagaaaaatgtcttataaaatgcatatgtgaagatgccttctgagtgctttctcatgcagacttgttctagtctttaatgaatcttccttgtagacactgtggagatgaaagatggttctccacttctactcaaagtacaaatcaggccggcattttgaaaaagagacaggtttattcatagctgcagcgttagctggctttgttccctgtacaatttcacttttggttattaaaatattcactgtaggaaataaatttgtaacccatttctcatattacctacacacagaaaaacaaaatttgatatcctggggtttatttgctgagggcgcttcccataaaagcgagagagtgtgcgttgggaaatgtgtctggttaactcttttatggataaactttagtcacaatcctcccccgcccccctctcacccccagcaccctcccaacctcccgacttcccgcctctcaagggctggtgacctaatagcatttttcttcgtgcatattttggcgtcgccccatggcctggctgccttcgcctgtctgagttttttgaaattcctgcatgttcgccccagattaagccagtgtgtctcaggatgtgtgttccgttttgttctttccccttaacgctccctgtgcaacgtgtctggggggaggagggcagggacgggagagagggaggggcagaggcgaggagctgtccgccttgcacgtttccaatcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtaagtacccccaagtccgctggaagcacccgtgcacctggtccccagctatgtggcttctcgacgtggctgcctgggcgcggcgggccccggtcctcgcagatccgatccctcccccacgcgcctgcagtggcagccctggaatccagtgcaaaccgcgcgtctggcccctcctgcttccttttcacattgctttgcagtcccgggcgtccccagttctcttgctgtcctccgctccactctgcagtcccggtgggcgaagggtgaggagtaagggacctagaggggtagggagttggagcggggggcgccgggttgtttcactgctgcgcccgtcgcctgctgacgtttaggtctcccagacctggtggccgacccctactacatccaggcgtccacgtacgtgcagaagatgtccatgtacaacctgagatgcgcggcggaggaaaactgtctggccaggtacgggctgatatgtctgaggccccgctccccggtctaccttcagggggcgctctggtgcctggttctgactgctactgcttcgcgcagacaagtgttaggaagtgggacaagagctgggaagtgggacgtgacctcctgggcatgctgacctggacggagagttaatatttttgaagatttctgtgggttctgtctcaaagtgcagcaggaatcacagaggtggaggaaacccttatcctggagactgaaagtctcatgctctttttccaagatacttaaacttgggagtcaattgttccaatcacttttcataaaacaactatacagtaattcaaaaaatttattgtaatggaagggtgtgttaatacccccttaaaagattcggggcaaatttgccatcgtagcctcattggtaaagactaagttttcctcttttgtttgagaccacgatgaacttggttgttttggtattacttcagccagaataagaccgtgagcaagagctttgtttttccactattctaaaataaaatagtaactctgggattggggttctctgggtttactgctgggaaacagcagagggagcaaaagatgttttaataaaaatttaaagtgtaaaataaggtcatcaataccacctgaacatatagacacactaaatatattagtaggaacacagtgatgtttatttgtacatttcttccactttgaccctttataattgtcaggctaaaggaagtgaagaaatccaagctcattttcattcctgagtcttgcatcactcacaccattgaactccctatgatgtttttacagtactgccattgttttgggatagtgaagttacaaaattattaatttaaatctgggtatgctcttttagagttatttcctcagtttgcagctcattaacttttttaaaagttttgttaagtttgaagtttgtaataaacatctatgaattattttttttattgggggattatttccacttcagtttcactcattcatatgatcaaacttgaattgattctaaagtttacttctgacatttagatttttaatgcttattatgtttttactgttaagatctgtggatttccataggtgttattcattcacttattcaccaaatattcattgagctctgactactccaagacggttctaggagctttggattcagcaatgaacaaaaagaaacaaaatgccttagactcttggaactgatagtctagttgggaaaggaggattgtcactactatataatggatgttttatttgtagttttgtctttagttaatattccatgaatataataatttttcttttttcaaaatcacagtacagcatacagggcagatgtcagagattatgatcacagggtgctgctcagatttccccaaagagtgaaaaaccaagggacatcagatttcttacccagccgaccaagatattcctgggaatggcacagttgtcatcagtaagtaaatgggcctcctgggtacttttgggttgcttttcatttctcaggtgatttttgatatcacaaatgcaagtcttatttcttacctgaagggagaaaattgctattacttatatttagaatttttctctatgtaatttcacataacccatctactacaagatcctgttatcttttgaaatggaaaatctgaagcccagcttattaaagctgttgataggatacagcaattgacttcaataaaatttactccaatgcattacagataggatttctttaaaagtccattacagccaagatcatctaaagttagttagcattaaatagcatttcataaagaccacacgttttttatcacaagcattcagaaaccattctcaaagaaagatgtagatgatacatcccatcagctcagaaggaccttcttccatcttttaaaagacctgtatcaagcccaaggtggttgccttttctatcctaaatttaaggatttttgcataaggtaattctatcatttgccttagtaacttgcctgggtgtttattttcaggaaatcctcatgtgtggccttaaacttacttcctgaaatccaagccagtcctcattgttttttccttatgtgggaagatgaacagctcagcaccttccatttaatgaaataacaaaagtagatataagtcccttaatttcctgataaaataggaatattttatttctaaataaaagtgtgtactatttaaataataatggtggataaaacatgccatgagttctcccttgcttttcactaatgattttaaatatgtgagaactcaattttttaaaatctcatagaaaccttgaaaaagtcatgtgctgcttttcggaatgaaacatcagcagtggcagccaaggggaatacactagagaacacagggcaagtttcacttaagcacagataatttattgtccatttctatttaatattcaaagacaaaatggggtacaataagaaagcaaaatactgaactaagtcttttgtcctagtagcaaagttaaaccttacaattttgatagacttatgtcctggggaaaaaaaaaccctagcatgaatctctcttttagaagataaatttggtctcaattttaatgtgaaaacaaatttgtgaagccatgggggaagtcatttaatatcttcattgctttctctgtatgtaactgaccaccatctttttgttttgtgggacatcagacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacaggtatgttggcaccctgaaatccagaacctcaagcctcagagagaaacgggtcatctaccgttagttagcattaaatagcatttcatgaagagcacacacatttttatcaaaaggatacagagactgttctcaaagaaaactgtagatgatataccccatgagtctagtattttctttcctctcacctctcttttataaagcattcaatttgaggtccatgttgttaagatgtaaaataattgggaaaaggcaaatgatggcttgatgatccaaattacttttgaagtatttccagttatgcatgtggcccctattcatgatcacaggtcagtgtgggtccttgttacagtccacaatgaagaacaaaaatttactctctgaaaaagtctgaatggttgacaacatatgcacccattctgtattccttaaccggcttagtaaataactgtaaaaaaagatatctctgttttttcacctgtgaaaccattccttccttctgttttatgctgaaaatagaatagtggttgcggttagcaaatggaggaaaaataagtttctttaaaagcactttaaaaagttgcctcttttaataatgcaaataagagcagaaggacaccatttctttctccacacatatatatttaaatctacagtataattgatgtcagatgttgtttggatggatttttttaaagtagtgctgaactaagcagtttgcatgttttatcattggaaaatgcgtgtcagttaaaatctatgtcagtatttccatatgaaaccctaatttgtaaaaggacattataatttgactcccgcccagatcttggcaaggggtagtgaatgtacataactgagggtatgaagggatcagcagttggcatcttgggaagcaaattccagggctgtggcaggaagctgtttggtgacctaaatgttaccattgcttttttctctgagcttagaacatcatagcaattggagggggaaaggttaacttctacatgccccaggacagtacttacttaagaaagaggagatgtaacttacccacacattattcatgtgtgcatatacagattcccttttcagtgatctgcaagtcctgtgcaagggacctagagtttatttgccccatttacaaaaagaggcactctggacagctcactctgaaatatttgaagctgggattgtagacattatagcacttctggttcccccccttctttggggtgaccccatttcattttatatggtagctttcttgttaatcatcttccatatatgttctttttaaccattattcaccaaatcttgcattgagcgatttatatatttgtttttttcattagatcaatgtctctttcacatggacttcatttaaaggaaaaaatagtctctcaatcacctaatgatgactcagattagtttattgtaatgctgcttaaatgtattcaagcataaaactaggtataacttctttagatttatacttttacatattaataactcttgtgttctgagacaaaaatttacatattaaatatatacgaaactaaaacagttgaattcaccttattaatttaatgtaacaaatagtatgtattgctaaaactcaaattgctgatttagagagcctcagctaacattcaacattgaatctgtttttatattttgactttgcctacatgaaatgcctatttgccttagtaactcgtttttgcttgcttgtgcaaataatcaaagcttatacttaagttctgccagcttatgaactcgagtgccaatttcagcatttttaaggctcttttgtctatttgaaggcaagataagcactgaagcattatgtaaacccatcttaaatgaatatctaatccagtgaatcctttacaatgtcatgaacattgtggtagtagtagaagtaataactagcacttattgagtatgtattatatgccagaatcagaattgtatgctggaatcagaccaaaaattcttcattttatatttactactcaacatactgttaagtgatgtatggatcaaggtaggaatctagataataacaacagaatatgagtctcactgctgtgacactgacccttctgagttgggcctgtctgtgctattgtgtgctctatgacagcacaattctcccctgctcttcccaaatcaagctacagctaaaccagcattggtagagcatgctaaggtgattttactgtctcttgggtgaccaaagtgatcttaaacagcaaagcaatattggttgctagaattgaatggcagtattgagttaaaatgaatctagcatgtactttgaatttaaattactattagaataaaaatacaagttaaaactttttgtgaagaactaatggaatcaagaatatacctacagactccaatctgaggaaacttctctagactataacattcttaaaagcaaggattgtatttgttatatttttctcctcccagcctgtagaaggcattcatttacttattgatgtgaatattttagcaagtggagtgatgtggcattcatcaatttagtcatgcatttaccccttcaacaaaatatgtcatatttcagtgactgtatgagagagagtatagtggggtagttaagaacagggactctggaccttgattacctaaactcaaaaccagcttagccacttactaggctggatacccttgggtaagttatttgatcttagtgtgccttagttttctcatctataaaatggagataatagcccctcatgtagttgtgaaaattgaatttttatacacacacacacacacacacacacacatataaatgtttacgattgttcctgccacatactatttaataaatgttagttattcaaagatacaacgtaaactctacccttagggaacttgcagcctctggttagctatattcttacatagcatgttataatgcagagcaaaaagggataaacactgtaaaagctatccacaataaaaagtatcatggacgttcaaagcacaagaaggtaatttccaaaaggggaaactggggaggatttcactgagaagaggacatttgagctaagataattattatgtggcctttattcctgaactgttaaaattctagaactttggtagaggcctattttgttccttcagattgcatttatctctggtgatatatgacacttttaagaagtgaggtgtactactacttatattagtcctgtatcttttttagctggaggtgctataaggctgagtaataaatacttctcaagggagatgaaatataagtatagttttatgtcagactcttgtaagtactaacttaaaatttaatttgcaaataatagcatattatttatcatagtctgaccacataccataattttaaattttttattttgtttatcttagggattgagtcctggctgttatgatacctatggtgcagacatagactgccagtggattgatattacagatgtaaaacctggaaactatatcctaaaggtaaagacctttgaaaatatatcatatattgatattgcagatcaataggccctcttctctggattcaaatgttaaataatcatggtattggaagcaattatacatcctcaaactatttataaacaatctaatctaatctaatctgtcttattttaaagaacttcaggggaaaatatgcagtctctttccataacgtctccagagtttaaccacttacttaagttaaaatcccttccctgcttgatttagctaagtcctcattaacaatttccttattgtagccctatggaaaaagaaatactgaggaactctttgtgttgcccaggtcagtgtaaaccccagctacctggttcctgaatctgactataccaacaatgttgtgcgctgtgacattcgctacacaggacatcatgcgtatgcctcaggctgcacaatttcaccgtaagtgttatttgcttagctaagtaattgttgtcacaaataatttttgttcatgccaaacattatacatagaatgtatctgtttctgctactacagcagctttcttgtaagcagaccaaaggcagaaaatggtatgcagtctgattttatttttttaaataatggaaggcaaaggagaatgtactaaggtttttagttttcaggagaagcttagttttcaggagaagacataaacagaccacagtgtttacccagaaggcatttgtgaaggcccaatatatcaaattgctcaatatgtagagtgggtgagcttgtagaagccccagtagttgcttcttggccccttcctcgcagtccctgaaagaattgctagggttcttcaaagtacattttgaaaaccactgccataaagtaagcaactgaagagttcagccccctctggtctgtacaaatcaagatgtcatatatttgagttctagaaccattgatactaggaaaatactctgcaaaagattgaggtgtgtggaggtttcttcataatattcctactcctgagactcttcttagaatgaaatactggaagatatctattcacagggaggtgctctgatgaaaataatgaaaaaaggttgggtaggtttgactgcatgcctgtctgtcctgccccatctccttaagcactacctccccaagtgttgctgggtgctagattataattacatatgccacttgagttatgccttcccaacaatgagaatactatttccattggaatgatactcaacactcatcagctttgctttgtcactggagaaccaccagtgccactggatcatacagacaggtatagcagagctatactagaatctcataattaatagaaatttctgcctgatacaaaaacccaggactttctacataaagaagcagagactgtgctttacaagtgttgtcacaacattagagatagatgaagcctgtgatagcaaaaggatagcactgaaaaaacagagtcacatacattcttctgaacatgcccacagcacagaaaacctggcaggttttatggcccatattgtgtggagttggttatagtagaaccaacccccgacccccaccgccagaacaccattataatttaagctaaaataatttgcacttaaataaacagattagttttttcttaatttttataattccttaatttattcatccattctccatttatttattcatttgcactctcatttttgtactgtttgttgatgccctgagctagatattactgaataatgcaaacataaataggactactaatctctatactgctgtagccttattacactattttcagttaattacttatgaatttctttgtttaatgtctgtctcctgctctactcagtgatggctgtgatttagtctcttgtccactgttgtatacccattgtcaggtacaggtctgccaccttgcagcctctcactcactgcttaatgaatttctttctcaaataatttgagtaaaggcattttgagtaggggaagtgagagaattacacatataactgtaatagagatacaatatgagaagtttcatgagggataaaataaaatgtggtgagatcagaaggacctttgctataagtttggtaactcccaactatgtcttactgacttcccactagaaataggtctggagaggtctgttgcatagaatgtctcttgcttttaatcagtagaatccattgaattgggtattgctagatatttagaagaaataaaaattgttgtattgctccagcaatatgactgtacaagagggattcctgatgtggtcactcatatagagttgaattttttttttttttttttttttttactagttattactgactgtaacaaacttcaagagtggttgaagctggaatgtttataactaatataaaccagatgaaaatatgaaaagtgaaattataattagtgatcataataaaatgtcatacttattctgagtggaaatattggggaaagtatagaatatttgagaaaaaaaccccacaccttcaggatagtaatacttgcttcttacattttgactttcacatcaggccttccttcctaggaatcagagttcagacagaggagaggtctctttgggctgagtttcaggagtgactttaggatacatttgaattgagccttgaagtctggggaatgcaccggggagcattaaggaaaggaagcccagggcaagtcaacgtcacaggcaacttgcatggcaggaggaaactgcagggcatgtttggaaaaacaagtcttctagtttggctaaagcatgaattttgtggagttacgagttggacaaaaaggatggaaaagtaagttgagccagatggaagacagccctgaagagcaggctaaaatttattctggaggcagtgggaggctgaagctttttgagcaggaagtgtaacttgcctaaggccatcaggtcagtctggtggctgtgtaagcagcagtgagtgtgactctgaagacatatcatgtatcagttcactgattgcttttcctgccagatatttaagagcattctgttgatgtgtaaaagccacccagtaaatagttgaataggtatgtgctgttaatgtaccctctctccttcattttcctcactgaaacaaaatgtacggaccaggtgactctgaggcttctttcagttataagatactatgtaagtttttttttttctcctcacagaatttactgtttggaaattggtagtttatgatttgaataagtgaattttcacttccttacatgaagatctatggtcacatttaaagacagtaatatttgattgattagctttggtccagtttctgcctattaatgtattattctacatccaaagccatgctggagaaggactaattcaagatggagcagaggccttgactctacttcttggtggacatgccacccttgttccatggaatgaattcccctggtcagggatgctggtcccagaagtcctgctgtactcttgagtgtttcagaagtggtttctttgcctctaaatgtgaagagtgtaggcatcaggcatctctgctgttgacatagtcactttcttcaaaccattattaaaatgatgtactactgcataatttcacaacatgattgctgcttaggtggagggaaactgttgcataaagtttttaaaaggttgactttaaatttgtctgttgtactcattcattatattatcaggttaataatttgtcttattttgtcttcttaatctaggtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggtt

SEQ ID NO: 16054 - DNA, 51336 bp, Human
  misc_feature (1)...(51336): n = A,T,C or G
accagttgctgaagagcatagaaccacgtggcatacattctctgtaattaacctcacccccagttttagtgtcatttttgtcttcacttctcttggcctcattttcaaatttcttgtttttaattgtttcattttgctaaggtgtaagtatttttgccagatgctctaaatcctttgatgaacaaaaccagaagtagataaagaaaatatccacaagcttatgttctgctcagctgataacatcaccatggtgatctggctttccacagaggattttccctttctttcctttctttcttttccttccttccttccttccttccttccttccttccttccttccttccttccttccttccttccttccctccccttctcttccttttccttcccttccctccttctgtctgtccctctctctcttttttcgagacagggtcttgctgtgtccccaggctggagtgtggtggtggatcacagctcactgcaacctcaacctcatgggttcaagcaatcctcctgcctcggactcctgagtagctgggactacaggtgtggttgcccagctaatttttgtagagatgggatctcactacgttgcccaggctggtcccgaactcctaggttcaagcaatgctccccgctcagcctcctaaagtgctggcattacaggtgtgagccaccgccactgcacctggcctcccacagaggattttctaggagataatgtgctcttcagaaggctcgaggatctcagctggcagattgagttcttactgtgcattaacaaattgacacatgggttcatgtggaagtcttgtgaacttggtaattgggtgtctattgataagaatgctcaccttgtaccattgattccctctacaactatgctgcaagcacagtcatctgctttcacttctttgaacatgccaacctctttcccacctcagggcctttgcacatactatttgcctctacgtggaatgttctttcctccttctcatccattagagtggcagcagtactttagaataatcagaggggtttaaaataatattgatgtccggtcccaacccagctcaattaaactcaaatctttgagtgtggggccgatgcactgataaaataaaataaaaggcatggagttgactttatccttacggtcggcaggtattttgaccaagctatcaccgtgagcagtagcatcaacagttagttattcagggatttggggcacaggcggttgtgaccacatcacaaaagttcaatttgttgggttaggcgtttagccataacctaagtagttgcagatggtctctacacctggattgcccattaggacaaaacaagtaaacttgtgtttttaggcaaataatgaaactctgaggagtctgaaaaaacaactcatcgccaggtaactcccagcccaggtgctcgtccatacaggggtgaacgcacggcagggggctgctcgaactctcactaagcctgcctctgttctttgcaaaatatttgatagtttttaatgcagcaaagcgaagcagacaatccacctcttgttttccccaagctgatggggggaaagttctaaggtgttgtttcctaagctcaaattaaccaagattggtcagtggcatggactttttttttttttttttttggtaattttacttccatgaggaatcatttggactcttcagtcttcctttcttcagttttacgtagggctttgctggaggaaaatggggctaagggggagagaaacatagtctcggagtagggtgggggataaattaaacgcaaacccagcggtgcggcaaaggccttattctgcctctgatctggggaagtttcatattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctccttttgttgaacaaatttgatttccggagtcagtcattttactgtcaagacatttcttgggcattctgcaacaggtaaggattttgcttccttaaaagtatttctttggtgtcaaaagaaatttttctaattttatttagcttttactctaggccaaacatcgtaatgactctgagctacctgctgtaaggtgtagaatcaatttatagggggacgggggtcgggggggtgagtgttgctttgatattcactgcccctcaccacagtcctaacaagatttttgaaacatgaaaagttacaatagttggctttttggttttccagatattctagagaatgcatatgcttgtgactgtggctgagctcaactgtatgggtagtttaaatactacccaaggtttgatgaagtaaatctaaagatgctctaagttgtgcaaatatgaattttaaagttgtctagttcagaaaagaaacagaaccgaagtctaaatgatgtagatttcaatctggaatttctagcttgtgtttttcacctattgccaatgttaatgaccatttcccaaaagtgctctatgatgtataacatgtattttttaattaaatttaatctttcttctgaggtggtttgatttggagatatgctacgaggtaccagtcagtagcctgagttgtaactaaacaaagtttgggaaatcaccggttttaggtgctttactaaatgaaagttgccattgacgtattcaagcaggcaacaagtagttggtgtccccttattggttctaagctggtgccgtggaggatataagagaaatattttaaaaatctctactttgaaggaccctataatctggtagttgtgataagaagtaaaatttaggaagcaatgcaagatgagaattcagtgatgagtggggcagcacaggcttgaagagttctgtgaattccatggagggggcctgggggcaaactggagttgtcaggaagatctgggctttggaagaatgcgaagtgtcggtagaaggagaaggggcaggtgatttcagactgggaggaccttgtgggcaaaggcacaaaggcgagactgacctggagatgataaggccagttgaagagacactggagaagagaagacagtttgttttacacattgcaggaaatcagattagacagttagggtgtggacacaaaagcgaggaccttgcaggcactggggagaagtgaccccattcaatagtccttggtctccttctgccctgcggctgcgcttcctcggctctcacggcaccagcagaattccatgtgagagggagcttgtcgagcgtggcctcttcccacttggggctgctttctgcatccctgtgcctggctgtgggcctccatttgccctctactgtcttcccttaggacatcatttatgcagagaaaggttcgtgtggctcggggtaccagtaagacctccacctctggtttcttcattttaaggaggcccttcaattatccaggaattaaagtggccttcctcttgggagaacgagttggttgatgaatgataagcaagtctctattcctcaaaagccagtccccaaattccatgaaatatgtgctactttctttgcatgtctaaatgagatggcacgggtatgcttctgttctttttctggacgttgtttagagagtcagtagatcataataattcagacactttttttctggaccataaaatatctgaacccatataataacaaacatacagcacggtgaataagaacccaacttttgagccagatcactttgcatggaatccccattctatcattctatcatttctgggctgtgggaacctcagacaagttacttaacttcttcaatgctcagattaaaaaaaaaattcacaaaatatctctaataacagtaataataactgaaaatacctacctcagagggttgtcgtagagatcaaatgagataaaaatatgtaaagcatgtagcctagtgcctgactgaaaaaaaaatctctcaatagatgcaactcttatgattcttattaaggacttggctattgccacaaatgaaggtgttatgagccctggcttaagagcaagaagcctgcaaagctaactctcctaatcccaacattcctttccagggaaagtagggtgacaggtggaggctgggaattaacgttttttgagcaccaaatatggacaaggcacaggggttgggtgtttttctagtgagaatacatatgaaagaaggaaaacaaacttggaaaccgctattttaagccatttggtaacagtttctctagcttatgagatgagagaggtcctctcagtatccgctgcattacttgtgggcctccttggttgacgtcgctctctgaacgcttggggtggaattctagaggtgcttttcattagaggcagagagcatgacctttcttccttgcccagtttaaattaaattattttatcttacaatgtgttaattttagtgctagcaaggcacagctaaaattccatttctacttaggagtggggatcattgtggcagtgagtgcttatttgggtttgggatgcttggatctgggtgaaagccaggattaaaaagcatcctccttccccattccactctctaggttataaatatttttttggattaaaagcctcctttaaaaaaatgcaaatccacctggcatgttaattgtgcaggggattcctaattatgtgtgcagatgacgtgagtcaaacggtgatagtgttccttctagagtcccactggtgtcctaagggaggagactctggagctttgtgtatgaaaagggatgggcacaagtcaggatggggtgcacaggtggaggctgggaggcagcatgacagtgtgggggctggggtgggctgtgagagcaaggagggtgtcagagatggaaaggatgaccccaggggggtggaagggtgccagaaacttagggctcctctgtgagctctttagccatttgactctagcaactgcttgaatgccctgaacaaccttttgacgacttgcacaagaagttgtcatactgttccccggatgtggacagttgttcagagaccacgatcatgtgtctggtgtctcactgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaaccgtaagttgaataagtgctgaaatgaggcaaattgatctactctctattgtgattaatatcttcacacagcaagtattttcctttgttttgagttcattccttgagatgagttatcgggagcggggtgactgggtccaggatatgaggatgtttagctcagtcatacccgcattttaacacgcaaacgtacggtgccgctcatttaaaaaccaaagtgttgtatacatgtagaagctatatattattccggggcagcccaaagaggggatgttgctttcaagcgaaagcaccaaatcacattcttttctggtaaaatagaatactaatgaattgcttttggaagaaatttccagagcattactgaatgttcaagtgcttcttagagcacaagttgaacctttcttatctctgcactcagtttctcgtaaaactgaagtcacagtgacctcttccccatttcgtagaaaagaaacccaaggaagagagtggttaagaaacagaagatacggttctcatcacatttgcctgagaactacgtatagtcatccattcagtgcctcgttaagtaaataaatgattgaatcatttgtatacatgacctcatggaaaaaagcacggtaaaatgaatgtttgagggtgggtagacagaattattcaacccggacaggtgttagatgttcactctatccccccctttttttttgcattaggttttattcattatttgcatcatctatggacctaaaagcatgctcattgtcacacagatgggaacagggtgaattttcaatgatttcaatgaaaaaaaaaaaaagatgtgctgttgcaaaatatcaagggagatgtttacagtggtgttctagaaccggcttgctctcaagtgctgattgtaatattttcagaaattttccaagccagtgacattattgacttctctttatctgtgtgatggaaatgctatataatattgtgctatctgagcatctgttttcaattttgcattcagcgatgtcatgatggtggcttgaaattggctatggtaaaagtacactgtgaaaatcagcaaacacaataaatcaggctccccaccttttttttttcggggcggggggcaagcatgttgttaaacgtttactagcatgctactgaggaactgtgtaaaatacaaatatggcaatttgacgatatgtatcaagagccattaaagtgttcatacactttgatccattcattccacccctggaaatttattctgaataaataattcaaagaaaagtaatatgcatgaacatattcactgtattatcatttatagcagcaaaatctgaaaataccctgaacactaagcaataggagttctggcaacattaactccatgagtttttttttttttttttttttttttaagacagggtcttgttttgtcacccaggctggagtgcagtgtgtaatcacagctcactcagccttgacctcctgtgctcatttgatcctcctgccttagcctcccaagtagctgggaccacaggcgtgtgccaccacacttggctaactttttttttgtagagacggggtctcactttgttgcccagcctggtctccatctcctgggatcaagtgatcctcctgccttggcctcccaaagtgctaggattacaggcacgtcactgcgcacagcccatgggttcttttaaagtcattaaaaatcatagttatgatggttatgaaaatatgtttgatatgatgttaggttagaaaatcagaattaaaaattttaattacattctgattttgttgtgaataagaattaaatgtgagccgtaaaaaaatgaatgacagcatttggtatgttagaatggtgaaatagtagaatttgtttttattttgtttattgtagtcgtggtgtgtgttcatttaagaaatttggagaacacctgttaataagtgatcttgagtagttttaacatttaggaggaaggctatgagttttgtgaaccacatggggctttacctttaaccggtagatgttactgtgaatccctgggcagggtattgtaaagggagtttggagctaggcagtgtgagctgtggatgctaaaggggtttctttagagcagcttaaggaggaggaagaagtaagtaactgtgtcctgaggacttgctaaaagtagactgcaaggactgagaaatagcccagagaaaaactaccatcaaaggccagagagacaggcgagagaaggtttcttaggaagagacaaggagacgctgatctcagaggtgaacaacatggataagaaattaactccattttgacctgaaaaaaataggggctgacaccagaaaggaaatgatttttgtagagcaatggttctcaagttttatttatttatttatttttagttttttttaaattttttattttttgagatggagtctcgctctgttgcccaggctggagtgcagtggcatgatcttggctcactgcaagctccgcttcccgggttcacgccattctcctgcctcagcctccggagtagctgggaatacaggtgcccgccaccaggccccgctaattattttgtatttttagttgagacggagtttcaccgtgttagccaggatggtctcgatctcctgacctcgtgatccgcccgcctcggcctcccaaagtgctgggattacaggcgtgagccaccgcgcccggccagttctcaagttttagtgtgtttaagaatcacctggatgagtgcgggaagagttaactaatttagcatccaggttccatctccatgcattctgatacggttggtctagaggttggcaggaatatgcatttttaacaaatcctcccaccctatgaagactctgatgtgaattgcctgcagattacactttgagaaacactagtggaataaatgcaacagtttggttttgtccagggaaggtatatctgtgagtgtgtgtgtgtgtgtgtgtgtgagagagagagagtgtgtgtgtgtgtgttgaaggtgaagccgctacttaaaggctcagaattgaaggacttataatgtaaaaggggaatgaaaacagagaaagcccagagggacaagttatttatttgttatagaaacaaacagcaaaaaccaggaagctgtacttacgatattccttaaaggaatatagtttgtggcacaaaatcctcttccacagttaaacaattttgtccagcacttgaaccaattaaaagtagctgtgactaggggaactatgagcacagagaaagatggtcatggggagagtctgggacccataaacattctatttcaggccatcgagcggtggttattaaacccgtggtagaatatgggagtgctacggacagaaaacactctggaccttactgtatgataacattatgttaaagaagaaaagaaagtatattttttgatgaaatgtagtattttatatacagaactcagcactcaaaatagtaataacaattagacttatgccacaacaacattatatcacaaaataaacatatgaaagtgaatgacatcgcagtagccacggttctgagattatctgcttcacctggctttggaagtttagtgattgtaatagctttcaaatagccttcaatgtctcgtgctcttcttacagtggagatgattcttttactttaatcacattccccatcgtcagggcctctgatctcttgagacatgatgtggtaaatcaaggataagttaacaacccatcttcacattggaggcgcaagtcacagggtctgtcggatgtgcaagggtctaacgcctgaaatcagacctctttctacaagcacgcgctgactattctattccccacctaacagggtttttcatggactgattggcttgtgctttggagcaatgtttcctaatcactagttttggtcacagattcgtttgacaatgtgatgagagccaaagactttctcacacagggccatgaacatttgctgcacagtcctaggggatataaggaccctctaaaacccattcatggactctcagggatctagaggcctcaagtgaggagctctgccctcagcagagggagcattgcagaggaagttctggttattactgacatcagattaagcccctaaagacagaaatgctgcttctccaattgatggctgaaatgagggcaagatggcggatacaggtgtagttttatagcatcagatccttaaaatgagtagcatgtggggctagagttgtttcccttcagataacatatgattaatgctctaaatccttagttctgaattctctcatgtgaagccagggttggttcccatttgggaaagcagtctctcaagatgccactttaatgtcttacttatcagctcgtgatgccttgggtggcacaagaaatgcaggcagggccgggcgaggtggctcacacttgtaatcccagcactttgggaggccgaggcaggcagatcatctgaggtcaggagttcgaaatcagcctggccaacatggcaaagccccagctctactaaaaatacaaaattagctgggcgtggtggcacatgagcctgtaatcctagctactctggaggctgaggcaggagaatcgcttgaatccaggagacagaggtttcagtgagccaagatcgtgtcactgcactgcagtctgggcaacaaagtgagactcagtttacaagaaaaagaaatgcaggcaggttgtaagcactgatctggccaactctagagtgtagtgagtagtgtggggtcagctgatgcccctaagcaacgtactggatacccagcccagctgcttttagggtgaaaggcattagcattagccggtgggtaaagtgctcccttctgggtgtaagatgtagttgtcttatctgaagctgaacatctggttgggctttgataactttgaagatagttcttttcctgtgtagccttttgatcacagaagccctgttggtcatcttccattagtgggtatctgacctgcaatttggggaactgagtgttttcagctgaaagctcagggctttgttcatttcctgtcctcccagactgtggtatcaggcagggtatggagacttaccccaaacccgtctgtttaaattagccaaccctactggaagtggtaagatgaggccacattctcatgtcacggtcatacagtggattgacactggatgagaaagagaaacgcacttcatcttcatccctccggagaaaaagaatgtgaaattgactaaatacatggtgagtcaaggttctcttggtgtgggatagcataaaaattggaaatctgtctttgagatagaaagggaaaatctataacaaatatgttccagtaatcagtgtgccttcatgtctataaccattttaattattgcacatccatgactacatttcttgtaagtttcaatatctattttaataataatattgcatcatacagtcacagccctcaaaacacaaatattccatgtacaccaaaggctggtagcaaagtctctactcctcttacctcctggagattattttcccctgccaggtcattatgtctagcaacctagttgcccatgcagagaatggactggcacaaatctcttccttggctcttttcctttctttcaggcaggacccctacttttaatttgtcttccctccaggtccagctgtcaccttcttgagagactctaaatatacaacccttactacgaacctttttctccctttcttgcatttttttttctcagttgccacaaaaaattcttctggtctttgttccagttttgagctgaaaatgatcccaactgtggttgagaagcataagaatgcctgtaattattccttctaacaaggaaaaggaaactcaatatatttagagtcaaatttaaatgatgtaaaatcaattacaaaaacctttaaggggcctaaaagtcccctttggcatactttttcttgataaaacctgattttcctcaagctctactctttgggcagtaacttgctgaaaattatatcaatagtagtctttctctgtcttcttcatgtgataaggaagtaggagagagggttggaggcacgtacaggaaataggaggggaaaagccagaaaaacccttacttattgacaataccacaatttcctatatgtgccaaaacaatattgtcactatattcctaaacacagaatatccggcaatatcagagaaatatctataataatttctactttaaaaatataatagtaatggatatttgttgtagcaaatatgtcatatgccttttaggttaaatatacttgtatacatcttatttgtaagtgtttatgtattaaaattgccatcaggctgggcgcggtggctcatgcctgtaatcccagcactttgggaggctgaagcgggcggatcacgaggtcaggagttcaagaccagcctggccaagatggtgaaaccccgtctcttctaaaactacaaaaattagccaggcatggtggcaggcacctttaatcccagctactcgggaggctgaggcagggaattgcttgaacctgggaggcagagtttgcagtgagcagagatcgtgccactgcactccggcccagacaacagactgagactccatctcaaaaaaaaaaaaaaagtcatcatcccagtgtttttcctccacgatgtgcaaaatctatagaaagaagcataaacattgcttcctaatgtgatagaaatacagctaataattgtaggatcatttgaattaacaaaaggcaactatgagtattttttctgagtcctatagctatctttccttttttttcatcctctacatttcaggaaaagcaattgaaatgtacattgtggcagtgtttctattacattctagagctatgaaaacacatggatggttttcaggatgcagcaggagggttctacgtaaaacgtcggtccagagttcaaaccccaaactaatagttttggatttccccaagtactacccacttaatatgtcaccaggaaagacccatcacacacatatatggaaggaaaaattaaagtttctcctccagcaggggctagatgcttgtggtttctgtttaaaaactagatggtggccgggcactgtggctcacgcctgtaatcccggcactttgggaggccaaggcgaacggattacctgaggtcaggagttcgagaccagcctggccaacatagtgaaacctggtctctactaaaaatacaaaaattagccaggcgtggttgctcacacctgtaatcccagctacatgggaggctgaggcacagaattgcttgaacccaggaggcggaggttgcagtgagctgagatcatgccactgcactccagcctgggcaacagagtgagacttggtctcaaaaaacaaataaataaataataatttaaaaaaactagatggtacaattgtgttaaaaaaaaaaatcaccagcgttttcagcctacgtttatatctacttttttttggacctgtgaccgatcaaccttaaaaagttatattatcttccagcttcctctgatttacttgtcctttctttggaggactaaaatgatcatactctttttatttccctacaatcaatcgagctatttggaatttaaatgttagtgctccttcctttataaatttggtcgtgattgattttatttctcaacaggtacgtagctcattattttatccattaattatagttactttttgtttcctttgccaattttgggagtgcttaacaactcttaagaactgtttcattaacgaattagtaaccaatgtaaaatgcagaataaataacaagttcagttgcctttatagtctttaaggtttgcttagaaacttttaaattataatcaagttttttcttttcctaccaaatattggccaaagtacaatttataaacaatatcatcagccagtcaggaaaacgagctaaatattccttcttctctccacttaatatgctctgttctcaattattattttgaatttttttaggaggctttcgaaaggccttttttcagaaaaattgtgagttttgggcagcaacatgaatgatcagctttaaattgttcatagtctttgaccatgtttaagaattattcctaagacaacaacgcaaggtgttttattataaaagcaagacttctcaacacaatggtgtctgctaataatagagaaaccaagaaacaacttaaaatgcccaacagaaatgtataaggtgataaaggtgacaaagtgagaccctgtctcaaaaaatatatacatataatatttgtatttataatataaaaaggcctatatatgtattcttatacatgaattcagaatatggaggtaaataaatatgttagaaattatctagtgtgtgataagattacatgatttaaaatgtttttcattttttcctgtcttttttataagtagcatatattgtttgtatataaaaaaggccaataatccttattaacagaatgtcagtttttggtgtgaggttaataaagaaattagttaaaatgattctgacatgagagttttttctgacattttgaaagaaacctaatgctttgaaagccctaagtctataattaaattgtatctaataaaatttagaggctctttagatttagagggattttgagtttctcaaagcatagaaaacgacttttagtgagagatgttggaattatcagttaagtttgtgagtggtttctgtttttaaaatatgagataattagcattagctagtatcaggctttaagcaaaatataaaatattcaagtgatgaatacagacgattatttctacattttaacctgtaaaaaggttcccaaagagatttttttttcttttttcttttagtgagacaggatgtcactctgttgcccaggctagagtgcagtggcatgatgatggctcactgcaccttccacctcctggggtcaggtgattctcccacctcagcctcccgaattgctgggactacaggaatgcaccaccatgccggctaagttttgtatttttttgtagagatggggtttcaccatgttgcccagactggtcttgaattcttcaagcatattcacccacctcggcctcccaaagtgctgggattacaggcctgagccatggcgcccagtcaagagatcctttaagaagcacattttccttatgcatcttaaatattcaattagaaaagaattgactttcaaatattttgaaagacatatcttctaggtaaatcataaatatattcattctgtgtaaagtaggaaaataaaggaaaattaccttgtatcttttcatggccatttctctacacagtaataccaaatatctaaaagtttgttaattcaaaatgccaaatattagttggaatatcatataactctttgaaaagttgattcgtttagtgaaaaagacttttcctcttaaacggagtgaaatctcgtgtctgatttgtgtaatattcctgattacattgtgtgcgtgtgtgtgtgtgtgtgtgtgtgtgtgtgtgtgtgtttctgtgtttctttccggcttggtttaacaataattcatgatcataagaggacagctattgcttgtaatgaacccagctgatcaatgaacaatgctttgtataacaattgtgtaattgaaagtgatacaatacctaccaacggggacttaaagcaaccaggattcatttctccacgtaacaggaattcggaggtctgcgtttcccgccctgggccaatggctcaatgagactgcctgccattttgttgtctttcgtcatggctgcacgatgattgctgcagcttctagccatgtactccattcaagacgcacgggaaggttggggtggaaaggaggatgagttggcagtggttgtctcattttccaggaaaccaagaattttcccggaggcctcccagatatcagcttccgtgtcattggtagaactaggttacacagccactccagctgccgtgaaggtgggaaacaggaaatagacttattattaacaattcccttagagcatacattcctaacaggcagggtgggtgggtgtggggaacatggtggagaatagggtgagggttgtggtggggcgtagatggggtggtgctgttgatatcatcccttaagggaaggatattgcttttgtgggagggaaaaggcaggaaaaatatcccactctatatgtataaagcacagttatacatacagcatatatgcagacatataatttgtctatggtattaaaatttcatgcatggggcaattaggaaaaaagcgtctaaaaatgctcttagggagatgatgttgaaaaaaagttgagaaatactgggctagaccaaacatgatccattgcctgaagcttacgtattatctattactgatgacaaagagaggcacaggtatggagtggcaaactaacaatgcgtgccgtagagaatgtcatacattaaattaatgaacagcttactttatgttgtaattgttgttggtcttctctcattgtactgtaaacatcttaaaagtgggaactgtgtcttatttcgatgtatatctttgtatattagcacactagtccctcaagaggtatgttttgtaagttgaatggaacaaacaacattttatttaacatatactttatttctattttttttaaattttatttatttatttattttgagacagcctctctctttgtcaccgaggccagagtgcagtggtgcaatctcagctcactgcaacctctgcctcctgggctcaagagattctcgtgcctcagcctcacaagtagctgggattacagacgtgtaccaccatgcctggctaatttttttgttgttgtatttttagcagagacgggctttcactatgttggccaggctggtcttgaactcccggcctcaagtgatccgcctgcctcggcctcccaaagtgtaatgttgattatttttaatggcaaaaatgaagtgatgcaggaagacatttaagcgtcataggtgatgtcttgggggtagtttcacaggatttttagcgagctgtttgattgctcttatgtggatggtacaaagaccaaaagaggttttgcaaacagtggagtcataaatgattgtgcatgagataattagttctgatagttccgttagtttgtttgtaagagatgaaaaggaaataaaatggaaaaagagagaagatttgttttgttttgttttactttttagctggattgttttttctgtgcctaagctgcttcagttgtaaaatgggaattataatgtcaaaatccttccttctcgaattgtgatggtcaaatgaaaagctgtctgagaaagctgccccgagctgtctaacagtattcctccagctggactatgcttctgagtcatccgatgctttaaaaatacatcttcccaggaaaacattgtaaacaactcccagggtacataatgatttagatgattaaatttggaggctgccctgacttcactaccctgggcctcaactgctttataaattatgaatacagatacttcctaggactgtagggtggatagcaaatgaagcgaattaactgccaaatccttccttaacatcttcgttatgatcaatattatgaacctaggcaatcttcatccatacattggacacttgaccttgggatggattagacttcctcagtttcctttgtcctctgtgcaaaatctagaatattgccagcctatcgtcagagtgcaacacgtttgaggaattattgcatgattgatattgttgagagttcagattaatgtcacttcagataatccacagatgacatggaaaactggtgggctaccggtgctatttgaagtcaacgagggcttgcacttagctgggaatgggcgagagaataggattaatgcccaggaagatatatcttctgatcctcacctctcttttgtatataggtgattttttaaaaaacttccttctcctccaatcaaaactggctttgaggaaagaatgggactggatgcacatttgtgtaaacatgctaatggtaaaaaaaagtctttacctttcagggatatttgcatttcaacaaagtaccaaacctcaagagaaagggctgctccaaggatggaagatatatttggtagggagaggactttttatcacccttgattcactccatgtaagcagggaccttctggtaagatgctccctgatggggacttgttggatgctggccgtgccagctggctgaaacccccagggtcagacttccttgcaggggatccttatcatgtggatggcagccactgctgatagattggggaactgcttcctttgccgtctccctatagggaaggttcccctaaactgagtccctaataatctcagagcgagacgtgtgctgtggggatcttatcatcttatcagatttttctaaactatagtccttcttagaagtgagaggcccagaacactctactttatgcaggaatagcagagatgactcatggttgggaagacactagaattcagccaggagaatatcattaaaagagggagaagggaaaacagactttttgtgtggtacaaaaacaaaaccctctgtatcattatgtgaacaacggtgcaaaaaagaggagacacagtttacccatgggtagctaactatgatagtgaaagttgccttgaaccttgttttagaaaaatggcaagtgtgggtctcactcttctagttcctgacttctctctctctctctctcgtttctcttttttttttttctctctctctctctctcacacacacacccatcttgggccaggtttgtaaagcctcatgggaaatggaacacggaagagtcttctgggaggttttaaaatttaattttagtcagatttagtaagatttcttcatacaaaacaaaacaaaaattctctaaaaaaaatccttgttagggtctggttaagacaactaataacaacagatgtgagggcatagttcctagttaccaaagaatcgctctggtgagagaggagtggaggcaaaaattccagatggtacctgggtagcgattgcactcagatgggtcatctgaggacagctgccctagaccgctgctcctgagcctctccattgtaattttccttcttctagttcctttttaaaaatttttcttttttgttgagatagagtcttgctctgtctcccaggctggagtgcagtggcatgatccccagtcactgcaacttccgcctcccaggtttaagtgattctcctgctcagcctcctgagtagctgggattacaggtgtgtgccaccacgcccggctaatttttgtatttttagtggagacagggtttcaccatgttggccagactgctctcaaactcctgtgctcaagtgatctgcccgcctcagcttcccaaagtgttgggattacaggtgtgagccactgtgcctggcctagttcctttgttttaaaagcttaaatgcatgaagcatacagtactgtgaagacttgcttgatgtgatgcaggttccttaatctcctcctttgctatttggttcgcagatggtggtacgggtggcactttggggaaggcggggcggaaggaagctttctgatgaatgtttgcacagtatacgagaaggttacaagatatgggcatcatgcacaggtggcgaggtggttagagaaaggtagatggtgtttggggattaccctctggtacatttcaattcactttggggttatgagatttcagaaggttagctaatgcttacgtcctggggtgggctcttttgtatttctttgttgtctcttttttattttttagagacagagttttactatattgcccagactggtctcagactcctggcctcaagcgatcctcccacctcagcctctgagttacaattgtctcttgaaagtaatttcaggtaggcttggggctaccaaggcaagcctagggaagcctactacatgaagaggattagagtcctctggagaagttggattcatatgaagagatactaatcagaaagttgggagttagtcatccatggaaaacaggcatgtttgagaatcatattctggcagtgcccatccatgcattatcagtggagagagaaccttggctaatggacttccccagttttgatcccatggataagaccatgggggagagggtaaggcttaggctaatgcatattcttggatcattcagtcacctccttccactctgagtccctgttgaccagggaatgtcttggtgtcatagcttggctttccaatggctctccccgtggggaaagaatacacaggctgtgttgatggtattctagtcctgacgagagctgcgtttctcatggtcagcaaatgaattggcatccgatatataagcaaatcttgtgactgtaaagtcatatactttcttgttagttgagggaatcagatttctgagggtaagaggtgaagccaagaacatggcaaattcattatcttgataaaaactacccggtaaggctgcccattttctttcaaactgcaacaccatatgtccagcgaggttcctcttacgagacatcaggggtatcaggagtgggtgccaagctggagtcctgagaatgagggaaataggagaccatgagttttgagcaccaccgcaatttctcttctccttttgtccctcttgctttaggtagtaatgcatgccttaagataataaaaggtctgtctttgtgggctcttcattgccatagaaaaatgattggtatgagtttcccaaggcctcggataaaaatatttcttcagagagggttttgaaaacttatgccagttacctgggtggactccaatctttcaagcactgtgtgtcttttcctggtcctccctcgctccctccttcctttccttccttctctaaacagagtctaaggtaatgcccctctccagtttcttgggatagggaagggggtggaattacttctgactcacccttacccttatggtgtaccctttggggttctggctaaaatatatgtattgggaagtgggacgcagtggctcacgcctgtaatcccagcactttgggaggccaaggcgggtggatcacttgaggtcaagagttcaagaccagcctggccaacacccatctctactaaaaatgcaaaaattagcctggtgtggtggtgcatgcctgtaatcccagctactcaggagactgaggcatgagaatcgcttgaacctgggaggtggagagggtggtgagccaaaatcacgccactgcagtccagcctgggtgacagagcgagactctgtatcaaaaaacaaacaaataagtaaaatatatatattggggtccattagtttttccaccctgggtggactctgacctttgacttctgtcatccttgccccatgaagccatcggaactgcagctcgttttccgctttttcatcgccatttctttcagctgacaaatgctgtctacctcactggcttctcctttattcttaggttttggcctgacagttgctatttttttttttttttttagctctttgatacttttaagaaaatggtttttaggccatgcacaggggctcatgcttgtaatcccagaactttgggagaccgaggtgggtgaattgcttgagctcaggagtttgagaccagcctggccaacatggtgaaaccccgtctcgattaaaaatacaaaaactagccgggcgtggtggcaggtgcctgtaatcccagctactccagaggctgaggcaggagaattgcttcaacccgggaggcagaggtggcagtaagccgagatcgcaccactgcactccagcctgggcgacacagtgagactccatctcaataaaaaaaaagaaacaaaaaataaaaacataaggacttttgacaaaaatatgattctttaggcaagaggtttatttctctaagtgtcagtttctctgaaaactttgaggattggattggatataaatttccccaagcacaatgtgtgtaccaatggtgggaaacaagatctttttagggcaagcatttaaaaaatgtttttagtaggtatatgtttctttgaatgttttcagaaaaaaattataagtgacaatcaaatctatgatttcatctatttaattgcttaggacaaggccatatgagttcacttagagttgatttttaaaacataccacataaatgatagttcaaatatggttatcagatgactgaaatttgggggcaggattagaagatgatctttcagattttgactaacttgactattctggtctcaatgacgaaaggaaacaagttcccataagtcattacagtggaatccaatgatattatccaagaaaccaatattcctaggatcttagttctcctagaaatctttctagcatgctgagcaggatgggttggacacagtccaaatcactggaatattacaaatttaaaaaattgttttgagtggtgtgtgaaagagacctgctctgaggacttctagaatgagtgagaagggaacttacagacctactgagacttgctcctctgtcagatgtggcaggagggtcggggtcttggagttgttcaagtaatttcatcagttaggggttaatcctgacccaggatccagtcctgctgggccatactttcttaaagtgactatccagtgacactagcaaatgttacctcttcccgggaagaaatgacaggatgtgtttgtattttcttttacaaaggatcatgcgattttatttttactttttttttgttatagaagtggtatatgtctgtgaaggaaactcagaaaacatagataagcacacacaaaaaatttgtaattgcaccagtatgagcattgttaaaatcttagtatagtttcttacttttttcctctctctatttttactaaaaaatcaggattacgttgcacataccgatttgaacttgcctttctttgatccatataacaatgttgtcacatacttttccccacattattaaatattgttctacaatagtaaggaattcaatgataaaagaggcatattgtcttcctcccaccttatacaagttattttgtgtggcagcttgacttgtattttagaagtagagacaaattaaggcaaaaataaatagaaatggcaaattaattccacaaggagtgtgttttctgaaagtccctgctgctagaaacggaattaggattatgcctcctggtttcaaacatgtcgataatagctgtgtgtgctactcgagtggcgtcaaagatggatgtccaactccatattggagctgtgggtaacctagtgacagccacaaatcacccttctaagagcagatggtcagggagcacctttccagtttagagcatataccagttgctctcctgatggacatctggtccatgatatttgactgttttaaggtatggagtgctttgtacaaggtacaaaacttctgtccttggtatgaacatttgggaggcaagtgagtgataatgacccacggctgcctttttgtccggcaaagcacgaggatgctttggagaacggaaggatttcatcgagtccaaaggacactcacctctaggcctctcagcctccttggccacgtggttgttctgctactgagagtctgcagatgagctggtggtttctctaagcttccgagagctctctcgggtatttattatatgcacgttctgtctacaatgaccagtggactctaaactgggctggaacatgttcccaggaaaacatgcccaaattctgttctaccttgtgtaaatctaagacaggggctactgaacacagtcttggaaatcagacacgtgctagggccccctgtgcttagctcggctaatgagcccaggctgagggcttttttgcaggcatgccaaaaaatgcagggccaaggctgggggtggagaggtaaggctagggaagtcaaggaaggcatgaggaacagcttgggaggggaaaaagttcatctggtggcaggagctttaggctctctctgctccttcacccttttctctgttcaaatctgctctcaaggcagcatgtgatattgatggttcacagaaacatgaactaccagccttggaggggccctgagagcccatctagttcaatgcctcattttgcggatgaaaaaacaggtttggagtggctaaatggcgtaagcaaggtcgtgtcactaggagtagagctgggattcaagcctgatggttagtccagggctctgatcaccacaagctgcctctatatacagtatagtgagaaagtctcaaccaccacattgactcttcatttatatttaatattatatttgtattttaagattgatccataatggaaggaattgtttagtcctgtactaaaggaatttagaaagagttgggtgactcaatctactgataaggaaaaagatttacaatctattactaagtgagaaaggcatcatggagtacagtatagtatgctgtagtttgtatataaaaatgtgtgtgtggctgggcgcggtggctcacgcctgtaatcctagcactttgggaggccaaggtgggtggatcacctgaagtcaggagtttgagaccatcctggccaacatggtgaaactccatctctactaaaaatacaaaaattagctgggcatggtggcacatgcctgaagtcccagctacatgggaggctgaggcaggcgaatcacttgaacccaggaggcggaggttgcagtgagccgagatcgcaccactgcactccagcttggggacagagtgagactccatctcaaaaaaaaaaaaaaaaaaagtgtgtgtgataattatacacatacattcatatatatatgcatgtggattcatgtaataatgtaatagctttggaaaaatgcatgagaaacttagtctgatggttgcgtctgggaaaatggcctgggcaccataggagggaggtatatttttcacttttatacttttaaaatgttactataggcatgtaatcactattcaaaaaatgtaaaaacatttaaagatgccatgtgagctcaaataagggagaaatatattgcttattgggaaggcctcatacaagaggtagcatctgagctgggctctgggatgggtagaagttcaccaggaagagccagggcaggaaagcttgcagcagcaggactgaagctgtcaaagcaggaaagaccagggagagtgtcagcaatgttgcatagtctggagaaattgcagcaaagtagtatgctgttgtttgaatataaaaatgtgtgtgtaattattatatgcattcgtacttacagcatgtgaatttatgtaataatgtaatagcttcagaaaaatgcatgagaaactgcattggctaggtaaagcagagacagggccgaggagaaaagtaaagagagagaactcggctggatggaggttattttatacttaatatggcataaagggctttttacaaattggccccattgtccctttccaacatcatcttccacctgtgcttcagccaccatagccagctgtctattctccaaatacccacgtgcacacctgggcaccagccgcttcctctgcctgcatgcggtccaccagtcctatttctttctctcctccaagaccaagttcaaatgttcctcctctccccctccccaccccaccaccctggaagattttaacactctgtccttagtgttctcttggcattttgcatttacctttattatagaacttggctgtttaaattttaattttttgcaggacgaaccggagagtgaggtcatttatacgcagaacattgcgtctcctctctttaatttagcattttattctctgaggtcctagctatatggtactttatggtgatgaagtacagccacaccattctgcctttgtgtggccattgcatgacctctccaaatgaaatcatttcttctatagagaaaaaaaagtgaggatcagagacattattaactaagtaaaaaaaaaaatttttttaacctctgggcctagtctaaactacattaacattttctttattatcttctgccccattaggctccttaaaagtaggcctagtttaaagacaattaaaggcagatattctgtccctttttttagacttctatggatttgaaatgtcatgttaatagaacactatatatgcgtaagcaatgaactgaaccattaaaaaagaattttgctctggaatatcctggtagtttcagggtcattatatatttgttttgctcagtttcttgatctttctgatccttaatcagaagctgagcatctaaggaaatattttatcctattgctatgtatctataatattatctgtataaaaagtacatatgtctatatttcaaaagaagattgaaaaaattaagaaaatctgaataaacttgtgttcttagattattcctctttgttcctcttctcccttaggcaattgagggagtaactgctatgttcctagtacaatttattctatagagggacatgtgaaaggtgagctgagaattcccagtaaatctcgatttacccatcattgcagagacctttcctctgcctgggccaatgtccttctcggcaagggaagatagatcgcaccagacaaagtttggacatttatctttctacataaatggaaaacccttcccagattgttcaactggttgctttttttcagttactaatacaggaatacctcatttgattgcgctccacagatattgcattttatacaaactgaaggtttgtggcaactctgtgttgagcgagtctatcggcaccattttcccaacagcgtatgctcacttcatggctctgtcacattttggtaattctcaaaataattcaaacgttttcattattattgtatctgttatggtcatctgtgatcagtgatctttgatgttactgttgcaattgttttggggcacgatgaatcatgcccatataagatagcaaacttaatggataaatgttgtacgtgttctgactgctccggctgttcccccacctctcttcctccctttgggcctccctattctctgagacacaatgatattgaaattaggccagttaataaacctataatggcctctcagtgtttaagtgaaaggaagagtcatgtgtctctcactttaaatcaaaagctagaaatcattaagtttaatgaggaaggcatgttgaaagctgagagaggccgaaaactaggtctcttgccagttagccaggttgtcaatgcaaaggaaaatttattgaagaaatgaaaagttcaactcctgggaacacatgaatgataaggaagtgaaacagccttactgcttggacaaagctttagtggtctgggtagaagatcaaaccagctatacaatttctttaagccaaagactaatccagaacaagggcctaacttgcttcaattctatgaaggttgaatgaagtgaggaagctgcagaagaaaagtatgaagatagcagaagttggttcactaggtttaaggaaagaagccatcttcataacaccaaagtataaagagaggcagcaggtcctgatgaataaactacagcaagttatccagaagatctagctaaggtcattgatgaaggtggctacagtgtacaatagaattttcaatggaaacaaaatggccttctattggaagaagatgccatctaggactttcacagctagtaagaggtcaatacttggcttcaaagcttcaaagaacaggctgactgtctagttaggggctaatgcagctggttgctttaaggtaaagccagtgctcatttaccattccaacagatcctagggccttaagaattatgctaaatctactttgcctgtgctctataaatggaacaactaaagcctgaatgacaacacatctatttacagcaatgtctactgaataatttaagcccactgttgagacctactgctcaggaaaaagattcctttcaaaatattacagctcatggacaacgcacctagtcacccaagagctctgatggagatgtacaaggagattaatgctgttttcatgcctgttaacacaatatctattctgcaacccatggatcaaggagtcatttcaactttcaaatcttattatttaagaatacattttgtaaggctataggtgctatagatagtgattcctttgatgaatctaggcaaagtaaatttaaaatcttctgaaaggatctaccattttagatgccattcagaacatttgtgattcatggcagaaggtcaaaatagcaacattaactggagtttggaagaagttgattccaagcctcatgactgacttgagggatttaagatgctagtggaggaagtaactgcagatgtggtagaaggagcaagagagctagaattagaagaggaggctgaaggtgggactgaatgtctgtaatctcatgttaaaatttaatgtatgaggaattgcttcttacagatgagccaagaaagtaatttcttgagacagaatctacttctggtgaatatactgtgaaaactgttgaaatggcaacaaaagatttagaatattacataaacttacttgataaagcagtggcagggtttgagaggattagctctaatttgcaagaagttctgctgtggataaaatgcatttcatgctacagagaaatctttcatgaaaggaagaatcaatcagtgtggcaaacttcattgttgtcttattttaagaaatagccacagccactccaacctgcagcaaccactaccctgatcaattggcagccatcaacattgaggcaaaaagattaggacttgctgaaggctcagatgattgttagctttttttttttttttttttttttagagagggtcttgctctgttgcccaggctggagtgcagtggtgcaatcatagctcactgtagcctcccggagtcaagtgatcctcccacctcagcctcctgagtagctgggattacaagtgtgcattaccatacctggctaattaaaaaaaaatttttatctagacagagtcccattgtgttgtccaggctgtattgttagcatttttaagcaataaaatatttttaaattaagccatgtatacttttagacatcatgtatagtgtaaacataacttgtttttttttttttttttttttgagatggagtttcgctcttgttgcccaggctggagtgcaatggcacgatcttggctcactgcaacttctgcctcctgggttcaagcaattctcctgcctcagcctcccaagtagctgggattacaggcatgtgccaccatgcctggctaagtttgtatttttagtagagacagggtttctccatgttggtcaggctggtcttgaactctcgacctcaggtgatctgcctgcctcggcctcccaaagtgctgggattacaggctcgagccactgctcctggccaacataacttttatgtgcactaggaaacaaaaaaaactgtgtgactcactttattgcaagattcactttattgcagtggtctggaactgaacccgcgatatctgtaaggtatgtctgtatatcatacccttcctgggcaatacgaacaggctgacctaattccttctaatgctgagtggattctatcgaatggatatggcataattaatttaacccctgcgtcttaatggacctttcagatctttccagttctttttttgctgtcgtgaataatgtagcaatggaaattcttgcatatcttgactacttgtgtagacacatcagtacaacgtgttgaaagaattggaattgctggattaaaaggtctccgcatttaaaagtttaatagatactggcaaggacttaaaggatggagtggtgcaaggggtcccccctaagtacaggaagtaagggggtatatcatttatatagaattttaaaacagtaataaaaccagtgtgggtctgttttttattatcaccatgcgctggcagtgaaaaagtcagagtaagttcttaatggtgtgtacagctttcactagagctttggggccaagttgcatcttcagcttctatggcacagcatagtcctgagtttaagctgcagattagacataaacaatgatagcacagtgattgtagaaaccccggaacagaactcgagttacctcaattccgttattctctcagagttttgtatttaaatttgaaacaacaaaggagaatgcaaactacaaagtataattaatgctgattggtaagtgcaagttttaattcatacatgaaatatcttactgaattattgttattattttttagagacagggtctcactttgtcatccaggctggagtgcagtgttgtgatcatggctcactgcagccttgatctcctgggctcaagccattccctgtctcagcctcctgagtagctaaggctacaggtacatgctaccatgcccaactaattaaaagaactttttggtagagatgtttgttcatttttgttttttgtttgtttgttttcagacagtctcactttgtcacctaggctggagtgcactggcgaaatcggctcactgcaacctccacctcccaggttcaagtgattctcatatctcagcctcccaagtagctggacttacaggcatgcaccaccacacccggctaatcttgctgtgtttcccaggctggtctcaaactcctggccttgagcaatcctcctgcctcggccttccaaagttctgggattatagatgtcggccagtacacctgacctgaatgatttttttaaagttcaattaaaaaaaaaagtaacttgtttcttttaaagctaaagaaggaataaaaaataaacagtctgttcctgattcttacgcattgctaggaaaataattttgtcacctagaggagagaggttgatagatgatcagttgtgggtgtcaaatacacgaaggacgccgctggattctgttcaagtgcgctctgcaaagatggtggtcttctgctcatcaaatggtgtgtgagagtgtctgactgaggaagaatctttaaaatgctgtaagaaatcaggcttgtagtaagaaggaaatcacccaccagcagaaaaatgtatttccggcctttcttcctcaccctctgccactgttttaggattgctcagtttcatcaaggtttgaaggataggcaggctctcactaagagagaggtagggagaggggaggtagagacctatgaatgggctcagaggctggactgccagagtctgaaccccagcatctcttctcattagcttgtcatcttggacaaggtactttacttctctgtgccctagttcccccagctgtaaaaatgagacaaaaatgatattgaccacatgcagtcttgttgtaatgattaaaggaggtaatttttataaagcacttcaaacagcgtctggcaaacgtgtttattgttatccttatctgctaagggccaggcattcatctaggcatgggagatagattcttttcagttgccttaaaaaaaaaatcctgcaaacgatgcatgattaattcacattttgcagttgtagttatgtgacttgcccaaggttatactgctgctcagcaagggagatgaaaatctaaccgtgactgtctgggtgcggtggctcatgcctgtagtcccagcactttgggaggctgaggcgggcggatcacctgaggtcgggagttcaagactagcctgaccaacatggagaaaccccatctctactaaaaatacaaaattagctgggtgtggtggcgcatgcctgttattccagctacttgggaggctgaggcaggagaatcgcatgaacccaggaggtggagtttgtggtgagccgagatcacgccattgcactccagcctgggtaacaagagtgaaactccatctcaaaaaaaaaaaaaaaaaaagaaaaagaaaaaaatatctaaccgtgactgtcaactccacaacatgggccctttgcaaacaattgcatatcggcagccttacacactgaaactaaaactaaatcacctcactccttccagtgctctgggctgcatatccagaacaaattattaaatgccttgacttcttttatagcttaagcaatctgcaagttaaggggttatcctacttctagagaatgctggaaagcttaatgatttctcctaaaaagagatgatccatctcgaaggaagtggatgagaaagggaacaggtgtttaaaaagtatttttatattaaaactgggagctgtggctgggtgtggtggctcacgcctgtaatctcagcactttgggaggccaaggcaggtggatcacttgaggtcaggagttcgagaccagcctggccaacatggcgaaatcccgtttctactaaaaatacaaaaattatccgggtgtggtggtgcatgcctgtaattccagctactcgggaggctgagacacgagaatcacttgaacctgagaggtggaggttgcagtgagccgatctcgccactgcactccagcctgggtgacagtgagactctgaaaacaagcaaacaaaaaacaaaaacaaaaacaaacaaaaaacattgacagctaccttttgagtaaaaagccatcagtacacaataaaatctttctgtgggaaaaaggcaaagaaataaaggttgctactgtgtgaataatttggcatgtctatctagctatatgagcattgtgcttaaaatattaaggaaattaagtatgggctatacaatgtaggcataatgtgtatctgaaaaaatcctgtgtagatggaaagtgtgctgactcagctggttcagtttctgggcctcgtgtgggcccccagcagcttaaccacttctctcaagtccttggtttcctcatgggagaaatgagtatgttgaattagatgacctttcaggcatctcatcatgctgagttttttttccgcagcagggaacatgctactttacattctgtttagggtttgctcagtgaagggggagtaccaggaatctggggaattcccagaatacctgggcactatatatatatatatatttgcaacacatttaatcataaaagattaatatccttaatctctaaaaggattttaaaagtcattaagaaacaatgaccgtcttgctggaaaagtaggtaaaactgatgacttacaaaagaaaaaatatatgttgtcaagaaacagatgagcaaattttaatcttcaccagttgtaaatgaaatgcaaatgaaaacaagtcaaacttgcaaatattatacccagtgagagttgatagagagatgcagtgataggcccatacatggaatataaattggttcaattttttatctcttctgttccagcagttgctctcatatctatttatcctaaagaaataatcatatatttatattaaaaatattcactcaatgttgctatagtgaaaataaggaattattaaactatccaacagtaggcaattggttaaataaatgatgctatatttacataatgaaattttatgcagccattttctatgtcaagaatcttgacatagaatgttaaattaagacctaaatgttaaattaagaaaaacaagatgccaaactgcatataaagtatggtattcttagttttggaaaaaaatgatgcactgaataaaaaaccccagaaaaatgtatgctaatattttacagcttttggttctaggtggtaactgatttttatcttctttggatcagtgttttcgaaatgttctataatgtgtatgtactacttttataatcagaaaataggatatatagaaatggtctggaaaaaatgaggagagaagttacaatagggaggtcatcttcaatctgtttggaccagcaagtaaaagcaggaaatgctgtccaccaccaatggcttaaatatgtgtgttggatggtggtggtggttggtggttctggggttggggatggggggaaccttgagatgtgatggttttcttagtcagagatggtgctttacagctgggaagtatcttgaacttggtggaggtctatccagacatcaggcagatttcatattttcacagacaaaggctacgtttacgtctaaggggaaaacacaaaatactaagatagaaacctccaaagccccctcaccttttcagacaacaagaacccccagggcagagggtcttcctcactctcagagttactttgacttctcatctggtttcgtgtgggtaatgcattttcactcttgagtttcttttctttttaaggtattttcattatgacgtttgttcttttgcaaagagctaattctgcagaattctacccagggagggccgagggaagttagtgaaggtaacgataccagttagaaagttgagtttgggtcatctcaggggcctcctttggcctcctttggcttatgttctagagatggcccttacttcccaggaatagatagtgatgtcttactgagttgcaggtagagtctgtattgaagcgcaagattttcttccctgacttgtctgggaatccttacccaggactgtggctttcctcttccatatccctccaccaggaggcaggctctaagcctctgtgctgtcatccttttgccacttccatgaacatgccttcaaatacttgaaaaagtcactatagcgtaaagtatacttttctcttttggtgatgcttttctgcattttctctataaccagagagtaagaataaaactacagcttgggacctggcgcggtggctcacacctgtaatcccaacactttggaaggctgaggagggtggatcacctgaggtcgggagtttgagaccagcctgaccaacatggagaaaccccgtctctactaaaagtacaaaattagctggcatggtggcacatgcctgtagtctgagctactcgggaggctgaggcaggagaatcgcttgaaccttgggggtggaggttgcagtgagttgagatcttgccattgcactccagcctgggcaacaagagtgaaacgccatctcaaaaaaaaaaaaaaaaagaaagaaagaaaacaaaagcccccacgctttaaaacttttaacacgaaaagttttgaagctacaccaaagaggagagaataggctaatatacccctgtatacccaccactcaacctcaatagttcttaacacttttccaatcttactttatccattgtttttgcttgttttctggaataatataaaataaatccctgacatcttattgattttcctcatcaatacatcaacatctctatcagataagggccttaaaatacaattgacaaattgattgataaataaggacctgacaatacagttatcacctaacaaaattagcaatagttcttaaatgtcatctaatacccaggccatattcatatttatttgaatatctaaaagaatataaaaaggacttcttttttttttgagacggagtctcactctgccatccaggctggagtgcagtggcacgatcccccctcactgcgacctctgcctcctaagttcaagcgattctcctgccacagcctcctgagtagctgggattattaaccaccatgacgggctaatttttgtatttttagtagaaacggggtttcgccatgttggccaggctggtctagaattcctgacctcaagtgatccacctgccttggcctcccagagtgctgtgaatacaggtgtgagtcatggcacccggcctggacttttttgagtccaggcctccctctgttgtccaggatggagtgcagtagtgtgatctcagctcactgcagcctctgcctcccaggttcaagcgattttcctgacccagcctcccgaatagctgggactacaggcacaggccaccaggcccagctaattttttttgtctgtgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctcagcctggacttttaaaactcttatgagtaagaagaaagaagaggtggcttggggctgaggatagctatgaacagctgtgattcaggaggcagaattattcagctttgctcatctcctttgcaaggaggagagaatgaaacagacctttaaaagggaatcagaagttggagttagtgcttctaggaattgtaaacgaattcagcagtgtagacctagaaaaattttcagagtcactgatagggattcacagaaattttctgtagcttcaagggaccagcccagcctttttgttcccttctgagaccacattaaaaagacaaaacaacatacaggaagcacttcttcaaaactgcgcaaatagcacatgcgtatcgtggacacatttttaaatgcacttaagcaaggagaagaaaatgggaatcacatacaaccccaggacccagagacaagccagtgggcaccactctagacattttcacagctctggaatctcctgtacaggccattttgaaacctgccattttgaaacctgctttccacccatttagcttaggaagccttttcctgtgtctgtgaatagacccgtacgatgttatgttaatggatttcaatataggagcaaattggtttgtgcaagacccacctattcttaggtgattttttttttttttttttttgctatacataacatagaagagaacatgtttctagctaaagatttcatgtcaaagctcatgggagaggaagatgaccctggctaccccacttctcttccccttcattcagtaaacgatagccttgtcatatgacggcagcctgtggctctcctgaaagcgctctgtctcttcagcaggccccccagtgggaaacacccacctcttcatggatctcacagatctgtctctctcctctggtgctgcctatgtttgccagcagcttctcccaggcccccaggcctacagcctcagaatcaccttgtttcaggcctgcgtgtcagttccgcctcgtggatgttgctggggcttctctccctctttcttgtctcacagcatctgctctggataaagtcatccttgatcccaacggcaggagcctcccacttgcctctttggtctttcccacctgcaatccagcctaacctgccacaagaatgagcttcctacagcccagcttgatctcccattctgggctccgccttttagcccaactgagctgcctctcacccttctaggtgccctaggtttttccttcattgctcatgtttctctttcttctctgtgcatctcaagctcagtggttttaagggtcatgttctaataccatggcctccacaaagccttccttgattcctgctagttgcaggtagcacctttttccctttgttggcactttatttgttcctccctcagatccttgctgaagtttatgtctggtgttgccattagactgtaagtttttttgaaggcagaagctgtgttttctttaacttggcttcaatgcctgacacagagtaggtgctcaaagaggttagtaacatttaagttaaaagagaatggattggtaacagtttttttattttttgagacagggtcttgctttgttgcccaggctggagtgcagtggtgtgataatggcttactgcagcttcagcttcctgggctcaagtaatcctcctgcctcagcctcccaactagctgggactataggcatgctccaccatgcctggctaatttttttttttttagtatagacttggtggtgaggcaccggaggcggggggcaggggtctcatcatgttgcccaggctggtcttgaactcctgggttcaggtgatcctcctgccttggcttcccaaagtgctgggattataggcaggagccactgtgcctggctagtaacattttatgtgccaaagacccagggattttaattgactgttaactgattttaactggagtcagctggagctaatagtgtgctgtggctgctgatgagcagaaggcaaccttggattgtataaaatcacaggctcatctcccataatccctccaccggccacttcctgctccccactgagcagcccacagtgcaacctccctgaacttcttctacttccccaaatcaaacatgtattttcatgcccctgggcctttgcacatgcttctccccacccccaaagcctttcttctctgttgcttatcaaaatcttactcatcctacagatcagctgtcaccttttaaatgcggggctcccaaatcaccactcctttctcccgtctcgagaattaatgctccctctcctgtgtgtctgtagtactggttcatatcatcatcatcatagcagctactatttgctagtacctgttttgttccaggcactgttttaggctcatgacatacactagctcagaaccatcttacgacaacccctcaaggtaaattataataatggtaaatacttctacggtactcactctgtgccaggcactattcaatgtggtttacatgcactacccatttaattctgtacaaccaccttgtaaggtaggtatcattattttattttaatttttattattaaaaataataccatcaaccaactcacaccaggtaggcaccattattattgcctatttacaattagggaagaggggcttagagaagttaagtgacctttatgagatcacatagccagtggggctgaaaggcagtatggttccagagtccgtgctgtagacactatgcatagttgactttgttgtcaaaggaaccgaaggtcagagacgttaagtaattgccccaaggtcacacatttaagtggcagacattggagccaaacccaagcctgcctgaccccaggtctacatgccccttcttactctgaactacctttctgtctagtaggagttggcaaacttttttgtgtaaagaccaaattgaaaatattttaggcttggttgcaactttatgttgcagcgagaaagcagtcataggcaacatgtcaatgaatgggcatgactgtgttccaataaaatgctatttgtgaaacctgaaacttgaatttcatataattttcacatgtcataaaatattttcctcctttggatttttttcaaccattaaaaaatgtaaaaaccacctgtaatcccagctacttgggaggctgaggcaggagaatcgcttgaacttgggaggcagaggttgcagtgagccgggatcatgccactgcagtccagcctgggcgacagagtaatactccctctcaaataaaataaaataaaataaaataaaataaaataaaataaaatgaaataaaatgtaaaaaccattctcaatttatggccctacaaaaccaggtggcgggctggattcagccatgcgtgggccatagtttgacaaccttactttatagcatcgtgacattatagaatgattagataggcatgatttgcctttttgctctctttttcctagaacagttcagctcaggccccaaacatggatacccaactgagaaaacacgagtctttggtaaacaagatccacattccctaaaagaagttcagagaccacgtgtccttccctgagcacacctcttggggttgcaccctcaactccaagcagtttttcaggctattccaactattttgagaaaagaagtaggaaatgcatttccccatcactttagttttgagatgagtttctaagggtgctctgggtggttgcctagctggctagtcttgtatttgactctgaaattgaaccggactaagaactctagacctcaggcaacgattccttgattgtgctcctgggagtggaagagaccagtcagggcagagttgctggaccagaggaggggaaggggaccacggtcccggtgtgattggggaccagagggcaggacacacggctcagagaggcttcagagcttaatatgttgaaataataaaaggcttcaggacttggcaatgttttgttttaattcaactataaaggggtttaatatgcttcaggcttaggaacataaatactgcttaacattttttattctggtgaacttatgttaaaagttgcaaatcagcatcttttttttttttttttttttttttttgtagaaacagggtcttgctatgttgcccaggctggcattgaactcctggcctcaagtggtccttccacatcagcctcccaaagcactgggattacaaatgtgagccactgtgcctggccaagcaaaccagcatcttgcaaacaaactttcagaacaaaatctgtttcaaacagagatgatctatgtatgaaagtacactgacttaaaaatgatttctttctgtggttttgagagaaaatctagtgattatttgtagcaattagcaacacagtagggggaattattaagataggattcagattggtgaaataaattcttgcaagtaaaacttaagataaaatgccacttgagaagatgttcaccacaaaggtggtaaccttatttttaaaaatgctttttattgaagttttatctacatacaggaaagtgaacaccacgtgggtatacagcttggtggattttcacaaactgcacacacttgtggaaccagcatccagatcaggaagcaacagatgtcctttaaaacatcaagaactgggccggacatggtggctcacgcctgtaatcccagcactttgggaggccaaggtgggtggatcacctgaggtcaggagtttgagaccagcctggccaacatggtgaaaccccgtctctactaaaattacaaaattagctgggcttggtggcatgcaccttgtaatcccagctactcgggaggctgaggcaggagaatcacttgaacccaggaggtggagattgcagtgagctgagattgcgccattgcattccagcctgggcaaaaagagcgaaacttcatctcaaaaaaaaaaaaaaaaaaagaaaaaagaaaaaaaaaaagcaagaactggtttattttcaggaagagaataggagtagagacctggtctgaagagctgggtacaacctagggcagtagctcatgcctgtaatcccagcactttgggaggctgaggcaagaggattgcttgaacccaggagttggagaccagcttgggcaacatagtgagacctttgtttatacaaaaataaaaaataaaaataattagctggtcatagtagcacgcaactgtagtcccagctcttcaggaatgtgaggcaggaggattgtttgaacccgggaggtccaggctgcagtgagctgtgattgtgccactgcactccagcctggcacacagagtaagagcctgtcttaaagaaaaaaaaaaaaagaaaaaaaaaaggggtggctaggaaaaatgtcttgaaactgggtctgcatagaaaacaactttgtttgagatgtcttggagaaggctgatgggaattacagtgtgtgttggtgacacttggagctgccaatgctttgaagtcagactctagttgggtctaactttgcctctgccattccttgctgtgtgactgtggccaagattgccaacctcttgaagcctctgtgattgtgacatgataatctctaaaatacagcatctcttgttcacgattatttcctcagaacctgttacagtgcctgccatacaggacaccctaagtaaatgtcttttttaaaggacatgaataaaacaattaataaataatatgtgcaaagtactcagtatagtacttggaagatgttcaataaatgtaaaatcaagtcacaaaatgacccattgacccagtaatgccacacttgtgaatatacacattcccaagaaaatcatcccccataaaagtaacttaccggctggctgcggtggctcatgcctgtaatcccagcactttgggaagctgaggcaggtgaatcacgaggtcaggagatcgagaccatcctggccaacatggtgaaaccccatctcaactaaaaacaaaaattagctgggcgtggtggtgtgctcccgtagtcccaagctacttgggaggctgaggcaaaagaattgcttgaacccgggaggtggaggttgcagtgagccgagatcgtgccagtgcagtccagcctggcgacagagtgagactccattaaaaaaaaaaaaagtaacttacctataccttacgtatataaagttatatctctgcacatacacttatgtacacatatatagctaattatggtgaaatacggaactaacccaaagacagtgaggaataggtgtgcagttaggaattgtcgaaaccgtggaaatctatttagctgaaatctagccagtgtgtagacaatgttgaaattttaaaaagcttaaatctgaaaaatatttagaagatatatacaagtgtctatttgttagatagtgaaaactagtaaggttttggagtgaaaaagtttagagatggttacaccttttttttctaaagttgcttaaggtttttggaattgcttccctttccccacaagaacaaagcactggccgggtaaggtggctcacgcctgtaatcccggcactttgggaggccgaggtgggtggatcacctgaggtcaggcgttcaagaccatcctggccaacatggcaaaaccccttctctactaaaaaatacaaaaaaatagccggtcatggtgatggatgcctgtagtcccagctactcaggagactgaggcaggagaatcacttgaacccgggaggtggaggcggcagtgagccaatatcgtgccactgcatacaagcctgggggacagagtgagactccgtctcaaaaaaaaaaaaaaaagaacaaagcactcagccccacttcccagctggggagccccatggcctcatccatcctgagaaaggcctgcttttgctgtgatgtccctgctaggctatgaaggggctattgaaggtgctggctagagatgggttgctgaggagcatggtgacttcctggccatttaattgtgttagattcatggtggaatcaattttcttagtgaatgaatcagctgctaccagcacaggtcctttgtccaaagctccttgaggaggatgacatttagatgtattctctgtaattgataggccatccccaactggcgatggactcatatttttaaaaaaagacagctgaggattccatcagcattttgaagtaagctacctccaccaaagcccagctaacttcaaacctgcaataataacaatcggttaataatagtcataatttcactttagctctatattatgatgtattgttctaaaaagactttctcgcaaaaccaagaagagagcatttccaaatgtacaaagtattgtaaaagtacaaacggaaattatttctgtattgttatcatttccacctgatccgtatgagctcacagtgaagagggcagggcaaatctgattccattttacaactgagaagacgagccatttcatcagagtggtggtttccatgtcaaatgtacatagaggtattttgggaacacagcagggggcatctgatctggcgggggcatctgatctggcgggggcatctgatctggcagcggctggggagcactggtggtcaaggaaggctttccagaaggagtgggagttgggggctgagtgaagagcaggtctttccagccaataggatggcacagagcgagcctgtggagggcgtcaggtggagaattggtgtctgttagcatggccgttagaattgaggccaaaaggaaaccaggatttcctactgaacagccctcagttctccggaggaggaaatgggttaggatgtctcttcccctaatccctcacttgtgtctatcttggtctctttgccagagtgggcagaagggcccaactctgttgcttttgcaacgtgaagcctcccttccctcctctgtctctgtgcgtgtgaaccctggaggcctgttgagggacccttttctatgaaaatggtagaaagaggaaaaagggcaagagcatcaaattatggagaccccggaggctctggaggtgaaggctcattaattctatctgattcaaagcctgagaagaacggcctggagggccactcagtgtcatcacccatgacgctctcgtaactcttccgtatgaagagacatacttgggccactcttgccagttagccacttgggaaataccacggaagactcactttttttcacccagaagcccttttagggagaatttctttaggagaaattccgctgaattcaagcccatcagactcacatgctgatgatgtaacccgcggcagctcactcctggacacatgtgacccattctgaagattatctgtcatgtccttatagggtatggctctgccttggactgcagctcctcccctacctcccctcctcccacagctccatatttaggcatctgccaaggctcctcccctcctcaaggcttatcatccatctttactgccgcacaatgatgcggtggtttgttttcgtattcactgcagcaggtaataaatgttcctactttggcttcagttttaataaaactatcagaaactgctttacagtttgggaaactgaggccctgaaagctgacttgatgggccacttggggtcagaactggctggcacatgagggtcacttgattgaacagagactttttctcctttctgactctctaggtagcaaagcttagacaggagtctctctctttctttctctttttgtagccatgtctgggtatgagacacacagaacaccctttgctggagaaacctcttttgtgctactttaaattccctacttagagttaataactgtttatcattatatttagtaattgttatttgagaatgttattaatagggactacttactgtgtgtttactatgtacatacaatgtgtttatattatgcacctgctaagaattttgcactctaggccaggcacagtggctcacgcctgtaatcccagcactttgggaggccaaggtgggcagatcacttgagcccaggagtttgagagcagtctggccaacatggtgaaaccccatctccactaaaaatacaaaaattagccaggcgtggtggtggtgcctgtaatcccagctactcgggaggttgaggcaggagaatcacttgaacccgggagttggaggttgcagtgagctgagatcacaccactgcactccagcctgagcaacagagcgagactccgtctcaagaaaaaaaaaaaagaattttgcactctcagctctaagcacacttaatactctcaacaacctgtgatacagatataatattattacattgattttacagaggaggaaactgaggcttaaggaggttaagaaaatcttccaagttcgtcacataggtagtcggttgggcagctcagattcaatgccaggtccacctgactttaaagcccatgaccttaacaattatgccttattaatttccttttgcagatattcactcaggaaatttggctttagctcagtcagtttattggaaagtttatttaaataaccaaaagggctgagtgtggtgactcatgcctgtaattccaacactttgggaggctgaggcgagaagatcacttgagcccaggagttcgggaccagcctcagcaacatagtgagaccttgtctctacacaaactaaacaaaattagctgatcttggtggtgagtgctcatagtcctagctacttgggaggctgaggtgggaagatcacttgggaggtggaggctgcagtgaaccaccattgtactctgtctccagcatgggagatagagcaagactctgtctcaaaaaataaataaaggtggccagtggctgtgtgtggtgactcacgcctgtaatcccagcactttgggaggccaaggcgggtggatcatttgaggtcaggagttcaagaccaaccttggcaacatggtgaaaccctgtctgtactaaaaatacaaaaattagctgggtatgatagtgcatgcctgtagtcccagctgctcgggaggctgaggcatgagaattgcttaaacccaggaggcagaggttgcagtgagccgagatcgagccactgcactccagcctgggcaacagagcaaaactccatttcaaaaaaataaaattaaaataaataaataaataaatgtccgaagcatgtacatttttcctaattctggccctgctacactggggtcaaataaaacttaaggccaggtgcagtagctcatgcctgtaatcccagcactttgggaggctgaggtgggaggactgcttgagctcaggagtttgagaccagcctgaacaatataatgagacccccactctatttataaaaaataagataattaaattaaattaaaaaaataaaacatagaaatgtcttaagaggtcttggctctggactaagtcacaaatgcatatatttaagttgcctcttggtctaaggatctaaagtttaaccgaagcctatggagccctcaaggagtccttcctcaaaggtctagtctcaaatggggtccatgaccacggtgtgtgacagtaacctggtgtgagtctggagaaagagtccaggtaaacatttggcaaagtggtccctccgctatggacattcaggatttggcatttcagatagtagtgaaatggataactcgatggcttcctataattcccagatgccaggttttgtgctaaatcagactctccacattctgaatccttacagtgatcacatgaggaaagtccttttcttattttcatttttatgagaaaaccaaggttcagagaggttaagtaatttggccaaggtcacctggcttacatgtgtttaaaaacatgaatatgtatcatgtgaattatttatatggctaactcatttgcaaaagctattaggtataattaaacaacagggacagtgggttgacgaggataaaaatgtcttggcagccggacgcggtggctcacacctgtaatcccaacactttgggaggctgaggcaggaggatccctgaggccaggagttcatgaccagcctgggcaacatagtgagactgtgtctctacaaaaaaagcaataaattagcccggtgtggtggcacacacatgtagtcccagctactcgggaggctgaggtgggaggatctcttgagcccaggaggtccaggctgcagtgagctgtgatgacaccactgcactccagtctgggcgacagagcgagatcctgtctcagaaaaaagaaaaagaaaaaataaatgttttggaaaggaatgccaggatttagagaagtgacttaaaaattatgtttaaatcagacgtgtaggtttgctttgtattgccctgcatgacacatgtcaggaagatcgccagggaggggaggttacaagcccaggttgcaggaataacctttactctgaattttggtctgaaagacttttccttcgtctggagctgggctggccttgtgatattgtgccacagcagacacgacactgtctccaaggcggagctcattgcctggggctttcccactgcactgaatgagaatttatttggcctttaatgaaattcagattgtcccatttatgcagtcctctgtttaagtgacaggcactgaatatggttgctttcaagcaagttattttgtttaaccaggggcctagcggagttcgggatacacagatggccaccaaaaatgttaaaagaaagaaataacttaatcctcacagcatctctgagaagtggttcctaaatttatcacaatcttgcagatgtgtaagctgaggtgtggagttcaagcagcgtgctcaaagccatgtgtaggtgacagtgcctgatttcagatgcagataactctaaggccagtctgttgcatctcttaccagtttttggaaaaacctcaagggaaaaaccacagcaaatttttagagttctagtaatttcttttcccctattacaacacatattcccataaaccaaggactgtgtgattagtcaataaacaaaaagaaatgcatatagtatctgtcgctcataacgttcttgtttcttgcagtttccaacatggctagatccatcagaaactgaagccgtggagaacgctctcggggcctttgccacttcttggagtagaagccgacagagagctgtttggaaacttctccttcacacaccaggttgctactgaggtctatttcatgttgcagtcagagcagttgcttgtgttttttagtgcttgagtgattttacagataaagtcagcttctgcttcttgaccgggaggcatttgtgtgtgtgtgtgtgtgtgtgtgtgtgtgtgtgtgtgtgtgttgggggaagacagatctaagctctccctgtgaggggaagagtggattgcacaagcggggttggatggctacactgagattaccccacatttaatcagtttgccaatgaggaagccccttatcttcaaaaaaggcaagaaagaaagaaagacttcattttcccccttctctttctgttccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctccaagcaatggcaacagaacttggaacagaagcaagagagtgtcactttcacttctggtagggtggttcccaggcgactgcaggtcctgtgaaagacaggggtctcaaagttctgttaatttcacaaatttgttataaatttgtctaaactgagctgttgtggcaacataatttatgaatcgtaaggtctagttaggcttattggggggatatctacatatatatgtgtatgtaagggaaaaaaggtagaatttacagccttcaaaaaagaaaaatcaaattccaagcacaggaataagaaagctatatagcaactgctcagagaacagaaagttatcaggggaaatactgaataaatagacacacacatactcgcacacaacctgctctcacacacacaactcaaacctcattctatcgaatagtttaaaagcaatggtgttgctcatctgttaaagtggagaacagaggactacataacttaaggtagaaattgcaaaggctgggttgggcagggcgtggtggctcactttgggaggctgagacgggtggatcacgaggccaggagttcaagaccagcctggccaacatggtgaaaccccgtctcttctaaatattagctaaaaattagctgggtgtggtggcacatgcctgtagttctagctactcaagaggctgaggcaaaagaattgctcgaacctgggaggcggaggttgcagtaagccgagatcgcgccactgcactccagcctgggcaacagagggagactccatctcaaaaaaaaaaaaaagaaaagaaaaaaaagaaagaaattgcaaaggctggcacctagatagatcaatcaattactgccctaatcaaaacttagaaacactctgaaccacctttatgaaggtacatcattgttatggggtaacgtgactattacacacaaaaggtaaggtggctggcataaatgactttgattagaattatgttgacatagccaaaccagtttctctgttcccttgtgtggtcaattccttacagctataatcagtatcaaaaaccaaatgtgtgctcattcacacattgctttctccttctctctctcctcctatccacagccagtaaaaggcctgggaccggggtcttgatctctggtgggaggattgcctcggttccctggggctgacacagctgccttcactcagacttctctgctctccaggcggtggcttgtactcacctctaagtcacccgcctcccttgattggagagcccgtgtctctagttctcagctcagggttggggggcttgaaagatgaccgggcaggggaggggaagggatctcatatcctctgatatccctgggattctcttcttctccctcaacccacagagtcttaaatcacggatgcgggtgttcagggccagcctttgccatgagaggtatttaacatgtcagtgggaaggaatttctattcactgcagtgg

SEQ ID NO: 16055 - DNA, 17580 bp, Human
accacttgaaagtgagttatgggtttaagcaagttgaatctgaggtgagggcagaacttccagatgaagtcagaattgcaaaggccataaagcccagggtttaagcactgaagccatggaattggcctgcctgggctccaatccctactctgccgcttcaatgctgaatgacctgacaagtcagtttacctgtctgagcctgtttgctcatttgtaaaatggggctaaaaatactacctccctaggtttgttttgagtatagggtaatatgtgggcagtgcttaggaacagagtttgggcattgtcagtgctgaattcatgttggtttttataatggtgtgtataatggatgtaatgataaatttatggtgatgtaatattaccataaggtaatattttcctgtattaagattcttgaggtcaggcacagtggctcacgcctataatcctagcactttgggaggccgaggtgggtggatcacctgaggtcaggagttcaagaccagcctggccaaaaaggtgaaacctcgtttctactaaaaatacaaaaattagctcggcgtggtggtgcccacctgtaagcccagctacttgggaggctgaggcagaatttcctgaatctggaaggcagaggttgcagtgagccgagatcgtgccattgcactccagcctgggtgacagagcaagactccgtctcaaaaaaaaataaataaataaataaataaataaataaagattcttgaatgtgttagccataaggggaaatcaaatcacaacaaaaccctttcttcccagtgactgcacaatcattttcttcattcccagcataccaccattgttgtatatccaccagtgtgccagggtctgtggataaaccctaaacatccagagaaggggagacaggccccagattcccaccccaacacgcatcatgtgagcagctggaggatgttgcagttcagcaaaatccaagggttggccacaggatctgctaggcaaagctgctctggatgagaaactgggaagaatgttcccattggtttgggggttgttaagccatcaggaaaaggtttggaatctgtattttaagagagcatgctatgtgattccttcctccagccctgccttcatccgtctttcacctgttcagacccttgccgtagagaatggtctcttaagagttttttactcaggaggagcaatgagcttggcttcaaggagtccactgtttcgtgaagggcattaactcagctacttggtgaactggaacctccaggcttccaaggatgacatttccctggaagaaagtagccagcagcgtcccctttgtgaaagagaggaagcctgggctccagggaagggggcaacagtccaatgagccatagcagggaatggaccgaactgtacatacaagatgaggaggggcctcgaacaacagggaagccccgtggagcacgcaggggagcctggacgcggggaatcgcctccgtttctcaccctgacagcagggagggcttcccggagctgacagtgaggcagacatcccggatccctgttatcacaggtgcagccacgcaacttttgggttaccttcccgccacgaaatggaaatgatttcctgagggccggaaagatcatttgcatcgggcctcaggtctggggctgggaaagcaggccccggccggaaaggaagactggaggccgccgccccagaggccggaccctcgcgtcccggccgcatcccctcccggctgggtatgcgcttcgggcgcggggctccctcgcgaggctggactgggtggagcccgagagcccctccggggagctggctgccggggaggcaccggggctgcggggccgcggggcgggccgggcctggagctccgcgctagaggcggccgcagcgcaccgggcgtgggcggggccggcagcgcaagggtgaatgtcggccccgccccgacggcgctgactcagtttcaccagaaaccagggggagaaggcggccgagccccagctctccgagcaccgggtcggaagccgcgacccgagccgcgcaggaagctgggaccggaacctcggcggacccggccccacccaactcacctgcgcaggtaacccgggcccccgcgcgcaaggccgaggcgcaggcggagcgggctggagcatgtccggccctttgttctgcgctcgtgcgtgtgtccgggtacttgagctccctagcggtccgcctgtccgtctgtctggctgccgggtccctggagggcgcgtgggagggccgggcccgtgcgccctcttcgatcctggggtgctccggtccctcctccccgccacttcctcccggccggcccgcctcctccaaagtctcccgggctgatcaggtgtgtctcctcctctgtcccctcccttcttctcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggaggtgaggagggtgccaagatggatgggtttggagagactcaaaaaagggactggttatggggtcctaggggagacgaacatcagagaggagttaaggagagttcacttttttttttctttttctttctttttttttgcgacggagtctcgctcttgtcgcccaggctggagtgcaatggcgcaatctctggttgctcactgcaacctccgtcttccacgttcaagtgattcttctgtctcagcctccggagtagctggaactacaggcacccgctaccagacccggctaatttttttttttttttttttttttttttttttggtacagacggggtttcactatgttggccaggctggtcttgaacttctgaactcaggtgatccacccaccttggcctcccaaagtgctgggattatttctacctgaagccctccttagaagtaggcagtacagccgaatcaagcctggtgatcaatggggtgacagatgtcacagccagatcgccttcacatcggtagtaggcagtacaaacagtaaacaaatgaaaggggacatgagtagggagggcagggcccaggctctggctcctgaactcaggatgttcagaggtgatgggctggtgctcacagggaggcctttggctctgggctgtgtgtactggaggggagaggaagtccccaggactcctgacctctggcactgataggctgattgaaggagtgagctgtctggatggtctggtgactagaaaggcaccttggccaagcactggtctgggcacaccgatgccctgtcaggtgagcctggccatagtctcctccactggctggacttgggactgcttagcatctctctaccccctaggaatgcattggccttttggtggtccaggaagactgccagatccgagactagaaaacaagcccagtctgcggttgatccaaagggagagaagtgatgttgtaggcacagaagcctagaggctctggggtgggggatgaggagggttgtggggtgagtcagcctgttggtatgtatacctagtagggaagggatgtcagctgtccaggcaggtgtgtgtgcatgcgcatgagccagacagggctctccctgcttagaatctggtagccaaaccttgtttacttccatagataaaggcaaagcggaggccagggctcctcctctttcttccccggactgaactgtctgctgggatcagggccagtccagagccttggttccccctttctctctacctgctgttctggccaggtggggctccagggcaggggtaggtcacctctcataacctctgtgagcactttacagcttactgattgctgtgccacacatcctctcactcaggcctcatcacaacaacttccaaaaagggtgctactagcagtcatcccactttttagattaggaaactaagactcccatgttaaagaatttgcccagggtaacactgcccataaatggtaggcctgagattcaccccaggggagacctccaaaaaaagtcctgtgctgtttttcacacaagaccatctctctggtaaaaacctagcattctgacccaaaatagcccagtggataacagaaccggggattggggagtttgggggccagaactgggctggggccacatctgggggtggtctccgttctggaaagtggagaaagggctttcctccgcagacttttcctgggctagtctctctgccaggctaaggagggtcctctttcctccctatccttccagtagctctcctgggtctctgaggagaggcgagatggggattcctgtggatgggagggggacatatctgagggccagtctgggccaccaagtcccactgaaccagggctgcagcctgttccacaaggaagtagcagaaagtgtaggtggtgatgactcttactgacctgagttgcccatgcccttcctgctccacagaggccccatgggagtccctctccagagccagagtgtgaaattctggagtctggtcagggagctgagctggactatggccccatggtcttgagaccagccatcctcatctggaaacccccaggacctgcctgtttgccacaagagagggtggagtggggatttcctgggacattgagggaggcaggtagggcttggacttagtatgagctccaggccattctaggccattcttagagtgctgcagtgctttgggaagaggaaaaagctgtgtgtgtgtcaaggggtttattctcacctgggtccagttagagaggttggaggtgggtaatgacagggtagagccattaagggctagggtggatgaggtgggttgggtgacgtgggtcacgggcactgagagcttccaaacctttgattctcctattgcatagataaatgctccccagaatgggtttgtttgttcctccttctgcctgtggccaggccaggccagtacagattcctgcagctggaggcggagcagcttgcacttcctcttctccccttctcttcccccacctctcctcctccccagtcctatgaaggagtggcttaggaggcggagtctgcacttccctgaggtcctgagacctggtaactaactgggggaggggctggttttattgccactctagccctttgctctcttgcgggtgggaggaagggagtggtaaggcaaggtacctgctccttggtcctgggggctggggcttggagaggactgagttgtgttggggtgggattcagcccctgattcagctcaaagtctgatgcatcactctgcatgctacttccactctgggggcctggtggggctagcctgtctgtctgctaggcagactgctaagtagtctgtcttctttctacaaaatgcaaggagggaggactgcgctcctcccagctcgctactcccttggcaggtgttctcagggtgctctcctgcttgtcagccaagcccctgggctgggaggttgcctccagacagccacttttcgttcctgctcatccctgtcttattttccctaatccctggaacccagttctctttttactatttttgtaggcctctgaaacattcaacatgtttcttcctgaaatctctcccttcccatcccttttgctgtcattgtgcatcctggtcttctcagccccagaaccaccttctgtgagtcccccattggctctgctttctctacttcatcaaagaggaatccctgagactcggcctcctaccagctgttcttagctctttaccttctcttctttctttgcattcactctaacacttgaaaaaactctctagagagcctctgtggagggtagttgggcaatatctatcaaacctaaatgcacacagccctggacacaattccacttgtaggaattcatcttgcagctgtacctacacacggataaaacaacttaccagccagttagtccccgtagtattgtttataataacgaagaattggaaacaatcgcattgtctgtcaacacatcctataattgaatactgtgatgctgttttcataataataataaaccctaaggtagcatggtttagttcttaggagagaaagaaagaaaatctaaatcaggaaactggtagggactgtttaaataaattataaattgtggtgcatttatacaatgaatatgatacaacaacaacaacaaaaggaaactctttatgtgtcactatggaatgatttccaatatatataaagggcaaaacaagatgaagaactcaaatgcttgtgaattcaaatactgtctcttgatattctctctctctctctgtctcatacatacctttggggtaataaacctgatggagaaggttccttcttaaggagaagaggtgacttaattttgactaggcttttgtaccttttggttttggtttttctgttttttttttttttgaaatggggtcgggccgggcgcggtgggtcacgcctgtaatcccagaactttgggaggccagggcgggcggatcacgaggtcgggagattgagaccatcctggctaacacggtgaaaccccgtctctactaaaaatacaaaaaattagccgggtgtggtggtgggcgcctgtagtcccagctacttgggaggctgaggcaggagaatggtgtgaacccaggaggcggagcttgcagtgagccaagatcacgccactgccctccagtctgggcaacagagcaacactccgtctcaggaaaaaaaaaaaaaagagaaatggggtctcactctgtcacccaggctggagttcagtggtgtaaccacagctcgctgcagcctcaacctcacaggctcaagcgatcctcccaacctcatcttcatgaatagctaagtagccatcacaccatcacacctagctaattttttattttgtaaatacgaggtctcactatgttgcccaggctagtctcaaactccttggctcaagccatccttctgcctcagcttcccaaagtgttgggattacaggtatgagccaccacacccagccaccttttgaattttatgtcatatatgtattacctaaactagaaaagcaaaatttaaaaacccaacattataaaagcaattaaaatcacaacctctgagggggtggataacctatagaattacgttttggagagagcatttgctgtggagtctgacagaccttggttcaaatcccagctctgcctttagaaactgaatgactctgagcaagccatttaatctttctggtgtcagctttctcatctgaaaagagggtgagaatgtaggtgtagcaggctggttttgaaggtacatcatggactccaggggtcaataaatttttctgtaaagatctaaatagaaattattaggctttgtgggccatagggtcccacttgcgactgctcagctctgctgttgttacatgaaagcagccatactcaacatgtaaatgtgtgggcaaggctgtattccaatcgatggacacaaatttgaatttcatgtgcttttcacatgtcattacaaaggattctccttttgttttttctttttcttttctttctttttttgagatggagtttcgctcttgttgtccaggctggagtgcaatggcgcgatctccggctcaccacaactccgcctcctgagttcaagcaattctcctgcctcagcctcccgagcagctgggattacaggcatgtgccaccacacccggctaattttgtatttttagtagagatggagtttctccatgttggtcagggtggtcttgaactcccaacctcaggtgatccacccgccccgcttcccaaagtgctgggattacaggcgtgagccaccgcacccggctgttgttttttcatccattccaaaatataagatatggtgggctggatttggcctgcaggcttagctgatgctaagctatagctgatgcaggtagagtacctagcatgctgcccagcatacactcagccagtgcctctatttccaacccttgcctgtctgtcattgtctgctggttcgggtggcctgccttctcccaaatttaacttctcttatgacttaacctatatgttccctctaaatccggtttcccttctgcctgtaccctggcttttccttcccagttcccagagactggcaggggagaagccagaagcatcagcccagcgttgtttctcacatctttatctccattcccttggctgctctggcatttgggccactcctgttgcatctgccctggaccgctgcactggtatacttgccagcctcctcgctccacagaatgcttccaaacagatgggaaaatagctgctgctcagagctcaggagtgctcctgctgcccaagccctgggcccctccctttgaactcctggacctctgtcatgtatctaggaggtcaatgtctggtgcagctggcctccaggactctacgccactgctcacggccagtgtctgtcccctttctgtactaccagttgtttaatatttgaatgttactcctgctgtgtccaaacaccctggcctggcctccaggacgctttaagatcaactcaagcccagcgaactggccttgcaaattcctaactccttgctttggtttctcatgtgttccgccattttcttttttctttttttttttttttaaacggagtcttgctctgttgccaggctggagtgcagtggcacgatctcggctcactgcaccctccgcctcccaggttcaagcgattctcctgcctcagcctcctgagtagctgggattacagacatgtgccaccatgcccagctaattttttgtattttagtagagagggggtttcactgtgttagccaggatggtctcaatctcctgatcttgtgtctgcccgccttggccgcccaaagtgctgggattataggcgtgagccaccgcgcccagctgtgttctgccattttcaacaacaccctacattctcccaacaaccaaacaagaacaaaaacaaaaaaatcaaaaaatcctttctccctcctccagaaagccttgccttatccccctagcctgccatggcctcctttctctgaatgtccactgccttgtttagtccacgtgttgcttcatgtcgtggggtcttatctgcccaactggactaatcctctgaagggcaacgtattaatttcctagagctgctgtaacagatggctatgaactggttggcttaaaacaaatttggccaggtgtggtggctcatgcctgtaatcccagcactttgggaggttgaagcagaaggatcacttgaggtcaggagttgaagaccagccaggcccatgtggtgaaaccccatctctactaaaaatacaaaaattagccaggcatggttgtgcacacctgtaatcccagctactcgggaggctgaggcaggagaatcgcttgaaccctggaggcggaggttgcagtgagccaaaattgtgccactgcactccagcctggatgaaagagtgagactccatctcaaaaacaaaacaaaacaaaacaaaaaaattattcttgcagagttctggaggccagaagccccacatcaaggtgtcagcagggctgtgctccctccaaagaccctaggagagaatccttccttgtcttttccagcttctggtggccccaggcgtaccttggctgtggctgcatcactctagtctctgcctctgtcttcgcgtggccttctcttccttcactctgtcttctcctcttctgtttcttataaagatactttgtcgttggatttggggcctaaccagctaatccaggatgatcgcatctggagatcctaattacttctgcaaagacccttttcccaaatcaggtcacgtttatgggttccaggggttagatgtgaacatatctttgaggggccaccattcagccccctacaggcagcgatcctgcactgtgcttgtcacccacccccatgcctgaccctgaggtggggaagcctcagacacaggcactgtcaagtcaaggaagggcgtggctcccgggaccccttgtaactggaggccgagtctgtctgaggtatttctattgtagaaaatagaaataagcctatcccctcaagtaagtgtctgtgtgtgtgtgtgtgtgtgtgtgtgtgtgtgtgtttactcaataagatcagatggcagtttgttcagtaatttgcttcagaaagagggttttacagctgggtgtggtaattgtacctttagtcccagctactcacgaggccgaggcaggaggattgcttgagtttgaggctgtactggccatgatagagtctgtgaatagtcactgtgctccagcctaggaaacatagcaagaccccatctctaataaaaaaaaaaaaaaggaaagaaagtgggttacaacataaaaatatcttcagtataccaaaaacatgctctctctgaatagagatcaagaagctggttctgttgggggctcccacccgcaccccatgcaggctgtggagtcccagtttggtctaggtggggcccatactttcaccaccccactttgctcctgagagaagcctggtccatctagtgagaattgaccttatctcactttctctccccgccagggtctgggatccccaaggcctgggcaggcatagacttgaaggtacaaccccaggaacccctggtgctgaaggatgtggaaaacacagattggcgcctactgcggggtgacacggatgtcagggtagaggtgagacactgggctgactctgaccccgccctctgcctgccagccttcttggagcccctttctggggccctaggccaaccaatggccccggatgggatggggtggagagaggctgaagatgcatttaatccaactccccctggcctccccaggggtgtgggtgtgtgtctggccaggcctggggcagcccaagggcatcagggggtgcccaagcctgatagccactcctgtgtgcagaggaaagacccaaaccaggtggaactgtggggactcaaggaaggcacctacctgttccagctgacagtgactagctcagaccacccagaggacacggccaacgtcacagtcactgtgctgtccaccaagcagacagaaggtgagggaggggtgaggagcagcacctggagcccccgctgtgcggattggccgcacggtcccctcataagctctcccccctagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggtgagtggtctctctcttctgtggccagggaggtgggtggtgggagctctcccttgcccacccaccccaattatctcatccccactggagcctggtcatgcctcctctcattctctgttctctctcccaggcccctccatggaaaggcgccatccaggtgggctttactcccctccccatcccccatccccaccacatctctagcccatatcatccctatgcccctaagcagcctgcctttgaccaagccattcctcccctcagagtttgtggaaggaccacaaacatcccaccccttccagcccagcatcgtcctatgaggatctgcccagtttgcgtggggcaggagtggggttggtggaaagggaatgggggatgtgctgtgtctgggcagagagggccaagtagaaggtgggccctgggcacttgttctttgcttgagcctgacctcccctccacccgtccagtgtgctctggcacctgtcagcccacccagttccgctgcagcaatggctgctgcatcgacagtttcctggagtgtgacgacacccccaactgccccgacgcctccgacgaggctgcctgtgaaaaatgtgaggcctgggggatagagggggttgggcagcagacagggaggtcctgacagccttgccctgaacccctgggagacccttgttgggtctgagactctgacctttcctctctgcagacacgagtggctttgacgagctccagcgcatccatttccccagtgacaaaggtgagatcctccccaggtgccctggatcagggcagacgctgacactgccatcctcactatttccatccagcagtgcctgaggggcctgctgggtgtacgggcctgtgggcacaaagagccagggtgggctccccgttctccagatggctcagcttcttccctggctggctcttgggctttcttctgtggctctgtgttttccaggcatcactcattctccgaacaccttcataacttcagccatgtccaccacatattgctcagatcttatttacttaatcagttactttttaaatgtaatatattaaaaaggaactttcacatcactaccataaatgggaagccactattacttgccaaacattgaaaaacaacacaaataaatataataaaacagtaagttttagcttgccaggcgtggtggctcacacttataatcccagcgctttgagaggccgaggctggcagattgcttgagctcaggagttcaagaccagcgtgggcaatatggcaaaaccccatctctacaaaaaatacaaaaattagccggatgtggttgcgcgttcctgtactcccagctactcagaaggctgaggtaggaggatcacttgaacctgggaggtagagactgcagtcagttgagatggaaccactgcacctcagcctgggcaacagagtgagaccctgtctcaaaacaataataataataataagctctagctagttgcttgcctgccaaggctcagaccctgaggcccatcctcttttttaagaaaggtaaaccagccaggcgtggtggcttacacctggaatcccagctactagggaggctgaggtgggaggatcgcttggcctaggaatttgaggccaacctgggcaacatagcgagacactgtctttaaaaaaaagaggtaaaccacccagtgttggaaaactgagaccgtgacccagtcagaaaagctgaaagaaaattgaaataactatgagtcggcgtagtttacttttgtgcctacagttattgtccagggtttgtcttcccttttctggcaccactgcagctgggccaggtgttttggggcctctcaggccctccctgagccatggcaggtggggaggtgctgggcagcagccacgtggagcctagcagaaggtggcagggaggccatggactcgctcaccatagcctaccccataccccccagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccagtgagtgggccagtgagagggtgggcatgtatgggggaaggcttagccagtggcctccactctgtccccaggcctttgggagtcacccctccatcctcagagcgcctggagtaggagtgggagaggatgccagtgtgaggtctggggcactggggagcagctgagtctctgagccctcagtactgactggtctttcccctcatcattctgcagagaaggatgtgtttggcctgaggcgggaaatccccattcccagcacaggtaagccctgatctgtcctgtaactgaggttagcatgtaggtatcaactcacggatcaactccacctgttgtgacagcctaacctgtgttgagaaggatgccaaggtggcctatagagacagagtaccgtaatcaaatggggatgcctgccacacacgagggagggagtacagtaaagtgcgtgccgatgtctgtcagcagcgtcccaggcttcccccaagttaactgcaaggagagcgacttgagctgagacctgaggcccaccagagttcctctgagctcctggacagagctgttcagctgttcatatgtgggaggtctgagtcgggtgcccatgtccttccatacctggcatccatttgacttggtctcttccatagattgggggtgggtgtcagaaccaggcaggccctgggagccccttattctaccccttcttcccccaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtggagtttctggctctgttctgtgggccaggagagggactaggttgctggggggtgatgggaccgtcctgttcagctggttcaggcttcagccaccctgttgagcaggttttcccatcgtctctctcgaaactggcctggcccctgactttggagagcagtgccatgtttgaccaccagaggggaggagtgagcgggccacgggagccacgagtgtggggaggctgcagtgctgctgtgtagcatttcttcctggtgtgagcctctccacaagcctgttgagtggttgagctctccacaattctgctcatttggaggttggggttaggggtgcacaggcaccttggctcctacctccatgttagggcccaggtgactagctgtctccctcccaacagaagccctggcttctgcgctggagtgcagcacccccaaccaggctctgagctccttcccaggagcctttagtagagacacgccactccaacccacacccctgcatttgttcaagctacctcccggtgccaaaaaaaaaaaaaaaatcatactttgagctcattcgttcgtttattcagtgaattacattgagctcctctgtgccagacactgccaatcattagaaatttgatactgctgagaggggcagaggaagcactatttaaatgctttacgtatctcgagttgctggcgctgcacacagcccttgtgatgacaatacaatcatccgcattttacaggtgaagaaactaattcattgaaatttcctccccaaggccctagagctgagattggactggatccccagagtttagtcttacaaaagaggtatcggggttggtgggggtgggggggggacttaaaagcaaattttaagcaagtacaactaccatgaatgtacatatatgaagttataagtgtatagctcagtgaatttccataatgacacacacctctgaggcaggcacccagatcaagaagcagaaccttcttagcacgccgggacaggcctcgttttgatggataacacctggttttggactcgtgctctcatggaccacctccccattttgcacgcctcagcctaagctcaaaaccctcccacacaactgcaggtggtggacactccctgcctcacacccctgtgtctgctaacaccaccctgagcccagagcacctcttatttcctttactgcctgtcttcttgccggattgtgagatcccagagccgcagatggcatccagttgtgtctgggttcctggcaccccatgctccctctgtgaccttggtaaatcgtagtttagtaaatgttgagtaagcggcagggggtggggctcatccccattgttccacttcatagggcaccgtgttttcccttctaaccccctactctgacactcgtccatccttcgaggctcaaaacggacttgatccctactgggaacaacccccattatcagttggttctcagactctaccctagtgtccagaacagtgatcaacacagagcaagtatttaataagggtttgttggcctgaagtgaacatcctctcagggagggatagacatcaagtgagaggatgccaggcaaagggccacccctagtaacagctgcttgcatgtgcagagggagtgcccgaggaggtgggagctctcgggggtcactagggggcgctgtgactatgactggatgccgtgttcttcctgcaaggatgtgaggactcagtctcaggcaggtgacaggagtggagcaatgaacgccaagacacagctcctgctctcctggcgcttacactctggcgtgcaggctgcagggatgcagatacggtgacaaaacagtctggtccccaaacttctccttatccctgagaccgccccagccatcctctgctctgtgcccacccacatgactcagaactttgatccctacctccatgtcctgaacaggcagtttcctccacttcagaagtcccctccgccctggaaagctcctactttaccccgtgt

SEQ ID NO: 16056 - DNA, 24847 bp, Human
  misc_feature (1)...(24847): n = A,T,C or G
tgggtgaagggtgggggtcattaccttaaaggtgaagtggggagaaaggagagcagagaacattaggggccagcaagaaagaggggccactgggcattccctggattagcagcagcagagggtgggaggtcagagggtgcgggaggagctcggaggaggggcgcttagttgcgtccgaaaaggctcagagtttgcagacaaagcaaagaagtcagtagaatgtatttgactccaacacccttccagggacgcctgtggacatattcctgtgccacctataaactgctccaggccatgtgttctaggtgaagagcagggtcggtgtgggtcaacctctcacgtggcaaaggctggcattaccactaagcagaggggcctttacggtagaatgaaatgcacatgtgttcaatgtaggaagtgtctccttgataaagaagccatatttctttttaaaattaatgttattgaggcagaatttccttagaataaaatgcacccatgtgcattgtgtgtacagtttgatgagttttaacaggtgcatgcaactgcgtaacacccccacctccactatcaagaaacagaatgtttcagtcatccctgaaagttccctgtgcctttccctgccagctcccagccccagacaacccctactcggctcctttaccagaaaggaggtttgtttctcccagaaccatatttaaagtgtatgtattttatctattctgtttatatataaaatatacactttttatgtgtagctgtgtgtgtttagttgtgtgtgtagttgcatgtatgtgtgtagctgtgtatatatgtagatgtgtgtagttctgtgcgtgtaggtgtgtgtggttttgtgtgtaggtgtgtgtatgtagatgtaattgtgtgtatatgtttagttgtgtgtgtattaacagatatgtgtagttatgtgtatgttgtgtgtatgtatgttgtgtaattgtgtatgtttagttgtgtgtgtgcagttgtgtgtatgtagatgtgtgtagttgtgtatgtagatatgtgtgtatgtttagttgtgggtgtagttgtgtatgtagttgtgtgtatgtacagttgtgtgtatgtagatgtgtgtatatgtttagttgtgtgtatgtagttgtgtgtgtgtgtagttgtgtgtgtgtttagctgtgtgtagtgcatgtgtgcagttgtgtgtgtatgtagacgtgtgtagtttgtgtagcagcatgtgtgtttagctatgtgtgtgcagtttatatgtagatgtgtgtagttgtgtgtgtttagtttgtgtgtgtagttgtatgtttagttgtgtgtatagttgtgtggatgtagatgtgtgtagttgtgtgtgtatctttagtgtgtgtagtatatgtagttgtgtgtgtgtctagttgtgtgtatgtgtgtgcagttgtgtgtgtgtagatatgtgtagtgtgtatgtatattgagttgtgtgtgtttagttgtgtgtagatgtgcgtgtatgtagatgtgtacttgtgtgtgtgtgtatagccatagctatagttacaaaaactgagtttctcacccatggtcattagagctcaatgggcattttgcatttcatgctttccctgggtgtaggtcaaaatgagatccacttcgtgtgttttagagctgcatgaaaaaggggattcgacccaaaataccttcctgcatgttcctttacttcatcttcactacttacttgggaggtagatgggacaggttgcatcatccctgttttgtcactaaggaaattgactgatttctccaaggtccctgggcagtcccaggatggggacgtaggctggtacccagaccctgcctggcatctgccatgttgtttgaacatagtgctgccatctccagcctgcaccttcccgacgctgcctgtctctgccttagggaggaagggcctgtgccccagggttcagcatcctggctgtctctgcctccctcactcctgcctcctctcccactcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtgagagatccccagcctcccattcagggaaccagctttaaaacacctgtcctgctgtttcagcatcacctctggtgccttccctccctccctgctggacatccgtcctgtcctataggatgctgtggcatttcctttggggacatgttagtgtcccgtggcacctgggcagctgcctttggccatgggaggagcccctgacccactaacattattcacttagcagttcctccatcctcgctgctcagggtggtctaagagccagcaacatttggcgtcccccaagaacttgttaaaaatgcagaatctcaggccccataggccccactgaatcagaatctgcattttcccatgagcccaggtggctggcgtgctttttatactggaggaacgctggggtgcacagctgcgtgaccctttcctctgtggaggggcacggtactgtgagacaatggcctcaatgagctgaggaataagaggcctggcccattggacagctggggcttgagcaggagcagactgcagcatcttggggtctcctgtcactcccccttcatcctggtgggcactccccactgaggctgtgcttctgccccgccctggagcctcagagagctgccagctcagtgctggacactgcaccaagcccaccaagcctgtgatgtcggtggaccccactgaggctgtgcttctgccctgccctggagcctcagggagctgccagctcagtgctggacactgcaccaaacccaccaagcctatgatgtcggtggagtttgtcttgggtccctctgggctccttcctctgtcctgggtaacccctcaccccttcactcttgtcttctggctcctcccttctttgctgtcaccacaaatctaaaacatccacttgtccacagtcataatgggcaaactagggtttcccccaaggccatttgcatttaaagagtctgcattcaaatccaaggaatgcatttcttatttttttaagcatttatttctcttaatttaatttaatttaatttttttttttttttttttagcaatgggggtttcactcttgcccaggctggggtgcagtagcctgatcatagctcattgcagccttgaactcctggcctcaagggatcctcccacctcagcctccagagtagctgggactacaggcacatgccaccatgcccagctactttttaaaatttttgtggagagtgtctcaccatgttgtccaggctggtctcaaactcttggcctcaagcagtcctccctcctcagcctcctaaagttttgggattacaggcttgagccactgtgccagccaaaaatgcatttctaagtgtagcatttccagaagcagtgcaccagtcgggggtgtttgtttttgcgtgtgtgtggtgaagctgcctgcttttacttagatcaccctgataaggaaagcgaggcactactcatttcgactgtgtctgtcttttgttcatcaggaacagccagccacctattaaccgagcatctttttggtacctacatctgctgggtctgagccactttccatgtgcctctgctgatttccctgcagtgtcagaatgtgggctatgtcatcagcataaaaccgagatgacaatgcctatcttatagaattgttgtcgggattaaataagatcatatatgtgtgttagtcaggactttttaaaatttcaaacgatgagaactctcttctaacttaggttaaaaaaaatcaatggcatcttcagtctgatgaagggttttttttaagatgcatcatgtttttaatgtggcatttagaatataatctgcctaaaccatgatatactattttattatcccttagaattattctatacttagagaaagagcttgttaaaacttagacacgttctttagaaattatatctttccaggcatacataaagtatgagtatgataaactggtccaaatatttctcattatctagctcttctaaatgattctgagtgactcagagcacggatgtctgtgttttccatgcagtttcatgctctgtgtctcgggagatggatgatgcagcgtttcctgagagaatgcccctctgttatagctgggattctcatccaagctcctgacacaccttccgcaagttcgctattgggcctgacatgttcttaccaaaaggcatcagtggaaaggctgtagacaacagccaaaacttgctttccttcctgaagtggcccttgaagggtttgttggcggaaggatccaggggctgaatctgcccggtcaggccacggagaataacaacaaagtcaccccatttttcagtgttctccttcaacaagtctgtgcaagcatgatgatgatgttacagtctcatctggccagtagcaattgtaggacacatctgaatttcagagatgtgaaaatggggaaaaatgtctatgctaaaactgacaaagtaggtttattggctcacaaaactgaggagcctagtggtgcagcttatgtcatctttcctcccggcccctgtccccctccttctttcagctttgctcactctttgaggtggcctcccttctctctctgcaattgatctgtctccacgcgccaagggagagtgcctccgacggctccagctcagccacctgctcagaaaataaacctctgggtaggcttgcttggtccacacgcccacccttctgaccaaacacgactgcagagggatggacaccacatgggggccgtgcgcagcatgtggctgagcttgtatttgggatgtgacccacagccctattggctcagcatgcgagagagcagggatggtgctccccaaggaaggactggtgggcaggacggagcagcgcatgtccactagggttgaaagtgctctgcacggcaccagttgcctggtacccatttcataaactgtggccaccatgattgcttcagctcaataagtggtggttagtattaacaattacttttttcacttattagttgattacttatttattgaggtgcttttgtataaaagattcaagctttctgaaatcgaagttaaaattttgtaaacatatcccacgccattgaacctttgtcagtcatgtcaataaatcacgcccttagatttaggttgagctccctctaccctattggcaacttctgcccacttgaacaccactccaaggtcatctgatggcacattagtcatggagttatttatttttcctccagattataaagtccttgagggcatatgctcttgactggcttaagagtactgcatgcctctgtttcccatgaaagctaaagctagggtaggcccatttgctaaaatgaagtatggctcagtgtggcggtgcacacctatagtcccagctgctcaggaggcaaaggtgggaggatcgcttgagcccatgagttggaagctgcagtgagctatgatcgtactgctacactccagcctgggtaactgggtgagaccaaaacatgaaatgaagtgtgaaaaataaagtatcttatacccttttagacatggagaaggttgctcttgattatactaaattctggatttgcttcatatgtatttttcaggtagcttatttaaaactcgatgtacctcttgtggagttgtggctgagaattacaagagtccaatttgtccagctttatcaggaaaagggtaattataccacactacagaataagtataggttgttttctcctttaggttgaacataaatgtgaggaaattgaacattcatcaaagattcccatggatatttatgagaaataagactaaatacaaggctgggtgcagtggctcatgcctgtaatcccagcactttggggttacaaggtggggagactgcttgagttcaggagttcaagaccagcctgggcaacacagtgagaaacctgtcctacaaaaaaacaaaacaaaacaaaaaaccacaaaaattagctgggtgtggtggcacatgcctgtagtcccagctactagggaggctgaggtgggagggttatttgagcctgggaagtcaaggctgcagtgagctgagatcatgccactgcactacagcctgggtgacagagggagaccctgtctcaaaaaacaaacaaacaaacaaaaaaactaaatatagccatgtgataaaagaaatattttgctcacaacttacagtgttaagtgaaaaccacagggtcctaaatttgtacacacaatgagttcgtgtatctgtatatagttaaaagaccagaagaaaatacaacaaaatgttaataaggaatatcaggagtggagggattatgggtaatttttaatttcttctttatatctttctgaattttcctatatttctattatgaacatgtactattattacaatgaggaaaaaatttgagggtagacacaatattgagaaaaattccactcagccttttaaaaacagtataaattgtataaggactatataatgtcattgcagaggatacaaatgatgatgatgatgatgtataaaggtaaacatgaagttcccccttggcacacccagccactccagccctccccacacatgcattccctcactggcagtacaaccactggtgatttttttttttctgagacaggttcttgctctgtttcccaggctggagtacagtggcacaatcacaccttactgcagcctccaactcctgggctcgagcaatcctcctgcctcagcctcccaagtagctaggactataggcacacatcaccacactcagctaatttttgtatttctggtagaaatgcagtcttactgtattgccgagggttgtcttgaacttctggcctcaagcagtcctcccactttggcctcaccagatgctgggattacaggcatgagccactgtgcccagcaccactggtaattaatggcttggggtccttccttctaatgcccttccaagtgagcatgtattaattaggagttttataccacatactgccaggcaaatatacaaactgagttatgttgtttctttattttttattatgccaataacaatctttcttttctaatattatttacttcagtgctccagaacctggaactcaagatgccagcatcccagttgagaaacttccccggtaggtagaaaactctgatttgtactggtgttccaggttaccaaaacaaaaaaaaaaacagacatcaaaacctaaacatgtatttggcaagacgcctcttaaatcaaatgcacaaatgtaaaaaccaggcttgatctctgagaccaaaagtgaaaggacaaaggatgaaccaaattaggatgaaaagaatgatttttttccaacctctttttgctttgtgttgtggtaggatcatttgaggtcgggaaagtttctgaagctgtcgtgcgacaggtggttacccagtgtacagaaagcataggggctgacctgtaactggtcaaataacatcactggcattattaatccagggttagggaggcaatgaaaggacctgaataggagaggttacaggaccaaacagaatgttcatagattaaaaaaaaaaaaaaaaaaaaggaagatttttatgccaatttttcaaaaccaggcattaaaacagcacttctataacctgtaattggattagaagtttttttgttgtgtttattttattttatttttttttgagatggaatctcactctgtcacccaggctggagtgcaatggtacgatcttggctcactgcaacctccacctcctgggttgaagtgattcttctgcctcagcctcccgagtagctgggattataggcgcccgccaccacgcctggctattttttgtgtttttagcagggatgaggtttcgccatgttggccaggctggtctcgagctcttgacctcagatgatccacccgcctcagcctcccaacatgctgggattacaggcgtgaaccactgcacccggctggattagagtgtttttaaggtaaaataaaacagcacttctaaaaatgtttcatagaacattaatttaatgttacgttgagacattacttgaaaaaaacatgttaggcactcaaataaatatggaaatgttagactaaacaaagttaaaatatgtttgctttactgcaggactttttagagcatttaatccacattgctgccttctaaaaagtggttgtaatacgtatgttaatgctttactggcttatttaaccacagaaccttttaaattttcctcatgagggttttaattgctaaatattaaaagttttcttctgaaggaataggtagacctggaggattcctgtgatgcaggagattactatgatgaaaatggtgtttgggggatggttttaggaggtgtatagaaggtaaccctgaggtaggagggagtgaaagaagagagatttttagtaatggacacaggaaagctggctacatactgggccagagagacatgaacctgagagaacatgaaaggaggtcattgatgaaattaggggatgcttggggtgggaggcaaatctgagtccagtatgtctcccaggtctgggtggctgtgagcacaaatgtgagcataatgaatgaactgggaaagcttagctgaaacaatgtgtcagcacatcaagtacatacagacaagataaaaaataaggacagttctgcagggcgcggtggctcatgcctgtaatcccagcactttgggaggccgaggagggcagatcacctgaggtcagcagtttgagaccagcccggcgaatgtggtgaaacatgtctctactaagaatacgaaaattagctgggtgtggtcacacatgactgtagtcccagctgctcgggaggctgaggcagaattgcttgaacctgggaggcagaggttgcagtgagcggagaccatggcattgcacttccgcctgggcagcagagtgagactccgtctcaaaaaaaaaaaaaaaaaaaaagaccattaaacctgatgcttcataagcaaggcaagtttatataggctgggagggagggtgtagggaataagaggcatcagaggtgacccatctggatgtactaggtttggggcagcccctggcctccctccgatccagctgggcagacttggctcggggttggcttaaggatcccattcttccaggtgtgaagaggcaggctgcgggggcttgctgcgacctcatgtcgtgtggtttggagaaaacctggatcctgccattctggaggaggttgacagagagctcgcccactgtgatttatgtctagtggtgggtcatgcccttccctaaccccaggacaggactggagtttgttattttttccttccccctctcctcttttccttcctccctcccttgcttctttccttcccgccttctctcctccctccatttcttcctttccttcaaatgtatgttgagaggtctttgtggtatcctatagaaaaactgagaaacaatgaataagaatttgtattaaaataggaaaccatgcatgtcttgggcatctcaaagcctcctcccccagccccaccaaaaacaaagaaaagaacatgctattggttttttaaataatacatgcttatgattaaatttaattgagaacatgcaaaaattatcacattataaagaggaaattagaaatcgcccatagttctgctatccagaaatagttaccgttagcagtttagtatgttttcttctagacccaggagtgagcaaacagcagcctttgggccacattgggcctgctacctgtttttggaaataaagttttattggaactcagccacactcattcttccacacactgtctatgactactttcaaactacaagtggcagagttgagtacttgtgacagagattgaatggcctgcaaagcctgaaaaatttactgtatggtcattttcagaataagtttgcccacctctggtctaaaccttttcttatgcagatgtacacgtattaattaaaattcaaaactgagttcatgacatatgttctgttttgaaactactttgttcacgcagcagttcacttagcatgttccatatcaatatgtctaaatcaatatcatctttcaattgactgtatggtgttatatatggataaggaatgatatatttagctaattctctactgtaagacatttgggctatttcaaattttgatagtttaatcaatgatatcgtgaatatccttagatagaaatcttagcatgctcttcaaatgatttccttaggacacatttcctaaaagtgggattcattggacagattgtatgcgtatttcaaatttttcttgacacgtctttaaaagcagaggcactttcttgtggtgcgtattcattcagccagtatttaaagaatgcttcccagtgttgagtatagtgccactgttgatgatggattgttaaatgagaaaagccggtttacaaaacaggtcatgctcttcccatccctgtaaagaatgtttataagcaaatatttataagagaaaacctaagaggacatacatgaaaatgttaacagtggttatcttgcggtaagattatggatgatatgtatgtttttttcttcgtattttctaccttaaacaaaaagatagaaaatatgttttaaaaagttatggatcatttgtttaactttaaaaagcagaaacaaaaccagaattaaccccaaaacatgttgattgagtcacttctatgtcactctttgcataactctccttttcatgtcacatattcttctcgattctagtgattgatcaaaggacacctcttcactttcccttgtcccttggacaccctgttttatcccatcctgtttggcttttctcacacctgcaaccacagacctgcctgagtttgtgtaaggttttctgaaataatgttccttctccttgtcgtctggctgtttgttcatctccgtgtacttgccttgtaggtgggcacttcctctgtggtgtacccagcagccatgtttgccccccaggtggctgccaggggcgtgccagtggctgaatttaacacggagaccaccccagctacgaacagattcaggtactgggataccctgatgggagagggagatgtgggaggcaggtacagacatggtcatctaaacatagttgacctactcctctaatttttaaaaaagacatagggtttgtgtttttttgtttgatctgcagttgcttttatggaagaacaaaatcattcactgtagactaaggtagggtagctctgtcattgtatgcgaaatttgccgtgggacttttgtttgttcacattttgaacgctcttcttggattccttaggctttgctttcccttacatttttaagctagacttagtgatgacctgtagttgtaggttacccaaatgctccgcaagtaagcctgggagacgcccttgcagaacctcatcacctgccgttcttactgggaggccacctggcagatacccctttggtctaatcgccaaggttatttgtatctgtggccatattatgacactgatcctgcttcccaagtttgggtgggaagtgtagattgtcatagtatgcatttttagtcttattcctgggtctgttttatttcttcatccatgttctgtcttttttctcaccccaacttttttttgcttttacctctaattcttgtccatctagttaattccttttgaataagttagaatataaataagtagtaaattaatataaatgaataaaatagaaaacttcattgaaccatcttgtcattactttaatcaacagtttccaaccttggctgcatattttaaaaatactgatgcctgggtgccacctcatgaaatttcgatgtcattgctctgagttgcagcccagacatcatcattttgataagcttcctaggtgattcctgtgtgcagccaggataggaaccactcttctaagtctttgctgggatttaaaaaaaaaaaagaaaaaagaaagaaaaggggccacagacacttcagtaggcccctcctcaagtgagtgaactggctctgagcctcttcttttccatgtgtctttttgatcagctacagcctgtgttcttgatccatagttcttcatctgtgtgtgagtagtaggaactaagaagatagccttaaaaaaaaattgcctcctatgcaaaacttatactctgaaaactacagaacattattgaaagaaataaggaaggcctaaatgaatggaaacatatccagtgttcatggattggacaacttaatatgattaagatggcaatgctccccaaattgatctatgggctcaatcaactcagtccctatcaaaatcacaactggcttttgacagcaattaattgaaaagattaatctaaaattcatatgaaaatgcaagggacccaaaatagccaaaacaaaatgaaaaatgaagttggagaactcatacttcccaatttcaaaacttactatgtattaactaggcatgatggcacatgcctgtaatcccagctacttgggaggctgaggcaggagaatcgcttgaacctgggagggggaggttgcagtgagccgagattgtgccattgcactccagcctgggcaacaagagtaaaactccgtctcaaaaaaaaaaaaaaacttactacaaagttgcagtaatcaagacagtgtggcactggcataggatagatatatagaatcagtggagtagaattgagagtccagtaaaaaacaaaacaaaacagaacaataaaacaaacctcacattcatggtcaactgatttttgaaaagagtggcaagacaatttgatgaaatacagtctttttcaagaaatagtgctggatacccacatgcaaaagaataagcttggacccctctgtcacaccattacaaaaaataacccaaaatggatcatagacctaaatgtaagagctaaaagtataaaatgtcaaaagaaaatgtaggagtaaatctttgtaaccttgggttaaagctttcttagatatgacaccaaaagagcaagtaacataagaaaaatggataaattggactttatcaaaatttaaaacttctgtattccaatgggtaccatcgattaagtaaaaagacaacccacaggccgggtgcggtggctcacgcctgtaatcccagcactttgggaggccgaggcaggtggatcatgaggtcaggagatcgagaccatcctggttaacacggtgaaaccccgtctctactaaaaatacaaaaaattagccgggcgtggtggtgggcgtctgtagtcccagctactcgggaggctgaggctggagaatggcgtgaacccgggaggtggagcttgcagtgagccgagatcgcgccactgcactccagcctgggcgacagagccagactccgtctcaaaaaaaaaaaaaaaaaaaagacaacccatagaatcggagaaaatatttgtaagtctaatatttgatatttgataagggatttgtatccaggatatataaagaactcttacaactataaataataaaaagacaatccaattaaaaaccaggtcaaaatatttgaaaagacatttctccaaatatatacacatggccaataagcatattgaaatgatgttcagtagcaaaaccacagtgagataccacttcacagccacaagcgtggctataatttttaagataaaggaaaatcacaagtgttggtgaggaaattggaaccctcatacatggctgatgagaatgtacaatggcgcagtcattttagaaaacaatgtggcatttaaatatagggttactatatgatctagcaattctactccttggtatatagtcctagaaatgaaatcatacatctacacaaaaatctgtacacaaatgttcatagcaacttgttaatggaaaaagtagaaacaacccaaacgtccatcgactgaaggatgaataaataaaatttggtatgtttgtacaatggactatattttagccataaaaagaacgagatatccatacatgctactacatggatgacccttgaaaacgttatgctaagtgaaagaagccagtcataaaagaccatatatggtatgacttcatttatacgaaatatctagaataggcagatcaatagagagaaggtagatgagtggttgttttggctgggagtagggaggaattgggagtgggtgctaatgagaacaagtttctttgaggttgttaaaaatgctctaaagttgattgtggtgatggttgtataattctgtgaatacactaaaagccactgaattatatatttgaaataggtggattgtatgtgaatcaaatctcaataaagctgttagataaaaagttaaatgatcttctaacttatctcctgaaaaatgcacattgagcctccgtctgatttgtgttgtggcacctatgtggagcagctgggccacttagcatgactaagcgtagtaataccggagctaggcagctcaagcctcctgtctgtttgaaagaccatcagaaaactcgaagagtgggacaggataaactttgtgaagcaggacctgagctatgtccccagtttggttcttctaatgtggtttcttttcagtcatttgatctccatctcatctctaattattataaagaattaaaacaagtcatcattgtagaaaagcaagaaaatgcagatagagaaaaagaagaaaataaaactggagtatttccacaacccaagtttagagttggcccccacctcccatgccatggactgagcagcaggggcccagcatcccttggatatggtggctgtgtcttcatgtgaaagaaactgaacttggtggtttttcctgccagttcaggagagattcttggcatgtaatatatatcactgctcaagtcaagcctcctaaaaccacagacctgtttcagctgctacttcagccaaaattcttcagcttcatattgtcttgaaaacctatgattgtctctaacaaacaggctacttgctagttagaaattcttatcaatttggcaagctacttatcaaccagactgaccacaagaactgtcatctcatcaatgaaggagtaactgatcaatgaagccagcaatgcttttttcttggcatcatcaaagctgacatttagaagagatgctggtgatagtcatctcatcctactcaatttttcaaaggcagaaaccaaccctggagcaattgagaggactgtttaaacacagagcttaacaatggcagaattgtatatctcgtgcttaacagattttggttgaactttaccctaggtcaggggtcagcaaactactgcctgtgggccaaatttgcccaccacctgtatctgtaaataaggtttcattggaacacagctgtggccatatgtttgtatattgtgtgtggctgcttttgcattaggatgacagaggtgaatagttgcaacagagactggctggtctgcaaagcctaaaatatgtcctgtgtggccctttacagaaaaagttttctaacccctgctctaggttacggagaaaaaaaaaatggaataatgttctctgctacttttaacctgattttctttgttacctaaataggcagctagaatgctgcctatattttaataaggatttggatctcacaagacaccttaggccttacacaagttgttcagattctttgccccagttctaatctagtgacaaaggcatagaattctcctcccacaggaatgtatttctattttcaaggtgttaattagttccagttttggttttgtcgttttccccatgtccgatgcttatattggatgatttctgataaaccctgactattccaataaaccctaggcatttttgaatttaaacctcagtgttttgactgttactcaaccccagggggccttggcttgtaggatttgtacattcgctgaggcaaaaatgggactgtcgctgcagggagctggtggccagggccttcaaagcacctttggcccactgtgccctgcagccactatgttgtgccctgttgatctttaaatttctctaaatgttggaatttaattaaagtccacaaatatttgtaagtatccactatgtatcagacacttttctaagtgcttaagataggatatatcagtaaacaaaacaaatatctaccaaggaaagattatattctagtggttgaggcagacaggtaagcagtgaacataaggtacacattctacagcacgtgagcaggtgctaagagactgcacaaagtaaagatgcacaaacctcattaagaagagattggagcaaagacttgaaggaggtgaaggaggcagccgaagacataatctgggataagagcttttcagacactgggaccacctggagcagaggcccctcagtgtggctggagtggagtgaggaagtcccaggagaggcgagcagtaaagtaatggagttgggggctctggggagggaagacacccaagctacctgctgttggagtttagaagtctaaggaattgttaggtagaagagttttatagattgttgtggttatatagttacctatctagggtgtgaagaggtcactgctttgaagcgatagttgaccgtgtgtgttagggaagtccagcgctctccctggctgtgctgtcaagggcgggtagggaagccctcctagtccatgcagtcagggcttagttggtctgttcattcaaaaagccactgaaaacaagactaatagaaaaggacacatacatactttaaacattttgatataaagcataaatctaccttcatttgctttttgtttgttttttgttttgttttgttttaagacagagtcttgctctgttgcccaggctggagtgcagtggcgcaatcttggtttactggaaactttgcctcccgggctcaagcagtcctcccacctaagcctcccgagtagctgggattacaggcgtgcaccaccacacctggctaatttttgtatttttagtagagacgggatttcaccatgttggtcagacaggtctcaaactcctggcctcaagagatccacctgccttagcctcccgaagtgctgggattacaggcgtgagccaacacacttggcctgcttttttttttttttttggaatagagctaaaggccttttgtttgagtagggatctgctgattggagctcacctttcttgtcgtatccataatcttcctcgtgttccccaaatacccctgaagatacgaatgactccagcccttattttataaaacaaaacagacaaccaggaaaatcagatcccaaggcccccacctagacttcctgaatcagaatttctagggggaagatgcctgtttatctgtgtagttagcaaatgacccaggtaattcttaccaagaaaccttggcaaacactggattacaacttctggtttttgatatttgtctgttttttttttttcttttaaaggagagcaagaacttaggaaaagaaacatgtgaagcagtcttcccccatcttttacacctacacctaatttaaccaaattatatttagtgactcagtatgtctttcccaagcattcaactagttttcctagaaataactctcttaacagctctatttttgcagtttattacgtaattttaaatgcagcaggatgattacattaaccaatgcaagtggcgtgagcagatgtgcagctaacactgtagtcgtggttgtcctacaactggtgggggccagcagagtgcacaggtgtgctagaaagaggctttcaaacactgttcatgtttgcctttcccattttaaaagttgacatctaaggttttttaaatcaaatatagttggagatgtgattccaagtgcattggaaacactgccattttatttgtttattgatgtttgagacagagtctggctctgttgcccaggctggactgcagtggcacgatctcgactcactgcaacctccgcctccctggttcaagcaattctcctgcctcagcctcccaagcagctaggactacaggcgtgcgccaccacacccagctaattttttgtattttttttttagtagagacgggttttcaccacattgcccaggctggtctcaaactactgacatcaggcaatctgcctagctcaagctcctaaaagtgctgggattacaggtgtgagccactgtgcctggccgaaacactgacattttaaaataaaaactaccatatcattgtttaaaatgtatccagtccaatctgaatgttataactatctggtacataccaccatccatttacaaaataaatatacaagcccttccttaacaattggaaactttgcattttttcttttctctttgaacttgtatttccattctatcactactacagaatttatactaatgtaatatatttttatgcatgaaaatcttttactggccaggtacaatggcttatgcctgtaatcccagcactttgggaggctgaggctggaggatcacttgaggccaggagttcaggaccagcctggccaacatggcgaaaccccatctctactaaaaatacaaaaactagccaggcgtggtggtccacacctgtaatcccggctacttgggaggctgaggtgggagaatcccttgagcctgggaggcagaagttgcagtgagccaagatcgtgccactgcactccggcctgggtgacacagtgagactctgtcttaaaaaaaaaaaaaaagagagagagaaagaaaatcttttactgactacctattatacttctacagcaaaatatcatatgaattatttaattttttcaatttccttaaaatgttaaaaaatgctttactaaaacatcttctagatagaattatcactaatctgcagtgcataattgtaaaaacaaaaaatacatataaatgtagattaataattccaaacaagtaaaattttattggattttttttttttttctttgagatggagttttgctcttgttgctcaggctggagtgcagggtgcagtctcagctcactgcaacctctgcctcccggattcaagcgattcttctgcctcagcctcctgagtagttgggatcacaggtgcctgccaccacgaccagctaatttttgtatttttagtagagacagggtttcaccatgttggccaggctggtctcaaactcctgacctcaagtgatttgcccacctcggtctcccaaagtgctggaattacaggcgtgagccactgctcctggcctggaaatatatccttaatagatgaatggggcataaacttttaattggtccatgtttctatggctgagtgttacctattgttggaaggagacagttcctcctgttctaacccaatcctcctgtagtcaccataaacaaaccggtattctgtcaagatcaggtttattgatttaatgcaatgagggagaccggacccccgtagaactgagaagtgtttcccaataagggaaaggtggagttattaaagcaattggggggagggtgaagtttaagtgaaatttgaatgaagtagtttttgatagactcaagcaactagcagggctgtacaatgtaaaggggtcaacatcatgtctggctggcaaagtaggccagggtcccacttccccagaaactataataccaagtttagatcaacgtggaatgttgtgtccagaaatcccttatctgaagctctgcacctgggttggaaatccaggctgcttctcagtatcaaagtgacttagatcctcaaggctagaggaatatttcattctttactgctataatttcaaatagcaatgtttccaatagtttataatattaaggaacaaaatccaaaagcagtagtcactcaaagaatggaattaagacattttgcagcttgtcctaggggaaaatatattgtttcctattaacttggcagctggctttacccgtgtcttttattctgatccaaagaatcgctgggcagattttgacctgccaagctaaattttactttttcaatgtcaattgtaatcttcagtgttgttttttatagatgtaagtactgaaagacctgggccacctaaactctgggcatgagggaattatttttttttaagagagggagctccctctgtcacccaggctggagtctgtacagtggtataatcataactcactgcagcttcaaactcctggctcaagtgatcctctcgcctcagcttccggagttgctgggactacaagctcgtgtcaccacgcatggttgtttttactgttacctttttgtagagacggggtcttgccatgttgcccagactggtcttgaactcctagcctcaagcgatcctcctgcctcagcctcccaaagtgctgggattctaggcatgagtcactatgcccagccatgaaagaaattttggtatagccttgccactccaattttggaccaccttccaagttgtatgccaaaatacacagagtaattttgtatcatacttagcgatctattcactgaaaatcctttccgaccctctttcaactttattgaaagcaagaatgaaaccagcctacttacatatgaaggtgtcagatctacaccagtattccagacgtccctctatttggtactccatatgtttcacactccctctatttcacactcggggatgaggtatcattgtaaaatttgggatgggtgaggggtccagcttgcttttgtaaggcggaagaaggctgaatgtggaaaggggcacttgaaatcacttaagaaagagaagaggtggaaattgaggatctgggaattccctacacgctccccatggctggcagtaattcctggataaccacatactggcctggaactttctggaagtcagtgctcagcacgtggcagggggcagacggactggagatgccgtgtagtctgggctgtccattaagtggcactctgttgatagaacaaagcatttgagggataaggcagtcactatttgtattgtatcaagaataaataatataaatgagttgcactgaggaaatgccttttctatttttaattgtgctcaactggttttcttttaataatgcatgaggaagtcctgcttttgcttcttattcatagtttttttaaacaaaagtccatgatttttcttcttttttctccttcctctttctcttttttctaactacacctcagaagctagtcagaaagttcaacaggtggtttgagaggctcgttgacttagctgagatcctagtggtcagatagtgcatgggtatttttttctcttgttctcagtactacctgtgaatgctgctgtaatgttttatgtgtgtgtgtgtatatatatatatatnnnnnnnnnnnnnnnnnnnnatctatcttttttcaaataataagaacacacatgaaatataagtgaggtgaattagagtatatttccttaaattaggaagcattggatttatcaaatctataaactatctccatgattgcatttaaaggaagctgcttaatgttccatggaatatatatgtcttcaatacaaatgggaaatatctaatttatatatatatatatatatatatatacacatacacatacacacacacatatatatacacacacatatatacacaaaaaagtatgtattgtgtctatatataacatgccaaacatacgtgttatatagatacacataaaacatatatatgtatataaaatacatatataacacacatacatgtatattttatacttacaatttcaatgagtttggcagtacagtcccaaaatacactttacttgcataggttctcaggatttgaaaaaaacaaacagaatacactttgtaatcatgtctcttacactttgaaataaaattcttctttatggcacataaattctagacatttgcttctcaaaattcccccagtcacagagcccagcccatagtgaagtgttataactagagttgttagaagctagttgaaagaagtgggcatggaaattcataataccatctttatgagaatttgggttttacttcggctattacttcagaaataagtgcttgctgaagtagggcattcattttgctaacctgtagttcaaaactgctgtatttgcttcttctctttcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagtaggtaatttattgtataaagacattaccccacgatatggctttattagggactttttttttttttttttgagacagagtttcactcttgttgcccaggctggagtgcagtggtgcgatctcagctcacagcaacctccgcctcccgggttcaagagattctcctgcctcagcctcatgagtagctgggattacaggtatgtgccaccacacccagctaattttgtatttttagtagagacggggtttctccatgttggtcaggctggtcttaaactctcgacttcaggtgatctgcccgcctcggcctcccaaagtgctgagattacgggcatgagccaccgcacccggcttactgggggctttttaaccttgtttggctacattacctcagtgaacaaggggaagctcacaacaggaactcacacaaagaaggaagagaacagtaccaacaaggtagaacatcacgatgagaagaaagaatgatgcaaatatgtggacccccaggataaacacagctgcccaaaatttagctctggcccccttagatgggggaagtcaacagtgaagtgtttctcagcatcataaaggcagaagctgtggttcctgtggggcctgccaaccgttcccagatgctgaactctgctgggagttttttccatgggactttaaaaaatgatgcccttaggttgggccagacctctgttaacttcagtagggatggcaccaggttcaagaggccaaagaagagacctggagctagtgaaggaaacatagggtttatttggggaatcttacagggtggtccagtggccgcgggctggacagaactgcaaccacttataaaaagcatgcagtttacatagcactttcactcagcaccctcccctcagcagcctccacgtggcaaccctcacttcttaagttattgctgtcagatgcatctgccatacagggtcattctcaggggatgcttaagttatttctgtcaggtacatcttccatacactttactaccttggagtaaagtagtaagaatacagctttttccttaacctttaccagctaactcagtgcttaggggccttggaatgcctgctgtccagcaggtgtcacaggcctgactgggaggcatggccattatcaacagtgtatgaaggtcacatatggctccctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattag

SEQ ID NO: 16057 - DNA, 60917 bp, Human; identical to SEQ ID NO: 12638

SEQ ID NO: 16058 - DNA, 41798 bp, Human
acctccccaaccccccttacttggcttaagtataaaagactccttgccttcccacatgaggtaggaaacgagagagagtatagcacactggaaactttttctcttaaaccaacagaaacatgggcaaatgttatgaacaggaaattcatggaagaggaaaactgattgaccgagaagctcaactatgctagtgaacagagaaaggcaaattaaaccaaacttaagacacaatctttgcactccagctcagcaaaagttaaaactacagatttagcaaagatattaacatatatgcatacattgtttgtgtgagtgaaaattgatggaggcttttaggaaagtgattttgaagtgtgtattaaaataaaaatgctgtatgccttgactccacaactgcacctgcttccaggtatctgtcctagaaaaataccagcagaaacactcaaatattcaagtgctggaatgtttatattgtattacttgtaactttttaaaaattgaaaacaacttgaatgtccattaaaaatgaataagtaaattaattataatacaagatgcaagaattcaatagaatacactaaactgatacgaaggtaagccttcaaagatattttgttaagcagaaaaaaagccacctaaaaattgtattaatgatatatataagtaggaaaatggaggaaaccagggatattaccttgtgtatatacatatgtagtctttttttttggtttggttttttgtttttgtttttgttttcttttgagacagggtcttgctctatcacccaggctggaatgcagtggcatgatcatggctcactgaagtcttaacctcctgggctcaagtgatcctcccacctcagcctccagagtagctagaactacaaggcatgcaccaccatccctggctttttaaaatttttcatagagatgggctcttgttatgttgcccacactggtctcgaactcctggactcaaacgatccttccacctcggcccaccgaattgctggtattacggtcatgagccagtgtaatatacagatgtcctgaatatttgatatatgtaaagaaatctgttcatataaacaagtgactcagaacctagattcactaatgcctagaatgctttttctatgcattagtgaatctagcccagtgtatatagactcgtttgtaaatgcatagaaaaaatgttcaaacaaactttttgggaaaaaacgtttcaaactgatgagggattacttttgaagaggggactggaactggatctgggggaagggaaatcaggtaggacttcagcatttacaatgagaatatgttgcatgtatgcttatacgtgattttacaaaataatttaaagtacaataaaatgagcagagttgctagatgtgatctttgagattcatctcaaatacagctttcaacatctatattgacagttagatttactaattctcagaagagcctatgagtgcatccatcattatcaaacagtatttgtcttgttaaggatagttctctataataactcacatctatatgtctaaaatactcacatctatatgtctgctcagacaataattatgaagtctttgctatacaggtttataagatcacacatccaattacgctttttagataataagccagacaaatttcagtacacagcaccttgacatcattatagtaattagctaattccagttgatatagtaatatgcataaagagaattgtaactaatattagctgaggagtaaatatttcattctgggaatagattctatacaatttaaattgcatcacatttaggtaactatttataaagtattatttaatgtatacagtttaaaacagattttcctttatggtacttattgttaagtcataatatgtgtgttcttgaatcacataacttatagttcttaaaagattaagtatagacattcgaaccataaatagcattacacaaatgttatttcattattttccctctttagtatctacatgaaaatgggattgtccatcgtgatctcaaaccagagaatcttctttatgcaactccagccccagatgcaccactcaaaatcggtgagaacatttcttcttgttttgtgaccccttttttcagagcagaaaaaattttactgtgtggaatttttaaatattgctccatccagttttacatccattcagttttcctgaataattgacatctgtaaaggaaataatatgttgttttggaagtttttgctctttcctggaatgtttatttggaaaatattgcttagaagttagtattctgttgctgggcacacaaaggaatcacagcttagaaatggcaaggaccacaggagatgaccttgtattttgtaaataagtttatagtgaacaaaatgatagaaaaagtaacacatcttttggagatattaacttttattccacagattgcttggagcttaattttaggtaataaagaactttgacataaaatatttagcacatattagtgagtctaggctttgagtcgcttgtttatatgaacagagataaattaagatctgcctttcccaaaatgcactccatagaacactggtttctcagcagggtagatgaggatgggagtgattcacagaaatgctatggctgatcaactaagttaggaaatgccaactttaaaaaagttaaacaagatttgtatttctgtaggactttccagaacctttaacctgttaacatataaatttacatattatatcatattctatgagacttttttaaaatttttaccaataagcattttgaaaaactataaaggtgaactttgggaaattctgatctacccaaagaaacctttaattagcactttagaaaaaaataaatgttactttccaagtatcttccaaagcaaatcttcatttcaaaaaatattgtaaactttattttcgatgaattctcactagtggaatcttcattaaatcctctgaagggcattgctcttctggtgccttccttatcgtgctaatctgcgaagttcactgcatttacagatgttaacacctttaacaattaagttgttcatatcagggaagagctcagataacataatgtgctttatgaatgcaagaacctaaggaaaaaatcctgaaagtcctgctgggcagccagcttgttctcataatcactcctgtaaggcaggggacagcaggcagtttccatttcctttcacatcactttcaaagatttaatccttaaagcaatttctttaaatggatggatagatactaatttaggcaggagaggttttctttctgaagggcttcctgctgcttccactgataaggatcaggcacctgccaggaaatgtgggtttatctttgaagtctaaaatggaattcattctgcacctgcctctcttgaagaatgcccttgaatggtttcctgatgtttcctgagtgcaagagatatagctcagcaaatagttcataatggtagcaactttcgataatcttttacctaggtaatattctgagaaataaataaaaaggattcttaccaaaaaaatcttatagtcttcttatgagagtaaattcttataagtgaaatacattggagactgaatgtattttcaagctgaacaaaccttttgatgtttctgttaattctcgtgtcactgatgaaagtctattttttttctcctctctgtcaataaattgaagattctggattatatcattaattctgtattgtcccttagagttactgttacataaatttcagaagtaacaacattagacaaaatataactattgcaactattactttaagaaaaaatagcttggctgggcgcgggggctcacgcctgtaatcccagcactttgggactgaggtgggtggatcacgaggtcaggagatcgagaccatcctggctaacacggtgaaactccgtctctactaaaaatacaaaaaaattagccgggtgtggtggcacgtgcctgtaatcccagctacttgggaggctgagtcagagaattgcttgaacccgggaggcagaggttacagtaagccgagatcacgccactgcactccagcctaggcaacagagcaagattctatctaaacaaacaaacaaacaaaaacaagaaagaaagaaaaaaattgcttatttgctgaaagcggggaattgtacagaagaacaaagattaaatatagatttatttgtaaatgtatttggaagtcatatttttctccaatttaaagaaacacatggattgttttctttagcttcctgttgggtgacttgttcccacccaccttcaccccatcatcaaatacaaaagaaagcaaatagataaataagttagttttatttttgaataacaaatattttgtcataaaagctgagaagacgtgcttcattaaatttttttcttgtgttattagctgattttggactctctaaaattgtggaacatcaagtgctcatgaagacagtatgtggaaccccagggtactgcggtatgctctttaataattatattttacttttattgttatttgaaatgtatttttgtttagcaatctcatttttaaaaattcctaatatttctatttataaatgcttaaaatttgttgcaaatctctatgaggaaggcatacataaataatactcagatcacttcttgttttctatgagaggttcaaggatgttggttttagggcactgctgttagaatgcctttgagccagtggctactcttagacccactgggcagcagaaagaccatcaccacagagggcaaggaaacaccatcgtttatagttggaattaaatccatgggccctttgtcacttttctttgcttttccttggatggagagtgtgtgtttaattcagatggcatataggacgatggtgagaatggggtggtccctagttctttccatggcctggcctagcctcactaagacaaggacttcaggtgagattttcctagaagagttctccagtccctgcagatggaccacaactacgttgagctcttcacatcttcccgcctcatcgcccagagtgggctgaaggcattgcaatcagaaagaacaaaagcttttgacccatactagcataaaacctgctctgtttttcttgatggtcaaattaatttggcaacaacttgaaagccaataaagtttgtaaaaattatcaagaattcctaaaattgttgtgattattgaatatgtcacagatcaattaaaattctaatctaaattataaagaaaaaagacaagatttcaagttatcaatcacaagattagtgatccttttctcttagatcagaatatttttacacaggccaggtgtggtggctcatgcctataatcccagcactttgggaggccaaggtagacgggtcacttgaggtcaggagttcaaagctagcctggctaacatggtaaaaccctatctctactaaaaaaaaataaataaaataaaaattagccaggtatgatggtgcacaccataatccccagctagctcctcaggaagctgagacaggagaatccctagaacccaggaggcggaggttgcagtgagccaagatcgcaccactgcactacagcctgggcgacagagactccatctctaaaaacaaaaacaaagagaatatttttacacaaatgtcctttatttcaattcatctcttcagtgaactgttaatcacctactgtgtagtcaagccagtgtgtggcaccagggagatgcttttcctgcccttacacccacactgggggctcacaatctacaagaaaacagacatgtggccagatgcggtggctcatgcctataatcccagcactttcggaggccgaggtgggtggatcacctggggtcaggagtttgggaccagcctggccaacatggtgaaaccccgtctctactaaaaatgcaaaaaataacccggcatggtggcaggtgcctgtaatcccagcgactcaggaggctgaggcagtagaatcccttgcacctgggaggtagaggttacagtgaagcaagattgcaccattgcactccagtctgggtgacaagagtgaaactccatctcaaaaataaaaggaaaaatccagaaatgcaaaccaagaaattatagcgtcttaagaaatattgtgttgtatgtatcgaaagccaccatggaaacatagaagaagggtgatattttgaattatctgtcttgttttctatagcgcttatatttgaggtcacccctgccccagaaatagacaaagaagtactacaaaactaactccttttaacaacttttgaaatcataaaaatcagataggcgaagtgcgataatatattcattgaagcatatatgtgattaaatccatagaattttagtgctggaaggaactttaaagttcatttattaacattctaatcttattaagttcagagactttgacttcaccaagattccacatctagttgttagtggctcaggaataagaatccaggtatccaagggcctaaaaatcatagaatttccctgtactatagggaaatttatatatttataaaactataaatcaatatagttttattcatagaagtatttatcaattattgcttttattttaaaatcttcattttaatatatatatattttttgagacagatctcggcttatagtaacctttgcctcccgggttcaattgattctcattcctcagcctcccaagtagctgggattccaccacacccagctaatttgttgtatttttagtacagatggggtttcgctatgttggccaggctggtctcgaactccaggcctgaagtgatcctccagcctcggcctcccaaagtgctgggattacaggcatgagccaccatgtccagctcattttaattttttatacctcaaaagtattacttggccaggtgcagtggctcatgcctataatctcagcacttcgggaggctgaaatgagaggattgcttgagggtcagaattcaagacgagcctggccaacatggtgaaaaaaaaaacaacaacaaaataattagctgggcatgttggcatgtacctgttgtcctagttactcaggaggctgaggcaggaggattgtttgagcccaggagttagaggctgcagtgagctatgattttactactgcattccagcctgggcaataaaaggaaacctggtctcagggaaaagaaaaagtattccttggtcattggcagaaataaaaatccaaataactatactcaatattaacagcctcctgtgcattctcttgtactcttctatgtctccttgtccatctaagcattttataatattgttttaatgagttagtattaattctggatggagagttcttagaaggaacattttaggtagacatgaaggatgagtaagagttcaacaagtgaagaagtggccacagggcattctttgtcagtgggtacagggagagcaaagtcatggaggattggcagcatctggtgagtttaggtgctgtttgtcactttgtcaactttgtatgactagaacatagagtttttggtacagagggcacaaatggacttagaaaggtcggatggaccatgtgtttaaagaatctatacatcaggctaagggattcagatttgacttggtaggtaatggtgatccagcaaaggtttttaatcaaggcaatatttttaaatcaggtctgtattttgtaaatatcttgatgataacattatgacatattatgacatgaatttaagggggaaagggatagaaagaaaacagacaaattagctattgtaaatgctcttttctaccactctcatgtcagaaatctacacacatgctcatgtccttccttagcttctcagcagatgacatgttcaatctattcttaaatctatctacttttttaaaatatttaaaaattgtaaaaatactgttttaatatattgtcctttccataaacaggcccttcatacaaataatgccatcttataatggaggcttattttctattattattttctcttgcaaatatccgtttcagcctagatggtaaataacgaggaaacagaaataagaggttgaaagtgaccaggataattctactataggtagtggcttatcaggaaaaagtagtttgccatattataagaaaaggaagtgaaagcagcaaggaagcttggcatgggggttggaaggtagactctacttaccttagtgaactattttggggattgagatggaaaataaaagtgtttttttggctctaaagtgctaaacatagaaatgtaattactattatataggcgggggcagtcttggaagtcaaaaacaagtaagtttaacatatttctttagcagacaaaggttccatttctatgtaagtaaatacatatgtgttcatacatactcttgacccaaaggaaatacactaaaatattacctcacaatgggagccaaagagggggtaggattttaaggatacacctgtgtgtggtaacataggaaacattggaaaacacttgggaaaaacagaagtcacagtaatactagggcccaggagtagataacctagagcagaggcaatatctagggttttgaattaaatacaaattttaatctagttatgaatatttgtttcatctatcttataaaaaattaaattgttaacaggtaaagctaaaaccctctctgaagatcagttctagccctttcttccctcaccacagatagatactctcatcagtctggcatgtatctttctgagaataagttggtggggaggaaactgtccatttatagaaggagttggaaatgagagccaagctcaagactggtgagaatcattatgattctatagaaagcaaagaatttacgcagagactgttttatattcttttatggccacaagaggagacagaggagagcctcaggaaaaaaaaagaaaagtgtattaaacttacatatcctagagacaggaggcacagcaagccacccagggccacgcaggaaagaagacaccagggtggtcaggaggcagaagacaggagaaagggaaagtttagactactgccttttggggtattttcttgggaaaggcaaggcaaggcagggtgaacagtttaggattgcctagtttgaataatttgtgtgggttgcctggctcctggctcttggccctgggatgattaaggcagaggaatatcccctcctggggtgtgtaggtcagatggatgaggtatggcactggactggttaatcggtatgtgaaaggcatgctccaggctggacgctttcttatctttcagaattaacaagccacaggagagacaggctctctgcaaccagaaaagctttttaagatgtcaaaaacatcataatatatataaagaaaaatttaaaatatttacaatacagagactttactttgaacttgaaaaagtgtctgacacccatataattgacagagatgagatgcgagcttgtttcgttgcttgttaggatgattatatccaaggtcgattatccttaagtgcactgtgtctagtttctacttttaatggaaggcttttcaaattacatcttgtgagagactgggtgtttatgttataccatctgtcatttctcaggaagtaaaaaaggaaaagccatccattctgtctctttcatagaacccttgccccaggctattaataaacagggctctcctataagtgaatcgcaaaagaaaaatcacagatgcttcatgtttaagcaaatactcattatttccttggaaatgtgcccagtcaaaaccaaactccaggccagaaaattaaaatttatggtccagataagtgaaatcaatgattagtgttcaaaaataacccatgaagagttcagtgttgaagggattctcaacatcttgtggatgagaaaataagtaggtcacacagacaaaaaaaaaaaaaaaaagaaaaaatcgatcaggccatagctcctaataaatgtgctacaatataactatacaatattaactgccaaaatgttttaactggtctagatatttaaggcttgaagtttgtggatgtttcaaacccacccacgccaatcctagaaaagaaaatcaagttgttagagtagaaaagaaaccactatgttaagggcttaggtaaaaaaaaaattatatctaatacgaattatctaatttattcataagcttaagtatgttcatatttcatatttgtacttgtctttattcaaattctattttcagagtctacaagctgttaggagtttgttttcttttggcatttgccaaggtctcattagttctgagacagtcctactggcataactcagaggaagtattaatacataaaaatgtcccatgtgctaagcctctaagcataacagtgttttgctattttcaggctttagtaatggcaaatatatattgtgcttctatttaagccaaaatgaaggctaattattaacaattgaagaatgagttcctacgatatgcagaaatccctgtacttagagtctgcaggtgcctaattctacaaataatattgtagaataataatattctacaataatattctgagtttccataaagaaggaatacatatatttcatatatactatgactgattcagtcttaaaaactctcattgcttggtaaccaattaattctgtcataattatcaataattataaatggaggtggtataataaagagatgattaaatgtggcacttcagctattgaatgtgaaggcatgatgaaagtgtagaatgacaggtaaaagagagagtccctcaccttccagctcttaaaactatccttgaatgatacctcccaaaggatcagcaaatagtgatgggctaacaaaagtcagtgtcaccaacctgatgttcagtattaaaaccacacatatattgctcatctaccctaaggcgtggtaggtctccatagatatatgggtgactacagggatgggctggccatatttggccctgtttacctgatgctcacaggcatagattgctggttgttgttgctgttgtggtattgttgttgttcatgttttcatgctttactaggcttggaagtcagatggctgttcctacttcaggcttgaccttgaatatgttagtgaaaccctctaaatctcagtctcctcaactatacaatgggaataataagaacacttatttcacagggctattataaagaataaataagataatgtatgtgaagttcttgcacagtacctggtaactaaaacatgtaatgaatgttaggcattactaaagtcattataatgaatatcatcatcctcatcttttcttattactgttaaaaatgtatcaattccttttattatgcagtatgatttttccattttgtcctcacaagagtaagtcctaatattcggggagttggtttgaggtctttgaaattactacatctctgccacagttctttagtttagaaataaaaacactcattaaaaaaaaatttctcggccgggcgcggtggctcacgactgtaatcccagcactttgggaggccgaggcgggtggatcatgaggtcaggagatcgagaccctcctggctaaccccgtctcttctaaaaatacaaaaaattagccgggcatggtggcgagcacctgtagtcccagctactccggaggctgaggcaggagaatggcgtgaacccaggaggcggggcttgcagtgagccgagatagcgccactgcactccagcctcggcgacagagcgagactccatctcaaaaaataaaaataaaaataaaaatttccccctaagatttaaatgacattgatggttctaaactttattgtttatggccatttttaaatagttttttagatttttaaacttactaaatatgaatgtgatagttcctgagaatggagagtggttttaatagggtaaaccattaaaaaaaaaggtagagaaaagaaatggaatctttttaaagactactggttttccaaatagtagttttagaaattttggtatttttactaggtaaatatgacacttcctactgggtaagtatgaagttacactgaaaaatgtatccttctgtgtaacttaatatatacctacttaaaattattattccaaaattggaaatgattggacaaaagatgggatttgttccttagttttgatgactacaggaagacaaagtctcctcagtgatcagacactgaatgaaacaggagatatgctgaagttcactgagtcagttccagcatctgatctgtcagtgccacttttgtgctgggagttcactgcattgtatttatttatggaggtcaatgagctgctcagagatgacactgtgctctgacagcctttatcaggggaattcaagtttctttggatagctatgggactatgagtttctgaaatttttacaaccacagaaaaaatgaaggatattttaacttaatattttaataggttaaaaggataaatttaagagtactttattaaaaataaacaataatcttctcttcctcacacacacacattatgcagagccattttcaagaatccaggaactaaaaagcttttaaataggaataatttctagggagcttattggaacatatcaagcagaccttacatttgaacatgtcctatgaatattaccattgaaagtatttcttaaaatgctattaacagaacagtttctaagatgacacaacacaattaagcaagtcttgtcttccattagtgcccattcatgatttcaaggatgattccacacacttgccacattgctactttgaaaagaaataacccattagattcactatgccaaaatttaagacaaattttcaacagcttatagttgaacagaagagatctctgcttaactcttaacaaaacagaaagttgggttagccaataagctacattttctctaacatgaacacatatgaaaaatgtaggaaaacttaaataaaagaaatacatctcataatctaaaatagaaacttttagtatagtttcacaaaaggcatagtgtttgtgttcatttccagaagaataaatagcttaagtgaaataataagagtcttaaattatactgcaatccaatcaagtaaaggacgatctcacccaagaatgaattaaatacccaaagtggcaacttcatttttacaatgaacttttaaaaaatctagttaattaaatgcatggtaaaattccagttgcactgactgtaactttctacttgaccggctcgtgtgctgcacactagggttcctgtgtggcttttggacaatgggaaaacgaccatcagggaaggggagaggaagtgaggcagagaatgctaaccaggtgtggagggtaccccatatccatctcccctcctgaccatagccctactttctccctaaggagattgtgtccccaagccgtcatataactgccacaggcatgcttgcagcatctgagtcagttgagtagtgccaggtaaaggaaaagtagggacagatacagggtggcgaggaagggtcatccagagctcatcttgttcttgatcatggagaggaaagggactctgcaggttgggcatgagcttagtttaagctgtgttagaagtttgaaatctgaagaaaactgcgtctttggagtctttatattggtttcgtactgccctgaacaaagcggtttctctggaactttagttgtgtaaaacaatcaggttttttgtcatttattaaatatttgttgtgcttctatgcactaggcactgttgtatgttgtaaagacatagcagtaaaaaccagaccaaaagaactcttccttaagtatactgtaatacattttagtgggagaagacaacaatacacatgtaaaatatacagaaagaggtgataatttcccatagaaattataatataaagttggaaaaggagcctgggttacagtttaaacaaggtaattaaggaaggctttgtgttagaatggaatatataagcaaaaatttgagagaggagagagcaaaccacatacatacctagtgaaagaatgttctaggtgaaggggatggggcacactaatcctgaggcaagaacacaccaggtgtctttaaagtccaccaagaaggttagttggttgattggaatgcagtgacaagggcagaaaatagtagataggagaggggataactaacaactgagggaatggagttaacatttcctgagatgggaagacatcggagcatcaggcttgggacttgttaatttctacatgtctgttagatatccaagtggaagtgacatgtgggcagaagggaatatatggtccacatgtcaacttggctactggtatcaatgtgggtgttaccagcatatagacggtatttcaagtcatgagactatcaggcatccccaaggcagaaaaggagacaacccagactaatgcttcagcaacaccatcattagtaggccagagagaagagaaggaacatttattatttacagaaattcaaatagtagaggaagctccacaaggcagaagtaggaattgtgatggatgttgcaaggcacagatttctggctcaatatacaagacaacattctaacaactaaagctgtcggcaatagtaagggctatctccttggtttgggagtgttcacaaaagctgattgactcatcactcaggatccaaggctatcagcaaggaaagagaaggaagactcctgttaagttttatatcacccattaggtacatagtgtgtggtaataaataatatcaccaaaaactgcctatatactctatacatgtaaactaagttgaggattttggcaaccacttacttaaatcaaagttaaccaaatatattttggattgagatggttgataaaatcgaatctcaagagattgtccccagtgtcctctcctgacttctcatgttctctttgagtttagagacagtcttttttttttttttttttttttttttgagacggagcctcgctgtgtcacccaggctggagtgcagtggcttgatctccgctcactgcatcactgcaagctccgcctctcgggttcacgccattctcctgcctcagcctcccaagtagctgggactacaggtgcccgagacagtcttttaatgtaatggtaatccttaacttctgggtctccagaccataaatcatttttgatgcccacttcagaagacactacttcgagaacagaaccaactgtgccagagaattcacagttctgtgaggattcaactctattattatatatgtgggggtgggatgatgggaggaaaagaggtcaaaaggaagaggtgattgatagcaagtgggtagaagatttgcttaaaatgtcttattttggaccagaacacccacaaaatgttccactttaaaatgttattacagaaaggatatgcataaaataaaaataaaaagttttgcaagaattattattgattatcatcagtgagaaggtttatatctccgttagagaaaaacataatgtttttcttttcttttcttttcttttttctttttttttttttttgaggcagagtctcactcattcccccatgctggagtgcagtggtgcaatcgatcttggctcactgcaacctccacctcccaggttcaagcaattctcctgcctcagcctcctgagtagctgggaccacaagcgcacactgccacaccgggctaattttttgtattttagtagagacggggtttcaccgtgttgcccaggctggtcttgaactcctgagctcagacaatccacccaccttgtaatatttttcacacttaacacgagacactttaaattctaagtccattactttatctttgcacctccatctactgaagatatttttatgtaattttaatattaggatgagataggtttatttattttatcctacttcatcccacgaaaattgaaaggtagcttttcaacagttaataccactttgctggcatccatcacaactctgaagtgacctggagactcggtctgattcagagttggagaaaatggcaatgacttcaagataggaaggctcaatggaatttcacagaaaagcaaatttcacagggcaataaaaataagttgtatttttttttccttttttgaaagcactaggtattctcaaatatttgattttctcttcaggatattatttaaaaataaaaaataagatgagggaaataaacagactattttcactcatttattagatttatacaaagagaaaatcatataattcttgcggtaaggaagacttttttaacagcttaaatgaaaaacatgaagtgggagttggattgactgataattgcagtgcaaaaaatcaagagccctggaggaaggaaagagtgagttagaacataaagtatatcacttgtgtttcaaaacacctaactttttcttttctcactccactcaagtcacagaaaactaaaatgacaaaagccccaaatacgttctcagtccttctcaacctttcagagcatggcacgcatagaattgagaatattctgagattcactgtagtaagctgacaaggcagcttctagccagaggcaaccccctctggaagtctcaggtgtgattcagtctcatctgcacctttgtcactgcacttaatctcctgaactggggcattatctttttatcaaatcaaaaattgcaccaagttttaaacaggttgtgctcctttcttagcaaatgtagatgacagctaaacaaaggaccgcacaaagtacagatgctgagaaaatcacccagtgtggagtctgcccaactgtgggcactgctgccgcccataggcagctgcctcaagtgcattcttctcctctgggttcctaggccaagctaggaaaaggatagaggcagagaatttcctaacactgcttttcagcctccctagataaatcccctccacccttcactcttctccctcctccctcctccttcccagaggcacagtttagagagactctagatgctgggctcaagatacagtggatttttgtggctcgcagaaaacactgaattcaaaacaagcctctatagtaaaaaaaaaaaaaaaaaaaaaaaaaaaatcccagcatttgcccctagctctaatagggacaataattctggaaagtcaggttcaggcttttagatgcaaatagatcttttcccatatgttttgaattgctaaaacagaaagagtggaaagaattttgaaacaaacaagacccctgacctactggatcttcagtctggcctctacctgcctcacaggcactgctcatcccacctaggcatggctggatacttgagccatgctccagccatgttggcttctttcagttcctccagtgccccttgcttcttcctgccacagggtctttgcataactttttccacttgcaagtctattctcttttccttcaacctcttccccatttgcctaattaacttctctagatcctctacatctcagttcaaactttctttgcaccagtcacattcgctgacctctgtgaccaggccaaccccgtactaaaaatattcttcctccaagcatttccagttatcactttgcatttcttcctttgatgtttttgatttatgtctacatcccccacctaactgtaagctcctagatgaaaaagacttgttctctttaacctgctcattattcccctagcacctccaagtatagttggcccatcacacagcaggtgcttaataaatatttgatgatttctttaatgagtgagtgaatgaacctgttgatttcattcaccttagtctccctcaaattttttccaaaagagttactaatagtgtgaaagctcttctgatgaagaatgccactctgtagttttaactcagtaagtaagaaagaatcataaaactcaactagggcattgacaaaatgaaagtacagtcaatgaccaaaatcgtcccttttaatttttcttctaggaatttaagaaaagaaggcaaatttagcaccagtggtccctgtaagtgagccctaggccatatctgatgctttttattttaggatcatttccaaaactagttacaatgattttatttgataaagtgaaattcatcccaatctctagagggatactcagtctctaaatgtttcaatggtgccatcatcttatttttaaaaagagtcacacttagacctagatggtatgttaatgaatatataatataaggtttgaatttttgtgtaatttttatatttagttaaactttctgttttaaaaaggaagtctggcatcttgagaattctaagaccgtttaccaaacttattctgcattgaagattggagtatgaggttttgtgggagcttggtatcatttagtgttttatgagcaataacatgaatggtaagataattttaggaagtggtagacagattggattcacttggaacacagccagaaaaatcaataaatgattatttactaattcagaaaagatgatgattctaagtcttttaaaatgcatttttaaaaactgttttacaaatcagcaagaaaaaaaagggcgcaaagggcatgaatagacaatgctcaaaagaagatatacaaatgggagagaatccacagaccctctgtataggaagcagattgttcctgcaggccccaggagacaaccgaaaaactctgaagacaaaggacataacctcttgggagctctaggctctacctaccacctgatcctccctgtactaccacagctgatgctctcttgaaagtgccacctcctggcaggaggccaaccaacacaaaacactgcaataaacaaatctacaactaaggaccctcacagagtccatttcactttcctgccacctccactggagcaggtgctgctatacatggctgagagacctgaagatggtttacaccacaagactctgtgtagacaccccccactaccagcccagaccccagcagctccactgggtggctagatccagaagattaataacaagcactgcagtttgcctttcgggaagccacatccctagaggaagggggagagcacagcatcaagggagtatagtgtgggacaaaagaatcagaatagcagccttttagccccacatcttccctctgacatagtccacccaaatgagaaggaaccagaaaaacaattctggtaatatgacaaaaaaaggttctttcacactctcaaaagatccccctagcttaccggcaatggatccaaaccaaaaagaaatccctgaattggcagaaaaaaaattcagcaggtcggtcattaagctaatcaaggagacaccagagaaaggtgaagtccaattaaatgaaataaaaaaaatgagatatgaagggaaaaatcttcagggaaatagcataaataaaaaaacaatcacaacttctggaaatgacggacacatttagagaaatgcaaaatgcactggaaagtctcagcgatagacctgaacaagcagaagaaagagcttcagagctcgaagacaaagtttttggattaacccaattcagtaaagacgaaaaaaagaatttaaaaaaatgaaaaaagcctccaagaggtttggggttatgttaaatgaacaaacctaaaaataatggatgtttctaaggaagaagaaaaatctaaaaatgtggaaaacatatttgtgggaatagttgaggaaaacttccctggccttgctagagatctagacatacaagtacaggaagctcaaagaatacctgggaaatttattgcataaagatcaacacccaggcacagagtcataaggttatctaaagtcaagacagaggaaataatcttaagagccatgtattctatggaagtgggcatcgaaaatgatttatagtctagggacccagaagttaaggattaccgttacattaaaagactgtatctaaactcaaagagaacacgagaagtcaagagaggacagtggggacaatctcttgagatttgattttatcagccatctcaagccaaaatatatttggttaactttgatttaagtaagtggttgccataatcctcaacttagtttacatgtatagaatacatagacagttttctggtgatattatttaataccacacactatgtatctaatgggtgatataaaaaacttaacaggagtcttccttctctttctttgctgatagccttggatcctgagtgatgagtcaatcggctttgtgaacactcccaaaccaaggagacagcccctactattgctgacagctttagttgttagaatattgtcccgtatattgagccagacatctgtgccttgcaacatccattcacaattcctaattctgccctgtggagtttcctctactgtttgaatttctgtaaataataaatcttccttttcttctctctggcctactaatgatggtgttgcctaaggatcactccgggttgcacttaaggcagtgctaggaggcaaattcatagccttaaatccctacatcaaaaagtctgaaagagcacaaatagacaatctaaggtcaaaccccaaggaactagagaaacaagaacaaacccaactcaacccaagcagaagaaaagaaataactaagataagagcagagctaaatgaaatggaaacaaaccaaaaaaattacaaaaaataaatgaaactaaaagctggttctttaaaataataattaaaaaagataaccattagcaagatagaccaagaaaagaagagagaagatccaaataagctcaattggaaacacaacaggagatactacaaccaataccacagaaatgcaaaagatcattcagggctactatgaacacctttatgtgcatgaactaggaaacctagaggagatgcataaattcctggaaatataccaccctcttagattaaaccaggaagaaatagaaactctgaacagaccaataagaagcagcaagattgaaatggtaattttagaaattgccaacaaaaaagtccaagaccagatggattcacagctgaattctatcaaacattcaaagaagaattgggaccaatcctattgacactattccaaaagataaagagggaatcctccctaaatcattctatgaagccagtatcaccctaatatcaaaaccaggaaaggacataaccaaaaagaaaactatagatcaatattcctgatgaatatagaagaaaacatccttaacaaaataccagctaacctaattcaacagcatatcaaaaagataatccaccatgatcaagtgggtttcataccagggatgcagggatggtttaacatatgcaagtcaataaatgtgatacaccacataaacagaattaaaaacaaaaatcacatgatcatctcaatagactcaggaaaagcatctgacaaaatccagcaatgctttatgattaaaaccatcagcaaaatcagcatagaagggtcgtacctttacataataagactcatctatgacaaacccaaagctaacataataccgaatggggaaaagttgaaagcattccccctgagaactggagcaggacaaagatgcccactgtcacaacttctattcatcatagtactggaagtcctagccagagcaatcagacaagagaaagaaataaaaggtatccaaatcggtaatgaggaagtcaaactgtcagtttgctggtgatatcattgcatacctacaaaaccctaaagactcctgcaaaaagctcctagatctgataaatgaattcagcaaaatttcaggatacaaaattaatgtacacaaatcagtagctctgcgatacaccaacagcaaacaagatgagaatcaaataaagaacccaaccccttttacaatagcagcaaaaaattaaaatacttaggaacaaacctagccaaggacatgaaagacctctctacaaggaattctataaaacactgctgaaggaaattatagatgacacaaatgggacatgtcccatgctcatggatgagtagaatcaatattgtgaaaatgaccacattgtcaaagcaatctacaaattcaatacaattcccatcaaaataccaccatcatttatcacagagttagaaaaaaactgttctaaaattcatatggaaccacaaaagagcctgcatagccaaagcaagactaagcaaaaagaacaaatctggaggcatcacattatctgactttatactgtaaggccttagtcaccaaaacaacatggtactggtataaaaataggcacatagctcgatggaacagaatagagaacccagaaataaagtgaaatacttgcagtcactgatctttgacaaagcaaacaaaaacaaagcggggaaaggataccctattcgacaaatggtgatgggataattggcaagccacatgtatatgaatgaaactggatcctcatccctcaccttatacaaaaatcaactcaagatggaagaaggacttaaatctaagacctaacaccataaaaattatagaagataaatcagaaaaaccatcctgtaaattagcttaggcaaagacttcatgaccaagaacccaaaagcaaatgcaactttgtttttacaaagataaatagatggacttaattaaactaaaaagcttctgcatagcaaaaaaaaaaaaaaaaaaaaaaaagcagagtaaacagacaacccacagagtgggagaaaatcttcacaatctatacatctgacaaaagactaatatccagaatctacaaggaactcatacagatcagcaagaggaaaacaaacaatcccatcaaaaagtggactaaggacatgaatggacaattctcaaaagaagatatacaaatggctaacaaacatatgaaaaaaatgcctaacatcactaatgatcagggaattgcaaatcaacaccgcaatgcaatgccaccttactcctgcaagaatggctataatcaaaaaatcaaaaaataatacatgttggtgtggatgtggtgaaaggggaacacttttacgctgttgatgggaatgtaaactagtacaaccactatggaaaacagtgtggagattccttaaataactaaaagtagaactaccgtttgatccagcaatcccactactggatatctactcagaggaaaagaagtcatgtgaaaaagaaacttgcccaaatggctatcaatcagtgagttcgtaaagaaattgtcacacacacacacacacacacacacacacacacacaccatggaatactactcagccataaaaaggagtgaaataatgacatttgcagcaacctggatggagttagagaccattattgtaagtgaagtaactcaggaatggaaaaccaaacatcatatgttctccctcataagtgggagataagcatttgaatgcaaaggcatacaaatgatacaaatggactttggagactcaggggaaagggtgggagtggggtgagggataaaaaactacacattgggtacagtgtacaatgctcaggtgatgggtacaccaaaatctcagaaatccccactaaagaaattttcaatgtgaccaaacacctcctattttcccaaaactactggaataaaaataaaaatatcaagaaaactgttttataccttaaagtgattttcttctattttgtttgttttgataatgaggtgagaaaagatatgaaggacagccagagtgcttataccattaaaagatacattaattgatgttttttcttgaactaaattgaaagtagccaactttcttgccctaagaagatcacaaattattagaattacctgcaaggacatttgatacttaggagacttgaagctggggtgctagagcctgaactttattgtaaaaattcttctggctcttggaaaaggcctgtctagattgctagagtgtgttctactggttctgaacaaagtcaatgccatattaactagtaatttaaaatattaagctgggtactgtggctcatgcctgtaattccagcactttgggaggccgaggcgggtggatcacaacgtcaggagttcgagcccagcctgaccaacatggtgaaaccccatctctattaaaaatacaaaaattagctgggtgtggtggcacctgcctgtaatcacagctactcaggaggcagaggcaagagaatcgcttgaacccaggaggcagaggttgcagtgagctgagatcgtgccgctgtactccagcctgggtgacagagcgagattctgtcccaacaacaacaacaaaaattagctgggcatggtggcaagcacctgtaatcccagctactcaggaggctgaggcacgagaagcgcttgaacccaggaggcggaggttgcagtgagcagagatcgtgccattgggctctagtctgggcaacaagagtgaaactccatctcaaaaaaaaaaaaaaaaaaaaaaaaaaaaatatatatatatatatatatatatatatatatatttgaaagttattgaaaataatatctaattgtgtctaggtgttttgactttgtttcaccccatttttttatgattttcaaaataagttattttaaaaacaattatttttaagatgaatttattatggatggcataaacattttttattccttttgtctgttaacttcactgtgggacatttaactttttacatggcaagtttactcacattgcagtacagtgcttcacaaagaaataaattgcctttggagagtaaggttacacccagtgctgcgacagatcagaacttgccatgtcaggtatgaaactcagactccctgtatagtggatccaaaaagcagtttgtgacacactattcattttccttagagttctttggctgggagctattagcagtgcctagagaaaacatctgacccttgccagtatgtgtctctggcctgcacggggtgggagggttgatttcactagagccaacaggatgagtccccatagggcagcatacacagtagctgttgtagcagaagaaatgagaaatgcaacaggtctgcaggttagaatgcttgttcttgtcctctcttcttgttgaatgatcagtaacacatcctttactaataatataatgggtagcaggttaaaactcaaagttaacttggaaatcagctatttggattcatttacagtttagaggtaaaaaaccaagatccagaaaatataaaagactctctcaacatatttctatatttatgtttaaatgtcagtatggggcttgatagcatttcagactgaataagattcactgatgtgaagacctgcatggagaaggactaatgcaagtggaatatgcatgctcaatatgtgtgcattcggctccttgactggaacatctcctagagacaaaaataggcaatagcagccttcctgcaatggcagcataatctgagttcccctttacaagggaaagttcactgtcagggctgttgtgctcaaagacactttctgtggggtacagattgccccagagaatgaaagctaacctgacagagtgaatgatggtagttcgtatcagccatgcatgtttcttaattttgttaattaaaccttaaaagaaaagttttctaggaataattcatctgtagattaaaaaaagctttttggctacagatacagttccttaaagggtgcatcttgctgaattgctgtgtagagtgctagaatgcacaccttcctttcaccatacaggttctttatctcatatagggagcacttcaaaaagtttgtcaaaaaatggtgaaaatgatgaaaaatataaactttatatctcaacataaactgcatcaaggtcaagagacttttgtaagtgataacagcagccatttagtctatccctagagaactgagggataaccatgtcaatgcagtcttttttacattattaactgaaaaaacaataagtgttccttatagaaattttaagataaagaaacaaaaagaagtcagaaggaaccaagttactactgtaaggtagatgcctaatgatttcctattgaaagtctcatcaaattgtccttgtttgataagaggaatgagcatgagcatttttgtggtggagaaggattctctggtgaaggtttcctgggaatttttctgctacagctttggctaactctctcaaaacagtctcatatgaaacacgttatttttctttggccctccagaaagtcaacaggcaaaatgccttgagcatccaaaaaaaccattgccatgacacttgctctttaccaatctgcttttgcttagcctggaccacttccacctcttggtagccattgctttgattgtgccttgtcttcagaattatactgttgaagccatgttttatctcctgtaacaattgtttgaagaatcaggctcaggatttcaatcccacttgtttaaaatttccattgaaagctctatttttgtctgcatcgatctggatgcaacagtgttgtcacccatcgagtgaaaactttgctcaacttttaatttttcagtcagaattgtgtcagcagaactcacagatgtctgtgatgttgactattgtttctgctcttgccagtcctcttcaattaggccatgagcaagatttatttttttctcaaaaattgatgtggatgatctgccactgtgggctttgtcttcaacattgtcttatcccttcttaaaatgagttatccacttgtatactgttaatttctttagaacattgtccccacaaactttttataaagcctcagtgatttcgccattcttccacccaagctttaccataagtttgatgtttgttcttgcttcaattttagcagaattcatgtttctcagatagaggctcttttcaaactgaagtcttagcctttttagtgtctcagactagatcctgtttggacatgttatgacaagttagtacaagtttattttggtacaaaaaattgtgaaattcatgcataattttttataatatgcatttaccatgaccttttgaagactcctcatattttatgtaacccagcttctacagggaaattggaacatgatgagagttaagggatagttagggaagaggtcagtggaatgcccacagtattccttcctgtatggtaaatccacagtcccatgaggatagcctccctccagagctcacttatttatttatttatttatttattttttgagacagagtcttgttctgttgcccaggttggagtgcagcggcgccatctctgcaacctccacctcctgggttcaagctattctcctgcctcagcctcccgagtagctgggattacaggcacctaccaccatgcctggctaatttttttgtatttttagtagagacagggtttcaccatgttggccaggctggactcaaactcctgacctcaggtgatccacctgcctcgatctcccaaagtgctaggattacaggtgtgagccactgtgcccagccccagagctcatcttgataggcaacactgaatgtgacatttccagccagcatggacagagaatcctgtttacttgcattccaacccctatcccagagaatggtatggtgtcctcatccccaaggccttcctcaagcagccatcagcattaatcaagaagctccttcttcaagaacgctgctggcacctgccgcacttgtgttcaaaatcaagaaaggccactctggacaataggcctgagctctatttctccatagatggtggggctcttactttcccttttcttctgttgttaattaggcaaacaaataacacccttagtactcagggaaagtgcctggatccagttaattacccattttcacaaatctaaggtaataaaaatataaaagatactgctattctccacaccagggctattttatggctgagaaagccttcctttttcacaacagcgggcagaactaatacaagctgcttcactgtgcacagataagttcccctttctcagttcatgacctcaagctgattgggatcagctgctctctggagacctacatgcatctctcaatgccaggacatgtgccaggacacctcctagctcctgctgcaaccgtctagactagatacttgtcaaccctcctcaccacctacactggttcccaccctgcacactgtcagacccacacactcgctgacacaccctgctcccagcaggtctagatctcaaggcagcatgcttgtgacttttttctcccttgttatgcttaactttcatttctttgttttctatgtacaaaactccctttgaagtattgcgtcttttgtagcatacatacagctctatctacttgatttgagcagtatcatgatattctgacatagaatattaaagttaatagtgttattttatgcatcccaaacacagatagactataatctctcctactaaaatagacataagtatttatagcttcatactgtggtttggggagagaagattggttataaaactgttcagaaattgttttgatgaatttatttctttcccattgcttgatattaaaatataaatattgactaagctctaatttaacacaattttcactttttctgcagcacctgaaattcttagaggttgtgcctatggacctgaggtggacatgtggtctgtaggaataatcacctacatcttgtaagtgaagaaaagcaatatttatgtaaactatttaccttgctgtgacattttctagatacctctaatgctcataaaaaccataaagattactttttgcctttttgtgattttctgttacatactaaatgcagttagtgatagaatttcctgaaaatgaacattgctttttattttggaattttcttgagaccggaattcttgtccagggctttcctatgtctatatccactatgtaatatacagcagatttagggaacagtttattacttgacactagtaaagaatatgagcccaagaccagctgtgtaaacttgctcttgttttacttatttgcatcttatatgaaattattagatttagtccttttaaatgggcaaatgactatttaatttcttaagcaattccaaactggtatatttcttatcaggaatattttaaatgcatttttagctatcaattttgtttcttatttctgttaggttttcaagggtcttaaatttaacaccctacacaaatttcttgggaaaaaaaatgagtgaaatattttaatccctggtatccccacatccattcctgagctcctgtctaataagaaataaggagtttcatgaaatttgccaaagacatggtggaactgcaggtggtgatgaaaaaaatcaaccaaatagaagagcgtctgagaaggaagaatactgtagaacaactagaaaataagatatcgatgctttcaagagtttagttcaaaacaaggagacttagttgccatttagagagtactacaaagttagttgttggaatgcataatattccaatttagagaaattttgaagggtttgaaagtaggtatactagtctacctgggcttacataacaaaatatatagactgggtggcttaaataacagaaagttattttctcacagttttcgggggctggaagtccaagaccagagtgtcagcacagtcagcttctgctgagggccctctcttggcttgcagatggccgccctctcacggtgtcctcacatgatggggagaaggagagagcaagctctgtgtactcttttcttatgaggggactaatcccatgaggaagaccccactctcatgacctcatctaaacctgattgcctcccaagggctccatctccaaatactatctcattgggagctggggcatcaacatatggattttggggttggaggggggaatacaattcagtccgtagcagaatgcttttaattaaagttgtttttaacttaatagtgatcttaaaaaattcaatatccaggtgatatggactaggaatgggctaactgtggtagggcccacaagcacgttagcaaactctaatttacctgatatacaatggttgatcgccaagacagaaaggtttaacaagcaactgataaaatagccatccactaatatgtaatacaaaaagatattttgtgtgctcaattccttgtgtctttagaaaagcttgagaggggccgggcacagtggctcacacctgtaatcccagcacttcgggaggccgagacgggtggatccatgaggtcaggagatcgagaccatcctggctaacgtggtgaaaccccgtctctactaaaaatataaaaaattagcagggtgtggtagtgggcgcctgtagtcccagctactcgggaagctgaggcaggagaatggcgtgaacccaggaggcggagattgcagtgagctgagatcttgccactgcactccagcctgggtgatagaactccgactcaaaaacaaaaacaaaacaaaacaaaacaaaagaaaaagaaaagcttgagaggaatttggagagataaagatcctgtttttgtccccaaaatgtaggtttgcccctaaagtataaatatacccaatttaggtaccagtgtaccaacaattggtaggtacattgttgaaatgtactgggaggcattaagtattaatgatatgaaagaacttggagagatggaagtaggaaattaagttacatttacccagaaaaattggaatgtggaatgcataaaacttaatgatatcactgacatgggaaaatgaagggaaaaatataattacttgagaaatattttattgtaaccctgaagatagttctaaaaatctgtcctatcccctagtccattaccaaattatgcaaactattttatatatttcttttatctttatacactttaggtaattaattaataggtttagttgaaagtaagagtggtagcctccaaaatgaaaataacagtgctgcttacaactaatattctttagtttttggctaacttctgtcaggccctaagcctgaggacgttttatttactctgtagttctttaataattggtgaagtccactggcacggtcgactggcacattttctctggtgggttgtgctacttgatctctgtatcttctttattagattggtttaatgtacatttagtggcctgctgggcacctgagactatgacctctaacatctcactcatttcaccagagtggcttggagacagacacagtagagtagagaagtaaccaaatgaagaattagaactaaagatccattttgttaatgcttcctgggaaagtaaatcttacaatgaagctacgttataagcttcagtcagattctttcttctgtcttccaaatgttgaggcatttgctttactgatacttgtctgtatgtacataaactctggggctgtttttttttaataaagccatgaatagacattggattcttcctatcagtgtaaagaattctgttacctcttttgtccctcttcttgtggctactgctgcattttaacttcactctttgcttctttgtgtgtgtgtgtgtgtgtgtgtgtgtgtttgtgtgtgtgtgtgtgtgtgtgttttgagatgaagtcttgctctgtctcccaggctagagtgcagtggcgtgatctcggctcactgcaacctccgccttgggttcaagcaattcttctgctccagccccccgagtacctgggattacaagcacgtgccaccatgcccagctaattttttgtatttttagtagagatggggtttcaccatgctggccagcctggtctcaaactcctgacctcctgttccacctgcctcagcctcccaaagtgctgggattacaggtgtgacccaccgcgcatggcccactctttccttcttaagagttctagcttgtcaccaccaggctattgatggggccttgctatttctaagaatgccattaggctgaaaatgaaggccattctattttttctcccaggaattctcatatctttaccttttatacctaaaccctcttcccctacagacaaaagctgcaggactgggccttatgatctgatcagaaatcagataacatcagagattcaaactctctccttcagctttcaacactacagttctgccctaaggcttgaagttgtcaccttttacctctgtcaccaaagcaaaaagtcactgataggattgaaatgagagaaaaggcatttgagcactataactcttcagtggtcatttttgtctctagattttcagaaggggaaatataaggaaactcctaaactaagtctaggaagctggctcatttctccatgactaactgcaacaggccataggtttctagtgttgtggagagcagggcagggcaggcaaggtcagactctctcgttgtcagggtgaggacatgtgccctgtctcaccttaggctgctcttccacaggtgggtcaggagcgggattctctgtgcagactgctcagtagggaaagggagaacacattggcccaggcgtctgcactgtcaggccttgcatttttctcactggctccagaatatctggaagagacaaacattctcccagtgggacattctgtgagtaaaaggacatacgaaactgcttctttctaaaaactcactgtattaggatgcactttaatttttcatgctatgtaccaacctggccagcttgagtgaagcctttgggaaaatgtcttttattcatcctccctcccaccctcattttttttcaaatggaacacatgcaacacatgccctgccatgggcttttttaagcagttccctcttggtccctactgattttagaacttccacccgtctgtaaacagtggatgcttggtggtcacaaacaactcgcttttcctttctctcttgttaagatgcccaagatagttctccgtcccttttatcccacttttcccattcatttttaagttgactccatagtagaaaatgatacaaagaatgaggtaaattgagggtgctcatctctttggctgcatctggtgactatattaatcttatacattttttaaggtcattgcctgacaatagtttcagcttctgtctttgttcactctgaaatccaaactggaatggaatggaaatgtcataaagctttactcatttctatggaggatttcatagaatagggcagaataaaaataagtgaaaatttctaatttccactttttaatttctttactctcaaaatcccagctcttccctttcacactaaattggaagtctattcaatctctgtctgcctgtctgtctgtcttctcaatacctgtcaaaaaatccatggaaaggctttagcataatgtctataatgttagctattattattattgttcttctgtgtaataagaattataataataattattattacacaataattataattattattatagctttttgtagaaatcctaagttggttttatattaattcctacttcctgaggacttgattgtgtgtttacactataaatagtgaattgtaataaggcagttgcatacttaagctgagtagacttgcttccatggcaggaagcagtgaaaaagaacagtcctgaattcctacagaaattggatgaaatatacttgagcttttaaagacattttattctctatattttattcctctagactttgtggatttgaaccattctatgatgaaagaggcgatcagttcatgttcaggagaattctgaattgtgaatattactttatctccccctggtgggatgaagtatctctaaatgccaaggacttggtaagtgtaaccaaaacaaaatgaaacaaaatgaaataaatttatttttaactaattaatgggaagtacaattttttaaaattttacccatattaatgccatattttctttcaattttaaagtattttaataaaattagttcattaatacattttccttagagaataaaaactagatatgtttttgactcatcactagttgaattatcataaactacaattactacagtattaatgagcttttactaccttataagtataaaaaccttgcttatgaagaaagctgtgctgggtgaattcaaacacaatttacacagaattctgttttaacatggcttgcaattgcctagaatttagatgtacttcatttcttttttgtttctttgtttttgagacaaggtctcactgtcacccaggctggagtgtaatggcatgatcatggctcattgtagcctccaactcctgggcttaagcaatcctcccacctccatctcctgagtagctgggacacaggtgcatgccaccacacccagctaatttttaaaagttttttggaaatatggggtcttgctatgttgcccaggctggtctcaaactcctgccctcaggcgatcctcccactgtggcctcccaaagtgctgggattacagatgtgagccactgcacccagcctagatatacttcaagtaaaacaatactgcttcctgaaatttcatcaaatttattaaaatatcctaatagtaacgtaagtcccattatgcatcattggcattataaaaatgttccactgtgttaatagttcattttgtttgtttgtttttacattgcttctcacttaagttaatattgacatttgtttgcattcaggaaatccataccttctggggaggtcactcacctcttataaaataaagaggatgctaacatgagattgaaacatttctcatcaatccactagagaacaaccacacagacataatcaaaagctgacttttgaatcatagaaggttagatatagaagaggtcttaggaggcatctagtcctcctctcattttaaagatgagaatgctaaagaccagagaggtgaaatgactgctaaggtcacacagcttcccagcagaaagacattattagggctgatccagtcgtccagactccctttcctgtgctcttttttcttcaagcatttcttccttaccctctgtgttccttcatggaacagattccctaaggctcatggcttttccagcatgagtgggaagagaaagtcagtgtgtgtgatgtgtgatgtataaatatgtcattgcaactccttcctcaagtcataccccatgctcctaaacacctcttgaatccatccagttctctcccccggaccactgccccaacctcctatctgacctccctgcctcttctcatgcctttctcaaatacagtctgtacaggatccagagggatggtcttataaataaatcgcatcatgtccttgtcctgctttaagaatcttaggataaaatccaaaacccataacaagatctacatgacgctgcctggtctggggcctgccactctctcctgtgccatcactcacttcacatctctcccctttgatcacttttcactctagtgcaccacacttctagtttctcatcagcatagctcaggatattgccatggctcttctgctctgtaatgttctttcttcctccccaccttcttctccattacacataggcatgtaaacacacacacacacacacacacacacacacacacacacacacacacacacacccctgggtaactcttattctcaagccccagctgccactagatatcccttgggaggcatggtcggccttccccttcagtccctcccacctatagttggttccttctgccaaaatcttcctttaccccctgcactccccagttcataacagtcatcacttatatatttaatggtcctccttaattagattttaagctctggggcaggacaaagcgtgtgtacccagaccttagaaccacataggcatataggactgactcagtaaatgtttattggatgaaacaatggatctggaagtacaccatgaagtttcagagtctgacacacctggatttaagtgccccctttgtcatgtcctggaagtgtaacctcaggctcatgatctaaccttgctatgctttagttttctcatctaggatgataattgtacctatctctaggtcgttgtgagaattaaggaacataatatatgttaagtaactaatatcaactaacttaataatagtactcttatttagccctccttccatttcttttcacccttaataaatattaagtgaataagagggttagctttgatgttccttcattcagctagatcccttgttagtttatcactgcttaaaacttcagaactggaagaatccttgagctccataaatgtatacttactagcaaaacccacatctgttgtgtcatcggcagagactaagtgctaaggagttggggaattggatgtaaggggtactgcagggtaatggcaaggctttgagtgtgattataaccttcagaaagtttcctaataattcagttaggattgttatcaatatcttcaaatgtaaagattaacaatggtgtatataaatttttggtgcacattgactttcaataaattctttgtatttttgtgaggaagatagtaatgaggagggagaggagaaaaatgattggaaaagaaaaagaaaatacctaattgtcaaaaatgttgtaaggattagggctcatttacataaaattattagtagtcctgttcaacggataatagccatgactactatcagatttttatttactaccatgccttctttctcttaaccatcctaccttcctccatgtcctctcagattttaagcctaaagagcctcatgtctctgcccactacaaatctagcccaaacacacattcttttgcagaaaggaagtgaagagagaaccagatagtatttattcctcatttgacttgccgcctgatttccttagcctatgttcacgtctccttaggtaattagagttagaaaagacctgagacctacaatcattcaaagctccttattttgcacatgagcaggccaaggtacagggagattgaccaccttggagacatcatgctgtagtggccacaagatgcgctctgacatacacagacctgagtctaaatacaggctccatcaattccaaattgtctgacctgaggcaagtcactaaatctttctgagctaccctgcttccctcatttatgaattggcactagtagttccaaatgataaggctgctaaaagattacatgagtttttaaaaagttatatatgcatctaagaagcaattacaaaggaattaaagtggaaataagattctgtaaggaaagagcctgagggggtgtccacaggcaatttatatatttgtctatatctagggtcacaaaagtggcgagtggcataaccagggcttgaacacacttcctgactcccaatagtctctgcctcatatcaggtcacccctactaagcccaggactgtggattattttatttgctgaccttcctgggaatttattgactgcccatcctcacaagcaggggtaaacctccaagaatgggctgccattgattggattccattctttaggcaaatcatgccctcaagccactgacttcttggattataaaatgatttttaaactctgggcttagtccttcaagtaccctcaaggggttagaaagaactataaaccccaagatagaaacataaggtagtattccataagttctgggatactctcccttttgtttgccatttaatccccacagaaagaatgatgatgcatgaatgattccattctgttaccatagagatgtactttaagttctgaattctaggtgattgtgaagcgcagcccagaattattttgctggttctgccttcaaagaacttccagtccacaggcaagtgaggagctgtttcttgacttctgttggaaagccgtctgccactttgggggtctcaggtggtacatggccctgtcttctcatactccctcagctactgctacctgaagctgtgcctacctacagtggcccctgaggacttaaacaatttttttctcacatatatttagtggtactgctgggaaatggaataagatctggaagtttgtaagctgagggcaagcccaggtcatcctaaaaacctcgctaagtttatggttctttattatttcaggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggtaagatagcatatattttgttttgttttgttttgttttcaaaaaatttatctcatcttgatctatcaataatagttctaccgttcttcatctaatactattatctatttcttaaggcaccagggaaaatcctgctttgaaactccaataaggctgacacaaagctacttaagttttcttatactctcataaggaatatatgattaataaagggaaatttgttatataagttgatatttacatatcaaatatattattgctgcttctcatctaattaaagtatactgcttaaacagcattgttcagggaaaactgatatttattcagaaagttgttttctttcagaatatgtaaaacttggtaaacaatttttgaaactatatttcctaatatagataaataattacttgacaaaaatttaaaaatttaagtgatataataaattacttaactaaatatatcattttatatagtacctatcgaatagagattaggagcttttctattacataactgtgtttaggactagctatgtaagtagaggatctcagagagcagctgggggtcagaattagggtcctatgcagccattgcttacggtctgatacagactaaataaatctgaaaggctccatggtcaaattaattataaataccccaaattaaatagtattgacttcacctaggatttctccagctagtttgatcacggaactcttatatccccatgatgacatccatgtggtaaaaactactaacgtccacagaactagtgttccgtaaaacaaatacaccgggaaacacagattaaaattttcaaaaattggttagccacaggtaaacacatgtattcaggctttcagttgtccagatgattaaatacactaatttgtatttaatttgagatgaaagaggttttactgttcattctccaaattttcttttggcaaacaatctaggaataaggtactttgaaaactttaacactaacctataaaacggaatccctaaaagcaaagctggggttgagctctgatgtggggtgttaaagcagaggtaacacttgacactcttctgtttccaatcaggcagcggtgaaggctgtggtggcctcttcccgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagttgtacatatgtgcaaaaaaaaatccacttgcaatggtaagaaattgaagtatccttaaaggccatgaagccatatgtccctaaagcctgtgtggagaatgctttattttattcttatttatatacactatattaataataaccaaaatgttctaagattctgccattttacaaccctggaggaagtaatttacaaactcacgctgagttccattctttccttcacctgctctccaataagatgactttctgatagacaaagcttagggtgtaataaacagggaagaaaagaaggtaagactgtacttaaactgatgaagataagattgattccttttcattttccagataaaattgtatttactcatgaatttatacaactttacagataagaacattttaatggataaactctataattaccaagttgcaaatatttagaaaattctatttcacaggttagtgccaaaatgtcttcatagagtaggaataatattccattttaagattattcattattgactttaatagagtaagaaaacattattgtttatcaaagctctttttttatccaattgatggttatctacacatatcacttataaactaaagttatttatgaaaagctagtatgtctttttctcgtatttggaatgaaagtacccacattttacaatgtagtgttgagaatgtggctgccaataaatttagcacaatgcaatttatttaccttaaaaaacaaacaaaaacaaaaataaagaaaaatactgatttcaaatcagactcttaaaaagctggaacattagacctgatattttattatgatttttcccagaataagtttaatttctctttgactttcatagaaacactttccccttatagaaattgcactatctccaatttatttctagtttgagttgaaatgaatattttatcagattaattatgtgtcacatttttggtgggttttctcaattttaaaaaagaattcattttaaaaaataattattttcagagaccaaataaagacaataaaaatgactatcacataaaaatccttgttaaaaaagagatcttaaattatgttggctctccctcaaaactattaaattagaaaacgaaactaaagctccagtttgtagaggctgttggacctcagtagacattcttcttttcaatcacaaatctctctctactactgttctcatgggaagaaaacaaggtaggacttcttatctttcatagtttaagaatctgacaggtcactgatatggagcccctgaagaagcacatcatctgggctcagaagattattttttgttttgttttatttgtactatctagtagagagcacttttcttattccctctttccttccttcctcatttaattattccctctcagaattcccatgttgtccattataaggggctcgctatttttaacctttaagaatgtcttctttgttaagcattaagatttccatttaagaggatca

SEQ ID NO: 16059 - DNA, 8787 bp, Human
tgctcctgtctgcaagatcaccagatacaaaatcttgaaggtctggtccattctgtaggagttccttttttttatctggcaaggagcttaacggtctgactgggctgcaaaaatatctcccaaatacctaaagaaagagttaattatgacgtttatttagtggagtccgtaataatttagttttaacccatcataacacctaaacggaagggtaaagccaaaaaagtgattcagaaattatgtcaaactaggagctctagtattctagggcattagaatataaaagatgactgaaggaaccaaacctaaaagagagtaagagttgactgtttactactgagtttagaatagatttggaaatctgtttttttttttttttttttgagacggagtcttgctctgttgcccaggctggagtgcagtggcgcaatcttggctcaccgcaagctccgcctcccgggttcacgccattctcctgcctcagcctcctgagtagctgggactacaggcgcccgccaccacgcccggctaatttttttgtatttttagtagagacagggtttcaccatgttagccaggatggtctcgatctcctgacctcaggtgatccacctgcctcggcctcccaaagtgctgggattacaggcgtaagccaccgcacccggcccgaaaatctctggaactaacatatatcacactttcatgtactccacctaccaggaactagatgtttgtctttcaacaagattgaactgcaataactgaagaaggtgccacagtttaaaactgttctggtcctgacttgaatcaggggcgtttaaagtgaagtgtgcaataaatctctcgagctttgaataattgttgaaacgtaggttaataatgcccaattagtttcagacaactggaaggttaaaaccaagcctaacgtttttactttctttttcttttttttttttttgagatggagtctcgctctgtcgcccaggttggagtgcagttgcgcgatctcggctcactgcaacctccgcctcgcgggttcaagcgattctcctgcctcagcctggcgagtagctgggactacaggcgcacgccaccacgctcagctaatttttgtatttttaatagaggcggggtttcaccatgttggccaggatgaacgtttttactttctaggttacattgtttctgtgtttgaacgtggcagtcaagaacataagaaatcatggtattcggcttttacatctgaacacaaacgtgtatgagatagccaaaacactacaaaatccacgagtctgcacatgtatctcaaaagaaccttcgacaactcaaagagtgcctgttagggtgttgcacgattgctactgcacttctcaatgtctgccgctgaagcctagcggacaggtttgtgttctctgcggctagagtggtgtctcacacacagtaagagtccaagacagaatagctatgtggggtgctcactgcagtgctccataaatatagggtacaaaccactctaagcagaaaataagtcctcggtgctggcccagagagacttgcaaacaaactgatgccagagactctatatcatggggctggcgggataattacatgagattacacgaaaaacgtttaaaactgccgttggctagtagtaaatgttcagtaaatgcactggcctttattattgggcatgggcgctctgaagggataggatccccccaccccacgcccaaacccgttcgccccgccgctcacccggggccccagggtgcgggctgcatccccgcagcgtagagacatttcctctttaggactagcgcagtgcaggggttgagggatcgctaactcccgggaaaggacaggtcgaaattacgtcgctccatttatgacaagcagccaagctgctccacgattggctgctttagccttacgtgcgtcgcgcactcatgacgcaatacgcaggccccttacgcgatacaagtacgtaatgacgacagacgttctttctttgctgcgtctactgcgaggtaaggatgtttctgtgctcgtgggggtactgggaatctgaaaccatctgctctgggaaaggctgcggcgcggctcccactctcggaaccttgtcctgtttgtcccccagctcggcaagcgccatatgagcctggcggcgccagatgcgaatcctgttgtgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatggtatgagacttgatgtcttttacttacatctttactgcacgttccaagcgttgtgtggcctgacgagtgtgttctctcttctagtcgacattactctgaagggacgcacagttatcgtgaagggccccagaggaaccctgcggagggacttcaatcacatcaatgtagaactcagccttcttggaaagaaaaaaaagagggtgagggtttttcttctgataattcagttgctcgttggaaggtggtttataacagcatcacatttggttgctttaacaattttcgaattgaggttcagtgcttcagctttaaatgttgctgtccagaataccagcctgttcagtgaaattgaaaaaccagattctgaacacagccaattatataaagctcaaatgtaatagtggtcatcagtgacacgtcttaatggtgttagaagtttggtttattttcctagtgattgctttgtaaaaatcacaggaaccggcagtaggtcatttaaacctgatgatttaattttccagaagggaagtttgttgcaacttctacaaagcttaactgttgggaggttttataggtggttggatttttccagttgaaaaccatgtgctttgataagggttaattctagaatcttaaagtaattcggtaagtggtctgttgtcttttaagcctgcatatttctggaaagaatacattttttgttctgttacagctccgggttgacaaatggtggggtaacagaaaggaactggctaccgttcggactatttgtagtcatgtacagaacatgatcaagggtgttacactggtaagcagatgtatcagacttccttgttttggaaagggaggtttctcaaacctgtgctttatacagcgtaagtgtctctttcagagaatgggtcatgtattttatttggtgtaatacgcaagaacttggcaaaaataggcatctgtgggtctttaagcgatagagctgagagcaaagaccagatgggtacaacatgtttgtttttttctgttgttgggttttttttttttttaatcaaggctggggtctcgctattttgtccaggctgagctcaagtgatcctcccaccttggcctcccatagtactgggattgcaggcatgagccaccatgcatggctagatgggtacaacttttaaaaagtaggctaatgatgaattttcataccttccgaattctttaagataggaaatctacagttgcagtactagttggtagtcaaatctcaccatcaggaccccttgttgggatagaaaaagatgtagtttctgagttttctgtctgctgccataatgtatgtcattattctttccaacccaccgtctctcccctcaagataaaaagttcatgctgaaatggttttctttgcattataccttctagaatgcacctgataatggcaccctgtacatctattataaatctgttaagattcccccatctacccttgctcttagccttaagttccttgaaggcagggggcctgcctttggcttggtggtctcaattcctgccatgtgctgtaccttagtaactcagtaaatgttagtctaatgtctaagatcagggctttggggttctcattaaaagaaggcagcattgttcattgagggcataagagctagtgaaataaagcctccgcaaggagctttacagtccactgaatagacagaacaatgtttataaggcttggttcaggtgacagttattagaaaatcttggcagtgagtgttacgttttaaaataagtataagcatcttagaaaattttaaaactattaaaaatattcctcagcattgctaatagcttgcttatttatttaacatagggcttccgttacaagatgaggtctgtgtatgctcacttccccatcaacgttgttatccaggagaatgggtctcttgttgaaatccgaaatttcttgggtgaaaaatacatccgcagggttcggatgagaccaggtatgtgcataccctcagacagaattaagaaatttttccttcatatttttttcctccttttccactcccaacttccatactttagttggctgttgttttgtgtttgtgctgagtaaaaccagatttgttttagaattatctcttgattacacttacaactgttggtgctacttaagggtttatatcattatgtcgattacaatttcagaaagttgatacattggagtagcttgcagtggtggttgtatttaacttggcaaatgaaatcttttaaaaagactttaaatttacaaaaggtgtatataatggtgtgtatttatggagcacaatgtgatgtttcaacacatgcatattctgtggaatgactaaatcaggctaattaacacatccatcactccatttatttcttcgtggtaagaacctttaaaatctaaagagaaaactacatgagtagtggttaatagcctagcgtaaatttcagctctcactgtccaccttgggcatgtcatctctctgcagcttaaaattgcaaacatctttgattaaatgagttaaagttgaaaaacaacaatgcatgcgtaatacatagtaaacacggtagctttaaaaaaaatttaaagcttagtgctttttatttgaggcagggtcttgctctgttgcccaggctggagtacggtggcgtgatctcagctcattgcatcctccaccttcgtgctcaggtgtttctcccacctcagcctccccactagctggcactgcaggtgcctgccaccacatccagctgatttttgattttttgtagagactgtttcgccacgttgcccaggctgatttcaaggaatgctatggtgcctggccccagctaatttttaaattttttgtagaggcagggtcttgctatgttgtccaggctggtcttgaacttgcaggctcaagcagttcttcccccttggcctcttaaaacatacctggctcggcctcttgatgcattttgattccattggggtggggaggggtgggaagaagggagattcttagtatcaaaataatggctgtccagaaatactctgatactagctatggtcagcaacatttaatgaaaacgcttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgcccgcctcggcctcccaaagtgctgagattacaggcgtgagccactgtgcccggcctcaaaatcttaagaaaaggttcttttggtgcatggagttttacatggaataaattagtgcctctgcaatttaaatattttttacacagatttgatgctgtgcaaatgccctctccccttttaggtgttgcttgttcagtatctcaagcccagaaagatgaattaatccttgaaggaaatgacattgagcttgtttcaaattcaggtttgtatgtttactatgtctaactatgcctacaagattttgtctaaatcttgtttaaaatacagtattttgctaatttttatttgattagttttttaaattgtgaaaataaaaaggtcacattctgaaattttaagtacagcacataatgaaatactttctttttaagatgggttaggctgatgtattaattgctttatcttcactcctatagcggctttgattcagcaagccacaacagttaaaaacaaggatatcaggaaatttttggatggtatctatgtctctgaaaaaggaactgttcagcaggctgatgaataagatctaagaggtaagttcttacagtgtcttaagttttattactgctctagttgaatgaagctcttaatttactaaaagacttaaactgaatttgtagtaatagaaaatggagagttaagcattctggaacacagtaaatttgacagaataaaagatggaattggcatgcattttactacgtatagtttactatgaatcagtaagtcatagtcttgaggtatgttttagattatttagaatagtacagaaaaaagattagtactttcctgggcaagtgtattgatggggatttacagattttttttctttttttacagttacctggctacagaaagaagatgccagatgacacttaagacctacttgtgatatttaaatgatgcaataaaagacctattgatttggaccttcttcttaaaccggttatcctttttagctagtttttttccctcgtggaacaaggagctttaatctggttcttgaaggaatagcaaggatatattttaggcaagaggaatattgtaccagtgacaggcaaacatgaggccattcatcattgcatatagaactttaggaataccctgaaagtgtctaaatttgctgaggcatgaatttgaatatttggtaaggcaaatgttgtcttagtcactggtggagaaacagctgaggagtagaacagagtgatacagcatcagttagaattagaaggtgtagttggtttggttcatggtctcaataatcttgtcctttacctcagccatttacttccataccctagaacttgcttttaaaaattgataacccttccataatctcttaattccatgtgttatactttaaatatggtacaaggccaccataactagacttaggtcaacatggtgacccccaaacctttgtgaattctacatctcatttgatggaaactgcaatttctaaggcaaaatttaacattcatccttgatcaaatgcgtcaggaaaacgtactaagtaccttcattgtaaggtatggtcaggtactttatcagaaaaagtaaatataaggacagaggtcacgatcagttggcatatatgttatcttggatcttacaatgtcttactcagttgcccaggctggaatacagtgccatagtcatagctctgtaacttcaacctactggactcaagcaataatcctacctgcttcagcctccttagtagcaaggactacaggcaggcaccgtcacatcttttttttttttttttttaaagtatggatggggtctcatgtttcccaggctggtcttgaactcctggccttaagtgttcctctttggcctcccagagggctggaactacaggcatgggtcaccatgccctatacgtcttagatctggattcaagtacactaattgaacatacattaaggagtcttgttgtttgatgactatttggttaggtttttaagaaatttggaggaaatcataaatctcggatttgctcagaaataacggatggggttgtaggcgatgaatgggatcaacgtgaagtaagatcacatcctcgaaaggttgggaaatatgggtccattagatacaaattttttacaatgtagaaaatgaaacaaagacctgcgaagttcacctggattattgtgacagtcaactggtcatcttcctctcctgtctattttcagcatcagccagggtactgattttgaaatggattatagcactgtttcaaatcctgcaacaggttttttttcccttttttctttttaaaatagcctccccattgtacctgcagccgtttttaactcaatttttctgacttctgcgctatagctgaattgacctggctaattctctataccaagcactctgtcattaagcatttaagttgtcgttttccctttggaatgctctcagctgagctgtgtggctaatttcacttaccttcaggtctattcagtgaatcctgccttgaccgccgtattaaaaatagtagaccggctccttaagcttgtcctactgtctcgttacccttctccacttgtttttgtcaatagcatttgtaattttaatatttacaattggttgtgtattgatgatgtgtttttttctgctaggatgtaaccttcacaaggaggtaattttgtactctggtgtattccagctaccagaacaatggcatgtagctgtttcctggattgccaaggaactcagtaatagcagtgggactggaagagagagattttgggaaggtattgacaggatttcaaaacagcatgaggcttgtgggagaaatttccaagtggcaatattctagtggggtggagatgctcatgagaggatcagcttatggggagtagctgctgtgggagtaaatgagatttctttgagcatgaaatggactggcatgctgggtctgac

SEQ ID NO: 16060 - DNA, 20079 bp, Human
aggtagtttccactggcttagtagatatttaccaaactggtgaaaactacacattaatttatccacctagaatttggtgggaatgaggtccatcttgtactataatttgtggattaagtaaaatcagatgctatgctatgatgtttgtaaaatcagtcactatgttagtgctcattcatcccagctcttgctgtgtgtggttcctgaggagtgggcatcatgacagcagggtgggaacatcactgttgtctgtgcacgtgcatgcgtgcatgtgtgtgtgcacatgtgcacatgtgcatatgcttgtaaaggggctggctggagaagaatgtctccttggtgatgctaacaaagcaacattgagctggagtgacatcaggtgccagaccccctaagaggtaaaggcagaggtctccaaggtgggtgctggactgaattctgggaacaggccaagggctgtggctacatcaatgggaaagagaagagggcctgtggcatgcctggtgagtgggcctaaggctccctctaggcacaaaaagggtgggagatagagctgaagatggcctggcatgtttgaggccagcaagttggggttaagttgtttgtttttctcctcttttattcctcccaggtttctttataaccttttcaaaattcaggcatctaaacagcccttgggatgagaaggacatggtggccagtgtccatgagctttaggtactcttttccctctcactgtctgtggtctgaggactgcttacaaagttggactgtggcacgaaggcctcctgattaaaccaacaaagaggccgcctctccagagctcagaattgtcctgacatgaaaataatcaagttctgacactgccaggataattactgtttaatttcgagtattttaaaactgaaaatatagccattccttcctttataactctgtattatggtctatttgtaataattgtaataacaatgcttggtgcagagactggaaaggggtaggaaagccaatagtggagcatcctcatgtttcccacagttttggacacaaagaagaaattctcttctctcctgataagcagagataagcttatacttatttccggatccctaagtcatctttttagccctgcaaatttgctggtgagcagttacaataaagcttcctggcagttccttctaccagagtgttaaagtaatccaggtatttgaaggcacgaaatggaatgacttaatctcatctctcagtggttcagatggatgcgaaggtcatggctacagctacctggtctaggagtgtgtacatcatgtaaacatccaggtcaagtgacagagctcagctaaaatccagaagtcccctgacaccagagttagttttccatgaaagaaatgcctataagaaactggaccaggataaagcaaagagtaaggggcaggaagaaagcttataattgcattactgcaatcttctgcaaaatcagacttctgcttctgttccacctctttaaagctgaaaatgcctcaagtttcttactgagagacatgagaaattccatgaatactaaattctttgacaatttctagcatggtttcatccaaggttatgtgatgaggctgcataatataggctctatatgtttgggtattttatgcgtgtatgtaactttgtcactttgatttgcaaaatggaaaattccctgaatgcccacagaaaagtataatgtagcatttagcaggtcaacaaaatgcactcccttattctttgtctccgcctcattctccaacactttagtgcactaagttgtagtgactgaaatcattcttggtgaataatgctgggccacgctgaaaatttgtggctgagagctggaccctcgtcatcgccacgtactctgtcaatgagacagggtaacccatggttactgagctccgatcagttaaggggcagagagcctccgctccccactgctctataaaagagacccagcaaagggaccctaccagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagaggtgagccacccctggactgacccatctcaccttccttgcgtgttagccctaggcggcaggcaggctgcctctgctcgcagccttttggggttcgctgtttcttccctctctgctggatgctgtcttgcccctggtttcccctatcctgttctccctccttgcctctgagcatcccagactgcctgcctgccttcctctggccgctggggataccctggcctgatggagagggtctaagaccttcccgtcttctccggacacgggaaaacattacccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgccgggctcgcgggcgcccgggacgcggggaaggtgggactctgtgcggggggcagagggctcgcggacatctcggggaaggggctggccggaaccgccaggggcgcggtccccttagctaaggatcggtccgcggaggcgcgccaggagcgggagagggtggcgcgcccggggcgcaggaacccagcgcagcctaggctggaagtcggggcgctgggcactacagagcccgggaatggggcgcgcggagagcggccgcccgaggacggcgctgcggcggctgcagcccgggacttattgccccatgccctcctcccccagggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtgaggcgcccacggccagccaacctagccggagggcggcacgggagggttggaaagggctggggcgctgcacccagcgtggggctgctgagcgtaggtagccagtggcacttcttagacacttcgctggtgcccgagtcggagaggcgcgttcgaggacccccacacggcgagaatctcgcccttacccgaagacctcgacccacacacatccagtggggctggggccggtgcctctggacgctgccatggtttaaattcccttctgggcgctttcgaggccctaggaacttctaaagacttgaactcgcagcgcggaactctgacgcaatccagggccgaggaaaaatgattaaaacccaacaagctcgagtgctggggtccaccaagcgggccgtcttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggagggcaggacaagacccctaagctcactgcctcctcgattccagtcgtcagactccataagtataacagggcagcatgggatggctgatggagctctactgtccaattaaaataatcatgattaacatctccaaagtaggattattttggaacctgtcacatgcgttagaaataatttgtagctgggttgttggtaattttgctaatgtggactagattggactcgttaaactggagacctgtggtgattttgagggtcaagtcaatagactctgaccctttgttcaactgcaaactttaacaagtgaaggaaaaatgttccaggtagcataccagccatcattgcctggctgttgaagcagttcttgacattttaaagtaatatgtgatgatatttttaaaaaatgagaaaaatgggtgtatatagtcattagcaggtaaagttgctgctccagttttttcttttgctatctattttcaagatattttgttcacatttcaatgactagaggaaagagagaagctgcacgaaacctaaattatgcttttgtggaattcttctgaaggtgagaggtagaaaatatgaccaaggtaaaaatgtacattgtacgttgttttatttaccaaagtggttgaaatgataaagtataaggaagtttacttactttggaagctttaaggcttataaaaaattaattaatactattacttgcaaacaaccctcaccatccaatatatacaaatgaaaaggcgagcaggcagagtgtggactgtcgattctcacttatgactgaaggcccattgctggatgactttcccccccttttcaactcatttcagacttcaggagttgatggaaatgatagcatctatgtctgtatttttttcaaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttcgtaagtgttctcagtcaaaaggcagaacttcggatatagacccgctttttgaaagtagtatcattgcacagacttaaagaaatttgaactgaggaatgatttgaatggaaatttttttgtaattagaaatgacctaaaggatagtttctattctttattatgaaaatcaaatcacagtttttaatttatttcccaggttaggtagtatactaatttatgaagagtacaattctatcttttctccaaagtcttgctctgagcttctcaggttctacaatgcatttagtgataagctttaatcttccaagtcatttcactaatccaggataagcttgagtgatcagatataaagttgcagtcttagagatattcaggcacaggcttgaaagtctccatgtctttcagcctgtgcctgaatgtggtagaccgatgtcatgccctgaccagagggttggattatagcacctcaatgttaccttctgattctgagcccaccactctaattcaattcatttatgatggacacacacgtagcttatgctacacaactgaacagcccaggtctaaagcatattatcttactaaaaatatttactccgcggtggctcacgcctgtaatcccagcactttgggaggccaaggcaggcggatcacgaggtcaggagatccagaccgtcctggctaacacagtgaaaccccatctctactaaaaatgcaaaaaattagctgggcgtggtggtgggcgcctgtagtcccagctacttgggagagaatggcgtgaacctgggaggtggagcttgcagtgagctgagatcgcgccactgcgctccagccggggtgacaaagggagactcttgtctcaaaaaaaaaaaaaaatgaatttactcatctgctaattgttttttccccattaagagaaaaatctgtttaaaaaattagaaaaggaacacatatcactcatttttgcatacagtagaattaatggtaacacttcatgcggctgaaagatggggcctttatctgccaaagaataatgcactactgatcttttgatttctagttctgaaaaaacaaaagaatttttgaaaaagccccccaaaaaggctgttcctgaggactgcaacagaagaattctagaagacaaaataaagagtttcccctatattttgtttagttagaaatcagaaacctcctgggccaggcgtggtggctcatgcctgtaatcctagcactttgggaggccgaggaggaggatcacttgagcccaggagtttaagatcaggctggcccacaaagtgagaccctgtctgtattaaaacttttaaaaaagtttattaaaaaaagaaacttcctagaaccatcaaggaatttcagtcctttttgaaagtaagtataattaaaaatatgaaaaggaggcaagaggtgtttctgatctgttctgatcaatgttgattcatccagtaatcagaaaaaaaagtacaaattctgatgcttctagtttcatatctagactaattaatgtattgtaaatttatttatttgagacggagtgttgctctgtcacccatgctggagtgcagtggcacgatcttggctcactgcaacctctgcctctcgggttcaagcaattctctgcctcagcctcccgagtagctgggattacaggcgcccgtcaccatgcctggctaatttttgtgtttttagtagagacagagtttcaccatcttggccaggttggtcatgaactcctgacctcgtgatccacccgcctcggcctcccaaagtgctgggattacaggcgtgagccaccactcccggccaatgtattgtaaatttagatttgagatataaaacaaaaaattgtagaagttcttgggagtaaattaaacattaaaaatgcaccttttagttaacttatcacttaacatgcagcaaatatttatcagacttaatactgctgtctttcatttttttctcagcctattttctcactattagaaaaatacttaaaataggcctggcatgggggctcactcctgtaatcctacactttgggaggctgaggcaggtgaatcccttgaggtcaggaggtcgagaccagcctggccaacgtggtgaaaccctgtctctactaaaaatacaaaaattagccagatgttgtggcacatgtctgtagtcccagctactcaggaggctgaggcaggagaatcacttgaacccgggaggcagaggttgcagtgagctgagatggtgccactgcattctagccagggtgacagagcaagattccatctcagaaaaaaaaaaagaaaagaaaaatacttaaaataagcctggggccatggtgaagctgccgagctgcatcctaggcccccagttttaaaataaaaattaagtttttttaaaaaagaaaataagtaagaatgaaaaagaaaatacttaaaattatttactttattatttaaaaatagacagagtttgagttttggactcaccattaagcctcgatttttccagattcctagctttaagctggactctagttaactcaagtgttcctagaactactaccagctagtatttgtttgggtgctgtgttatgtcttgtgattgttataaacaaggtaaccccctaagattaacattagaagccccctcacagcccagggcctcctgacaatatccacgtgtcactgatggtttttgttccccaaatccttcctgtctccaaattgcttttgtggtatatatgctctcttcctgggcagaaggccctagatcatgaacaggagccctagaataagatacaataaatgtctataaaaacctagcaaaccaagtaaaggaaacgtgaatttctttttcttttctacaaagcttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaaggtgagttgcttacttgtttcctaaccgtttgataaggccacaactttatcagagcagaagcaatcatatagggaaaacctggacactagcaaattggcgtagtacgttgctctgatgaactcttaaatctcaaatgtgtttgccctagctgctttgactaaccccctcttctatttcagttatgcggcaagttgcatactcaggtgccccttctgactacttgaatactttccctgtgatgtaagaagtgttttcaattggtaaagttgtggtatataattacaattgaactctcttgtacttgcctcttttacaaaaattctctcctagcagaacgtagtgtgagtcatctacacagctgtttttctgattattggaattttcttttgacatgaaggaagtatctcattgacagaactgcgttgtgaaggagtgctaactgtagcataaaatacaaaattggatttttagattgcaaaatacagtaaagctttgaaaagtatttggcatgacatttaactcaatacattttgcctaaaaaatattagccaagaacccctatcaacttgtttttgaataaacttctgtatggaccttaaaattcatgctgagtttgaccgcattttcttgcactggtagcattttccctctgagtcatcctcatttccttctactttctcacatgactaggttaagataactcatgtatttgctgctatcaaaggcagtcataattcctaatcagacagattttagtgaaaaccaaataaatagaactaggactgagaaaaggagtatatccaatttcctttaagccctaaattcatggactagtgcctgctttttttaagttggaacttagtggaagaatagtcctttgataaggacatttttgggtatctttggtacagttttactggcttgatattatttgtatgtcatttttgatgtaaaatatagaagatgaaaggtgtgagcacagactgggagatctgcactttagttattggggctatgggggtaatcttggtgtttcctcccgaacaatttagagcctacagtgttctaggcatctgttccttcacaaaatattttttgaatgcttaccatgtgcaaggcactattgtagatgctggaaattagcaataaacaagacaggtcctgctcacagggaccctgcattcaagtgggatgagacaggcaaaattgccatgtatttcagttggtgataagtgctatacagaaaatgcagcagagtagtgtggtagacagtgactgggagcatgggggtggatggagaggcgcggggctacttgtgataaagtggtcaggaaagaaaccttttgagaagtgagacctgggtgatagatcagaaggaaccagcagctgtgagaacagggagcagagggaacagtgcaggggctcagaggcaggaatgggcttgctggattccagacatggaaagaagaggaggattggcataaaacagcttcagggagatgggcagggccagagtgtggtgagccctgcaggccacattagggagtttaagtgcagtggtaaaccactgaaagagttcagggaggaaagcaacatgatctgatgtatgctgtctaaaacgtcactgtggcttccatgcaatgaatgggctgtagggccatgccaccctttttatggctctggtgagatgtttctttagttattattaacatatctatcaagattattttcttaaacctcccagatttctatgtattggaagatgagttccaccaaaataaaaccaaaaccaaaaaaccttcaattttgcacattgagttggtgtgaggatcttacatttggtacaaggaatgtaagtactttttattgttttttgttttttgttttttttttgagatggagtctcgctctgtcgcccaggctggagtgcagacatgcagtctcggctcactgcaacctctgcctccgaggttcaagcaattctcctgcctcagtctcctgagtagctgggattacaagcatgagccaccacacctggctaatttttttttgtatttttagtagagacagggtttcaccatattggccaggctggtctcaaactcctgaccttgtgatctgcccgcctcggcctcccaaagtgctgggattacaaacatgagccactgctcctggccaagtacttttttggtacattattgtgggctaggcaaaagatagtagtggcttagaacctgaacaaagaaatttagggaatccctgttgagaaactgaacttgagaggtccctgcataactcagtttctgccattgtaagaaaagctgagaggtttgcaaagaagggagaaaaatcattgaacagcaaggaataagtgcacttaactttcttgtttctttgttttgttcccctcactttagtttctatttcttcctagcttctttatttcctacttctctctcctgagtctgcctttttgcctgcaacagcacctgctgaattttggaacctataaaactaagtggaaaatttagttgtaagagatgttcctcctggacatcctctactcaagggaaaggcaattaaagtttttttcctttactgctaaattgcttattccactctcaatacaagaacatgaagccctgtatacagtggggctaattaaacctctttcatcatttgatgcaattatgtataaagcctctaagcatcaaacccagtacatagtaggtaggccctttaaaaatatgtatccccacctgcccctgctcattagtgaagcagttgccattatgttattttccaatttgctgtttagttccagttgtattccaatgctcttctgtgtttttttgtttgttttgttttgttttgttttttcggagacagagtctcactctgtcgcccaggctggagtgcagtgacgtgatcttggctcactgcaacctctgcctcccaggttcaagtgattctcccacctcagcttcccgagtagctgggactacaggtgtgtgccaccgcgcttggctaatttttgtatttttagtggagacggggtttcaccgtgttggccaggctggtctcgaactcctgacctcaaatgatccacctgccttggcctcccaaagtgctggaattacaggcgtgagccaccatgctggtcagtgcccttctaaatgcctgaatgtgtgtgcttatgtgtgtgtgtgggtgtgtgtgtgtattaagttctctattttagattttggttcctatgtgttaaggtctatctagtgaagtactgagcaccttgtcacattctactagatctcttaatgagcacacttcaatgaaaaagaggatcacaggcaaaattgtggggaccagtacaaatgaaaatgtgggagcccttattacaattttatgaaaatgcagcagaacattaaaccaagcatagagcccttctaggcactggctttttgtggctgcacaggtggcatacttgtgagactgccctggggagatgggggctcagagtacttttgggactaagagtggttgctttgtttgtgttggaaagtgaggcacggggattgctatggacaagacagtgtggaaaaaatgaaaaggctgggtgaggtggctcacacctgtaatcccagcattttgggagtccgaggcaggaggatcccttgaggttaggagttcaagaccggcctgggcaacatatcaaggacccatctctacaaaattgaaaaaaaaaaaaaagggggaagcaggaaaaggtgatcatggtggaccacacaaagctttagaatgaattcttttgagtagcttgaaataaatttgttttagttgaaaggagaaagatcatggtaactgtagctaacttgggccccaaatcagggttttattatttctttaacatactcataattaatcaaaattcttattgttagaaatgaggtgttccaatagcacacaaatttcctttacaaagaagaagaaaagagatgaggtgaaggaaaaacggatgtgaaagccctatttataaaatgtaggtatttgacttcgcttagctgtgactgcatgcattaagaaattggagtgattcagtatgtatgtccaaatgatttgaaaagtaaagcattttttggttgaatttccacacatcttatatggagtttacagatttccattttatcattccagtccttgagcttaaaaaaaatgaaaaaaacatgtacacacatttctaaaaaaaatgattactcaactgatttagaaaagcaatttttatgattttttctcttttaaatgtcttttaatttccagagtcccagatgttaaattaaatggtattgccaggatgttgagggctgattgagtgaattcatggacccgctgttggtcaaatggtttgacttctgtaattggtttaaatgtgtctttctctgctgctttattcccttagaaatcctcagcaggttgcgagggaataggagactttgtggagctgctgggaggaactggattggacccttccaagatgacgcctttagctgatctctgctacccctttcatggcccgggtgaggtatttctttgattgttatgtatgtgcctatcaagattaaaaaaaaataagcactcccctaatattttctacattggaaggtgagtttcgccaaaaaagccttcaatttttcacactgagccagtatgaggatttgaggctatatataacatcagtatctttaccaaaatatccgacactgggagagaaacctttgaagcaataaaggttggccttaagtaaaactatgaaaaagacaaagcttttaaaatctgcattctttccattttcttgggggtctctgctttcattttctagagactaaagagtttactaactgaaacacttatggttcaaatagtagatgtatcatcaattagtaataggataataatgaaataactgttttttatgtatgtgtatgtatgtgtgtgtgttactcatagtaaataaacaacaaagtgataagctttattagaaattcttagaactgctaagtctataacttcttatggctaaactagcctctcaaaggccagtgtaacacagaggtaaattctgaaatctaaaagcggtcaccagtaatagaagactggtttatttggcacagcatatgccaaatagaaccagatctatgtcagagacaagtgagtattttcacttttttatgctcatgtcaggtgaggatggatgggacttcatgacctcatgaccagataactcaatgaagtctcggggaggtgggggagaggagtcataaaacattcctgtaaaggtcactcccatagctttacttcagacacaggagtcctagattaacattaacgagacaaaacagaagaagaacagcagtctctaatctcagttaattcttactgtagcctccttcctctcctgtcactgcagatcattaaccagctaggcaatgaagctgcaaagcagacagtcctcttgatcagctgttacctgtaataattaaaaccaggccagaccaccagtattttctgactctgagttgatgatggacaaaacatctccaaaatagaattaacatacagtcagcccttcttaactgtgggttccccatacacagattcaaccaattgtaatagaaaatattcagcgtaggctaggcgcggtgtctcacgcctgtaatcacagcactttgggaggccgaagcgggcagattactgaggtcaggagttcgagaccagcgtggccaatatggtgaaacccccgtctctactaaaaatataaaaaaattagccaggcatcgtggtgcacacctgtagtcccaggtacttaggaggctgaagcaggagaattgcttgaacccgggcagtggtggttacagtgagctgagattgtgccactgcactccagcctggatgacagagcgagactagacagagtgagattctgtctcaaaaaatatatatatattcagtgtaattcctgaactttgggaggctgacgcaggaggatcgcttgagcccagcagtttgagaccagcctgggcaacatggcaagaccacaccccataaaataaaaaaaaagaaaagaatcaggtaaaaaaaaaacacacaaaaaaatacagtataacaactatttacatagcttttacattgtattaggtactataggtaatctacagatgatttaaagtatatgggaggatgtgtgtagtttacatggaaataggtaaaggtaaaaggtagccatttacataagggacttgaacatctgtggattttggtatccgtgggatggggagcatcttggaaccaatctcctgaggataccaaaggatgaattatacaaaagtcagcactaaagcctgatatgcactccaccctcccccagatacacctatattctaaaagtttcagatgagatttaaggtaggagtgggctcaaagcaagctttctaatcaaggtaaaggcaaaagatttccaaaatcccactttgcggaaaactagaggattctctaatgctaattgacacttgagccatggtttaaactgtcagtgcatgcggcttctttagccttttgggtgcatgatctgaggcactaaagtacttccatgctcatgattggagagcacctttgaggagatatacctcagctgggttaaaaagtaagacaaggattaaagaacaatcaggccttacaatttagataattgaagccaaagtcatttttccgcttgagtgatataacttgaattagaaaaaaaggtgattctaaagccagaaaaccacttttgcctacattacctaggtaactgaaaccacttttaagacaattttaaggcttgaattatatcactctttggttcattttagactttattccgttactggaaggagggccttgagtgtaagttgtccaggttcttggcgttttgaacaaagaattggacaaaacgcacaaagtaacaaaggaatgaaacacaggaacaaagtagccgaagcagggatgtattaaagggagaaagcactccgcagggtgggagtggaccctagcgagcggctcaagggcccggttacaaaagttttctgggtttcaagtactcctttcttttgttttgagatggagtttcactcttgttgcccaggctggagtgcaatggtgcgatctcggctcaccgcaacctccacctattgggttcaagtgattctcctgcctctgcctcccgagtagctgggattacaggcatgtgccaccacgcctggctaattttgtatttttagtagagatggggtttctccatgttggtcaggctggtctcgaactcctgacctcaggtgatctgcccacctcggcctcccaaagtgctgggattacaggtgtgagccactgctccttttgaggttcctatcaattaccctttatctggatgaaggatttggtttgtgggtaaaggctgaggtgaattggcaccctatgcagatgaagagatagcccatgcttgttccacggccagtacaaggcactctccctttccttgtgagatgtggtggaaggggagggttgtagggagactagcctttgatccgtcgctacttgggcttgggggagatgcggtttttccttttggttcagctttaggaagtttgcattaattgggcttaggttccctgcccccagacccaggtgttttccttttgatccagctttgggaagtcagcacaaattggcctcagtttccctgccaccaggccttggtgtttttccttgattcagcatgaattgaccttaagttccctgcctccagaccctattctcctgccttaattcttttctttctttatcatatttccatgagcccctcctgagttgttcagtgttgaactattaaggaccctgccctttacattggattttgttaggaattagttcaaaataataaataaataataagtaaagaaaataggacatgttataaagattaaagtccagagtaagatcagaaaaagaatgacctccaaactgtttaatgaaaaataaatttggctgggtgtggtggttcatgcctgtaatcccaacactttgggagtctgaagcgggcacatcacttgaggtcaggagtttgagacgagcctggctaacatggtgaaaccccatctctattcaaattcaaaaattagccaggtgtggtggcacacaactgtaatcccagctactggagaggctgagttaggagaattacttgaacctgggaggcagaggttgcagcgagccaagatggcaccactgcactccagcctggatgacagagcaagatcctgccacaaaaaaaagaaaggaaaggaaaagaaaaagaaatttggacctcctggtagaagcttaactagactacctggtacttatattaaaataattatagggcttttatttattatgtcatccatttgacttttatctcaataactctattgaactgtttacttcatttaaacccaggtatgtgtttgagtggtacccattacacgaggacaatgatagcatttcttaaaatttaaaaacaccttatagagacaaagtgaggaaaagaaagattgagaaaactaaaacagcagaaatgattattgtagagcagataaatcttgcctcaggaatcagcttggataaacaaatagaataaataaaaggaaagtaattcttaataaaagtaatatgagtttcaatatataacccatacagaggagatataaaagttgtcagatcttatataaataatgaataagattggattttttttttttttgagatggagtctcactttgttgcccaggctggggtgcagtggtgtgatctcgacccaccacaaccactgcctcccaggttcaagcaattcttctgcctcagcctcccgagtagctgggactacaggtgcgcaccaccatgcctggctaatttttgtatttttagtagagacggggtttcactatgttggccaggctggtctcaaactcctgacctcgtgatccacccacgtcggcctcccaaagtgctgggattacaggcatgagccaccgtgcccagctgaataagattggatttaagagaagcaaggatatcagaagccatttcatataaatagtacagaaaaaatcagagaaaagttgtaagtggataataaaacaaaaactagtatgttcagtgtatgtctatacgatgcaaatgatctttttgtttatgtataaaacagtttttgtttaaattcagaaaatgataaacaggtgtttttttttgttttttttttttttggtctacataaatgtcccgcagtacattccatcctctagcccccactaaatgccccttgcaaccctagatcggtgacaaccaaaaactgccactgcaaatttccgacctgtccttagagggccgtactgtttccactgcaatccctgaacccgagcaactgtgcacactccagactgattgcctttgcctgcctttactacttaggctttgcaggcaaaaaaggccgaggagacatcttcttgcctctttccagctagttttattttttaatagtgttcttgcacatgaggagaaagactgaattcaattgcactattctataactaattataagttataataaaaatgaaacaaaaacatttcaactgatagtagatgcatggtttgggtacatgagaggaagataggtctccttgctttcattatgtttaagtgatcccgtcatttaaatgatgactgtgtggtttctaacctgctgggaaacttttatcttttccatccattatagcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggcaccatgatgttgggctttatttgctttcctgagtagtcctctttcttgttaccatcagaaaataatgttatcatgtggtgcagagccaaatgctgaactaaatcattttggacttctcagagctagaactctgggccattgaagtagaattatttagaggagaggtagaattgcagtgtttgcacaggcaacactagctggtcctggcagggaagcgggtgcagagattcattttccgctatcctcagaatacgtgtttttgtcacgatatacatttctacaaagacagcaaggaccttacaacaactctcatagacacaatttgcagaaatctgaatacttctttgatactgaaggcagtttactgttgactgagctttgttccgtgtttggcttaaaactgagtgtgtagtatgtaaaagacatcttggagcaaaaaggaaggttctaagctacaaagaaaattcttttttttttttttttttttttttttttttttgagacagtcttggctctgtcacctaggctggagtacagtaatgtaatctcacctcactgcagcctgcacctcctgggttcaagcgattctcctgcctcagcctcccaagtagctgtggttacatgtgcgccaccatgcctggctaatttttgtatttttggtagaggcagggtttcaccatgttggccaagctggtctcaaactcctgacctcaagtgatctaccagccttggcctcccaaagtgctgggattacaggcatgagccactgtgcccggctagaaaattcttttaagggaactctttactttggattagtagatgaaagcttcaaactatgccataattaatggccttattatggttcctgaaacatatttaatatgattggcatatactgggatcctatacactgggcttgttcacaaaatctgaaaaccaggcagaaaaaaaaaacccaactaattggaagtgtttcaaatacctaggatttggcacaagttttggctcagtaggtattttggaatgagtgactactttagcaaatgatgaataaatgcttgaatggatggatggatggatggatgacggatgactataattcttgattagttatataaaatattggattcttcatttcatagaaactaaattctatgaagcaggaggttgaacccttttcttaaaaaagatagtcactctagcaacccaagaattaaggaagttacttttatcaccatcagaagtttctggctcttaaccttcatgattccctcatgctgagtaaaatacacttttctattacatctcaccatcaaagttaggaaacttcttttattcctaagggattttgcaagctgattagcctctctgcagtaagacaggtgctcctgtggtccttaagccctgacattctgtggtcatttgtgacatgctttacttcaaagcttgttagtgaacaacaggttacattctttgagaggatgtccaccctggtgaactgtccatgtctttttcttggactgtctactacttagcctatgttccaaaaggatggggcagctttctggaaacaaaatggtaaatgaaatctccgggggagatttataggttgtgtcttcattggtatatccatcaagcgagtaaaagtttatatg

SEQ ID NO: 16061 - DNA, 250958 bp, Human
  misc_feature (1)...(250958): n = A,T,C or G
gtagagatggaggattaggtgatggtatgtgagtgtggcaggtatcatttaagaaaacacagggaaagaaatataactttttttttgagacagagtctcatactgtcacctaggctggagtgcagtggtgccatctcagctcactgcaacctccgcctcctgggttgaagcgattctcctgcctgagcctcctgagtagctgggattacagctgggattaccaccgcgcctggctaatttttgtatttttagtagagatgggatttcaccatgttgcccaggctagtctggaactcctgactcagtaatctgcctgcctcgacctcccaaagtgctgggattacaggcgtgagccaccgtgcctggcctaaaaattataatttttaaagtctattcattatggagtaatgatgagctcacttagtgaggattcactggaaggtagtttttctgtacgcgcagagtgctatctatgtgcaaggagccctgacaaattggcaggagacatgaagatgatcaaaagcttcctctaaggatcccctagtttggagagacagacagactgatttacagtggggggcttttctgatgagtgatgtaataaaaatgtgaactaaagtgccaaggagagccaatggatttagattcagagatccatggaattttgcctgagatgatgtgaaaggcaccacctgcagaaggtgggagaatggctttccaggcagagagaagggtggagcagaagcactcagcgttggagggagtggtgtggtcctggaacacggtgctgcctgggagctctggctaaagtgtgggcttcctggatgtggggagatgcaaagtgctctagaacttgttctgtaggaaataggggagccatcaaaagttttgagaggggaagtaataaggaagacggcttctgttggccatggggagaatgagtggaaaaggggtagtggctgagtgactagacctgttctgagagttttatgggagagacattaagacctggactctcgcaatggaggtgcagaggaagattgagagcttctgtacttttctgaaatgtgagagctcagttttaaagtttagattggactgagtttattaaagaaaaagaaaatgtttttgacacatgtcaatctttgttgacacccgttggtatcaatgctgtggggtgaggtctccatgttcaaggaatggagccacaatggaaaattgggagtggtaggaagggggatgggacaaggatgaggacatccatggaagctcctgcccgtttgcacactgctttttttttttttttttttttttccctgagactgagtctaactctatcgcccagggtggagtacagtggcacaatcttggctcactgcaacctccacctcccaggttcaagtgattctcctgattctcttgcctcagcctcccaagtagctgggactacaggtgccccccaccacacctggctaattttttgtatttttagtagagatggggtttcaccgtgttagccaggatggtctggatctcctgaccttgtgatccgcccacctcagccttccaaagtgctgggattacaggcgtgagccaccgcacctggccttgattcacttgttagaaataatactgtaaaaataaaaaaactagccaagtgtggtggcgtgtgcctgtagtcccagctacttgggaggctgaggtgagaagattgcttgagcccaggaggctgaggttgcagtaagtcatgatggcaccactgcactccagcctgggtgacagtgccagttcctgtctcaaaaaaaaaaaaaataaaaataaaggaaaagaaatgatattgtaaaatccaaaggcaaatttctctctctgcctggtgtttcaatactcctgtctctgaatgttaaatgttcagctgcatatgatttttttctgattgattgtctcaggtgtttaatgaagactgcctttgtaaatcacatgttgttatcctctatttctagctattgtggacgatgaaaggctctctgcagaggagatggatgagaggaggcggcagaacattgcttatgaatatctgtgccacttagaggaagccaaaaggtaagatccagacttagtctatttgtgcaccatctcttggagataagctttgtgataagggtgtgggatttgatgaccagagggttctgaaatgggccagcaattctaaagagttgtcgtagttggagatggccagggagagattcttgcctgcactcagtgatttagatttggccaaacctcccatgccaggaggccagtgggctaggggatgacccctccacactctgctccactcctgagtcacagctgggtgcacatcacactcctgtgcatatgctacatagttctaataactcatttgcagtcttgttggcagcaggataatgggagaagaagcatctatttcttgcaaatggttgggcagagttgagaaaaagttgatgccacagccaaagttgaggcactaggaggaaggcaactattcatttccctgcctcggagcctcccaggaaatcacggggccaactgcagattgtttcaaattcttcatctcactggcttggatgtagaggagcaacaatgacttaaatcaacttcctttttccgcagagcttccttgggtcttttccccactcgcagcccaatgatgataaatgcccagcaggacagtggcatatcagactgaagtccatcagtccctaagtaggtttatgacagcaatctcctctttaaaccgtgggtgtgtggccacttagggtatattgtctctaaaatcacattgactcttttaggctttttagattaaataaatgttgcgttctccaaggagaaagtgaagataaagagtcctaagtgcaaatactttcctcatgagaggaattgagagaactttatcctttgtggggtgaatactacagagttcatataccatgagttagagtttgattgaatgctttatgccagggtggagcgacagtattgttccctggacaaagatatgttccagccctcttagctatatagaaataaatacttggttaaatggtcactggtgttaattatctctgatcactgatgaatggctatctacagaactagaatgatgaggtttttaatcagtattttggtgacacatgccctaatttgacatcaaaattgctttcaaggggtttctcagagttgtttaatattttagtagtgtcacgtaactttctttaggctctaaaaaccaagttttaaagattgtttaacatgtctgtgaagtctacagttaggttgcaggatgctagcgattcactatcagtctaagatcattaaaaacatgcttttagtcaagttgtcgcaaaaaagttagataaggagattgattcataggcattagaaagaagtggtcccaaccactcctgaggctaaggtgggaggatcacttgagcctgggaggtggaggctgcagtgagctgagatcgggctgctgcactccagcctgggtggcagagtgagacgctgtctttaaaaaaaaaaaaaaaaaaaggaaaagaaagaaagaaaaagaaaagaaaaaatatactttcagtgaataagttcaaggagatagtagaaaaacttacttttctattgatactcactttacattctgtttttgcctcctgtttttaacaagtgggaaggggtgtcatgtagaggaaaatgatatgtgattgggagttggtttgcctaacttcctggtcccagctccaccacttacacaagcagcttgaccttccacagaccattttacctgtgggaagttcaatttgtcccctctgtaaatgagacaatcaagatgatgttacttattgccctacttattcatggattcaaggatttttaaaaaatcatttaaagaaggtgaaagtattctgtaagctatagtgccagtcaggtttatggtgataacataagcaaagttttctcctcagtatattgaaatggtataaatgtagcttgaaagcttgtcatcttctctagtatttttgaaattctgtagttgaattttgtttcagaaagtcagcataatgattatttcagattctttgaggaaaactttccttggaatagtttcatgaaaataattatcaaaatgtacaatttttcctctaagatggcttttcataaatttatttgatgagtatattagatgtagtatatatttatgaatcttttattaagacacaaatactttttttcttttttctttttctttttttttttctgagatggagtctcactctgtcgcccaggctagactgcagtggcgggatctcagctcactgcaacctctgcctcctgggttcaagtgattctcctgcctcagcctcccaagcagctgagattacaggcgctcaccactacacctggctaatttttgtatttttagtagagatggagtttcaccatgttagccaggctggtctcgaactcctgacctcaagtgatccgcccacctcggctcccaaagtgctgggatgacaggcgtgagccactcactgtactcggccaagacacaaatactttgaaagaagctgatttttggtcatggattatataaaaatttgtggctactactagacatatagttgtgctgatttaagaaagcatagtgcacagaaaactcatggtcttgaatgcaagaaatacaggaaagggtgaatttgtctttcttgaaaagatgagaggatttattgcatgattcttttgaagtattagtacctttggaatttgtgatattgggtttattataatgcacatatgtgtgttcacatgaatggagttgacttagaatattgagtttctactaaattgtatgcttgtactgtatatattcatctaggaagtgtttcttgtttctgatttcagttgaaatgactttattgcattttaattaaaaatgtattggttctgtctttgcacctgtttttctttctggaggtgagaattggaaggtatctagtttgtatatcctgtaacttaagatttttacaaattgagaattataatattccagtatatctttaattttggttttattaatttcaaaattctataataaatcaggccattgaaaagttctttattcagagaggacatcactaccaacattacagaaatacaaaggattataaaggaatactatgaacaattacatgccaatgaaaacttagaggaaattgacaaattcctagaatgacaagctactaaaactgactcaataagagacttaaacatctgaaaaaaactaatataaacagaatgagacttataataagtgaagagcctgacttagaaatcagaaaacttcccacaaacccagataacttcacagtagaattctgccaaatgtttaaagaagaattaagagcagtccttgcaaactcttccaaaaaatacgaaaagagaaaacattttccaattcattcttctgaggcctacattaccctaataccaaaaccagatagccatctcaagaaaactaaagaccaatatctcttatgaatacaaatgcaaaaatccttagcaaaatactagcaaatcaaatccagcaacatataaaatatatttaataccatcaagtgagatttatcctaggaagcaagcttggtttaagacctgaaaagtcaatatcatagaccatattaatggaagaaaggacagaagccatatgatcatctcaatatatgcaggagaagcatttggtaaaatccagccccctttcttgacttaaaacgttcaacaaactaggaatagaagagaatttcaacctgataaaggacatctatgaaaaacctacaagtaacaccatactcagtggtgaaatacaggaataaggatgttttttcttaccacttctgtttaacattgtactggagattttagccaggcagttaggcaagaaaaataagcaaaaggcatccaggttagaaaggaagacgtgaaactatttctaagggatgttttctggtttatagaaaatccataggaatctactaaaaaacagaacaggagaaaacactaagaaaaccccaccacaatgagtccatcatggttgtaggatactaggggagtgtgtaaaaatggcatttcttgacacgagcaataagcaatctgaaaatgaaattaagaaagcaattcactatatgatagcattaaaaacaataaaattcttaggaataaaattaacaaaagaagtacaagaattgaacactgaaaactacaacacattgaaaattttaaaactcttaaatagacagaaagacatctcatgttcatggattggaaaatagcattaagaaaacaatggtcccaaattgatttatagattcaatacagtttctagaaatattcccagctgccttctttttttttaaatggagaaattagaaagctgattctaaaatttatatggtggccaggtctggtggcttgtgcttatcttccagcactttgggaggctgagatgggagtattgcttgaggccaggagtttgagaccagcctaggtaatgtagcgaaaccctgtctctgcaaaaaaaaaaatttttgaattagctagatgtggtggcatgcaccagtagacctagctactctggaggctgaggcgtgaagatcactcaggaggctgaggatgcagtgagttacgatcacaccactgcactccaggctggatgacagagcaagaccttgtctcaaaaacaagaacaaaaataaagtttatatggagatgcaaggaatgcagaatagtcaaaagtgtcttgaaaaagaaacgcaaagttggaggactcatttttcaatttcaaaacgtacttacaaagcccacagtaattgagacagtatggtactggcataaggatatgcatatagatcaatagagtagatttgagagtctagaaataaaccctaacacttctggtaaactgattttcatcagcagaataaagtcaattcactgggagtgagagaagatgcccttttcaacagaggatgctgactactcagtgtctacatacataaaaatgaatttggacctctgcctcacaccgtatacaaacattttcttaaaatggattattaacctaaatgtgagagccacaactgtaaatctctccagaagaaaacaggagtaaatctttgtagccttgggtgttaggcattggtttctgagctatgacaccaaagcacaaccaataaaagaaaaacagataaattagacattataaaaactgaaaccttttctgattcaagagataccatcaagaaagtgaaaagacaaatcatgtgtctgataaaggttacatgtattcagaatatacaaagggttcttaagtcgggtgaggtggctcacacctgtaatcccagcactttgggaggctaaggccagcagatcgcttgagcccaggagatcgagaccagcctgggcaacatggtgaaaccccatcgctacaaaaaaatagaaaaattagctggatgtggtggcacatgcctgtagtcccagctactctggaggctaaagtgggagaattgcttgagcctgggaggtggaggttgcagtgagctgagatcacactgcactctactctaacctgggtgacagagcaagactctgtctcaaaaaaataaaaataaaagtaaagcacttttaaattctacataaagagttaatagcctaattttaaaatgggcaaaagttctgaatagacatgtctccaaagaagatacacaagtgatcaataagcatatgacaaggtagtcaacatcattagtcatcagggaaatacaaatcaaaaccacaatgagatgttacttcatacccaccagcgtagctataatcaaagatggacaataacaaatgttagtgaggatgtagagaaatcaaaactcatacattgctgaacagattgtaaaatggtgcagctactttagaaaatagtctggcagctctttaaaaaattaaacagagttaccatatgacccagcaattatcctcccaggtatatacgaatgaaaattgaaaatctatgcccatacaaaaacttgtactcgaatgttcacagaatcattattcataatgacaaaaagcagaaacaatccaaatgtctacccactgataaacggtgatgtatccatacaatgaaatatttctcagctataaaaaagaatgaagtactgatacatactacaacatggatgaaccttaaaaacacgttgagtgaaagaagctagacacaaaaggccacatattatatgaaatgtccagaatagacaaatccacagagacaaagtagattagtgattgccagggcctaggggaagaagagaaatgctgggtaactgctactgggtatgggatttctttttgggctgataaaaatattctaaaattgattgtggtgatggttgcacaactttgagtatactaagaaccactgagttgtttactttaaaagggagaattgtatggtatataagttgtatctcaataaagctatttattaaagataatttccttacactggcttggagaggtccttaggaagctgttaaataagatcaattggtattagcagatacattgcatatagaaggtacccctaagatacacgagatatctaaatactgtgtttgttttacagatatttattgagcatcctttatgtgtaaacaagcctaggagggttgttttgggagatggagttcaggcaacaaataatgctgtgctcagaaaaactcgccatttggttgaactttttactcaagagtttaaagttattttccttcatttatgtttgctctgttaatctctctgtatatgtgtatcatctccatatccagccatcatcctcctaaacagctctcatatgttcacctctctatcccaccactgctagcccgccaaaggattccagcatctcttgtgagactactgtagtggtccttaactggtttcttcatgagtctctagcctccttcaatcctttatctgtcttatagtcagataaatcttttcaaaactctgagcaaactcctttacttggcctcataggctctgcatagtccagttcaacctctttagttttacattgtgccgcactgctctgtgcttcaaccacattgatctgttttattccctgttccctcctgcacaggaccttgccatgtgctattcgcttttcatattcctctttatctagtcagacttacttcctcttcagattgcagctcactttttcagggtatccttctctggcttccacatccaggtcaaactcaccgattagaaggccttttgacatcacatctattgcatgtttgaatgaataacgtaatgcccagtgttggatcagtatcattcgctactaaggaggtttgattatgctctgttttctgtacattttggatgttggaggtaacaaggaggatatgaatcagactcacggtagacagctagactgccagcctagcggtaatctttgtttcactggaaaattctatattgcagttagatgatgcaagtccttcccgacaggtttgtgacccagtaagttatgaagctgggaattccagacaacttaataagccgtgataccacagtgaactagaaaatatccagaaaggcgtatagagtattgctcaatgaatgaatgaagagagaaagaggaagcctgtgtattaggaggacttaaggctgaaattattgctcaaactttataaaattatgaagtctttacgtatagatgttaagactcaaaaaatgaattttttttttttttgagacgtagtgtcactctgttgcccaagctggaatgcagtgcagtggtgcaatctcggctcaccgtaacctccacctcctgggttcaaacgattatttctcctgcctcagcctcccaagtagctaggattacagaagtatgccaccatgtctggctaatttttatattgttgtagagacaggatctcaccatgttggccaggctggtctcaaactcttggcctcaagtgatccgcctgcattggcctccaaaagtgctgggattacaggcatgagccaccgctcctggcctcaaaaaactaatattgatggcaatgaacaaaatattaaacaggcttttttttttagggccaaaaagaagtaatttggctcttcacccaaattacttcaccctacaggctgaaggattcagatgaagtggagagtgaatcacttctgttaagaggcaaaggatgtcttgtatatgtattagttgcctatgactatataacaagttattctaaaacttagtagcttaaaacaataaacatttatctcggaatttttgagggtcagaaatctgtcattgcttaactgggtcctctggttttgggtctctcacaaagctgcagtcatctcacagttcacgtggggcacacccacttccaagccacccagtgacactggcaggattcagtttctgacaggtttttggactggagatctcagttccttgctgctgttggccagagtcttccctcagttgctcaccacttgggcctcttacacatggaaacttacacatggcaactggtttccatcagagtaggcaactgagagaagaagatggaagctagtctttttgtaacctattcttagcaatgacacccatcatttatgctgtatcctattcattagaatcgagttactaagtcaaggccatgctcaaggggaggagttttccacaaggggttgaattcagagggatggggatgactggggcaccaccttagaagctgcctttcacagggtgtcttcataggcttttgaaatggaccccagaaagggaatttgaggataaaattatttttgttactattagaaactcaatcagaaattgaatccttcctgatctgaatgcttacggttctaagcttactgctgccttgattgttttttgttggtttgtgtttttgtttttaattttaagggtcttgctgtgttgcccaggctggattcaaactcctgggctcaaacaatcctccagcttcagcctcccaagtagctgaggctacagttgcttgctaccatgcctggcaactcccttgattttttttaattgggagctgttttaaactaagccttttcatttctttgtcatttaaaataatactaaatggactttttaggtttccttttcaagtaggccctcaaagctaactttatagcttctttgctgtggggcttttgctgaaatgaaactgtacagacaagtctactactaatatgggctttgaaatgtcctctctgatgccagaaatcctactatttaaattaaaggagtaacttttccaaaagaattagtactgctgagtagattttatattaatctgcctaaaatttattcaaataatgaaaatgaatctgttttaagaaattcagtcttttagtttttaggacaactatgcaaaaatgtacgatggagaattctttttggataaactctaggttgaggaacttaatccaaccggagctattgtgaaggtcagaaaacaggagagggaatcttggcaaggaatggagacggagtttgcaaattgcagcttgagtaaatagttatgaatgggactgctattgtgtctcccaaggaaagttcctgtgatattatattccttttttaaggaaagagaaaatgcacagaaaacttttgctgtgcttcctttttctgtcctacctctgaaaataaactaagcaaaaaaaaaaacaaaaaaaaaacacccttcccttggtgataggcttgtttagaaatattatcttcaaaggtctctttatgtaagccaagccattggctatattggtgagtctgggacagttatatatgtgccctggaaagaaaacaaaacacgggtgtgtttccttttgtgtcagtgtttacaactcagataccaaaagaacaccttgttgattaaatcaagtctcaagctctggccttatctagtggtgagttagagaatcagatttgaaaggagaagtgcttcaaatgtttaagcaagtgaaagccatgagttgcttaacagtcaatattcatgattagtttaaaaaaaaaagagaatcttctgactggggaatactttagagaatccagtggatttcctctgcatgcttggacctcactatccttattcctaggacatacccatggataagcaatgctaataagaacttggaatttccagggaaatatttttctttgttgctctacacacaaaatagtaatgaaatttttaagaattcctaattgcattttcaaaacataaatagttttcatgtttccactgtaactctccatttctcccttccctcccttgttctctccctggctctgacctcacctctgctttccacggggagcaagatgaactgcttggttgttccatgcggcagctggtggggcagagggtgcagtgagctgagagcagggaccccctcgcaagtctggcacctggttgaggggaaggcctgcttggggctgctttccaaccagcttgcctcaggagccctgtgccagcgaggctgagatcagggcctggcacatcccaatggcagggagagagtaacttgtgaggagcccagacttgtccagcgtagcttggcagagttggagaggtggtcttaacagggtgatctccgtggcacaggaatagacgtgatcccagccagccctacctgccaacaagtagtgcttgtagttggggcctcagagaggtgttggtgctgagggccagctggcggtgaccagggattatgctgtggagctagaatggaaggaacacttattaaggatataaaggaaaaagctacaggacttggcaggggtctggatttgggcagcagaggaggacactgggaggtcagatgccctggggcagatcaaggcattgcttatctgactcagcaggacacatttcgtgttctctgtctgccaagcctaggcttgggcatatagtaggtggaaaaagttctttgtttttagtttcacatattgtactagctttggatgtatgttggacaggtgccaatcgggtatgttctgacagatgaaagtataacttttcagagtgctggtattttaaaatacaaataatcggtattaatcatctccagccaaagacaagttgagcaactgatatttgatcccaaagtttatatttgtttctcaggatcttcaaagttggaaacctgggagaggtttggaattttccatggttgcaaatgtactttactcacaaggattatcacacgagtgtctactcaccaggcacggtgctttaagcattcaacccacatggtctcgattctcacaaccactctgtgggaaggagcattatccccatttgatagatggaaaaaccaagtcttggaaaaacttaagtaatttattcagtgtcgcagccaacaggcgacagcaacagtattacaacctaggtctttctgacttcaaagactgtgcttaaaaactataacatactgtcccatttctttatttcttaatgtgttttgatcatgtcttccttgtaagtccaaaacatggtcttggtttttaggttctatatgggctagttctagttctagctcttgatcaataaattctcacttaagctttggtggaattagcacaatatagctatccattggctatatatggctatatattgttttattttcctttctctttttttttcctgtgaactgtttctattttgttttaactggtactattataagtagtttgttctgggaataatttatcttgtatttaccttgtgttcttcctccctctttctccttctctcttttgctcattttaggctagctctttcttgctctctcttttttcaattaaaataaaatagagatgagatctcactatgttgcttaggctggtcttgaactcctggcctcaggcagtcctcccaccttggcctcccaaagtgctggaattacaggcatcagctactgtgccttaaagtattattaagaatttgtacttctctatgatgtagactttattctgttctcttcacccaagaaaattttggtgcatctttattcttggttaggcctccatactaccttcaattcatcaattatctttttggttttgccactattatgactggtttcaaagaatgcttggctttttgttgaaacatcaaaaggtatgagtagcaaacagcactgagatctcttccttcctgtgtgaacctccccaccggaagctgcctcatgctgtgatgcttaaaagtcataaaacggtatcattattcaaggcatagagtgactttagggaagctggtgggggagaacatttgtacaaggttgtcacagaatgatttctttgtgtcttccatttttagggtgatatagaatgtagagcgatcttccattgccttctcagtctgaacacctttgtttttctttaacagagtcaaatccccatttcatatatggggatactgaggctcagaaatttatctcacttatccatggtggagttagtggtagatttgggattaggataaaggtcttctgactgtttgacagtgctctttagttccatgagtctctatacaccatgttgagtagtaaaagtagaaagctcaaatgagtctctataaatcatgttgagtagtaaaagtagaaagctcaataaagaaaaaatataaacatgaatattaaacttatttggtagattcagttcaagtttgcttttggttaaatgctgcaaatggtttgggggaattagccattcatatgttcttgtccttgatctttcatttttgctgagaaacttgaacccattttggtgcaagaacaggaattcaggaattaacatttctagtcatttctgcactctgtactccgtcctacttggcttaatgtccctgggttgcttttttgtttgtttgttttttcccatcgtgtgatttgtaatacacagcttttcctgcccctggtatttctcaaggcaagagttgaggcagctatgtcatctgggagagtgacttagggcagtgatccccaaattcatttacacctgcatcaaggtcacttggatgcttgtgtgagtgcaggcttctgaggatcactcctgaccctataaggccatctctaaggacaacctccgcctcccaggttcaagcgattctcctgcctcagcctcccaagtagctggaatcacaggcatgcatcaccacacctggctgattttgtatttttagtagagacggggtttcaccatattggtcaggctggtcttgaactcccgacctcatgtgatccacccacctcagcctcccaaagtgctgggattacaggcataagccaccgcgtccggctgaggtctgccttttaacagagcactggagtacactattatgcacactgacatttgagatagcatctatggctgaggctgtctcagctctcagccttcccaccccagcttagaaaaaaggaacagaggataccccttcctctgggatgagaggggagagaggaaggatactaagagtcaccatctgctgaggtgaggagggtggaggcatgaaaaagcagtagtgcatcagccagggttggatagaaagcctgagtagttttgaagatccaattagtgttataaatgttctttgcagagccaataagcattttcatgtgaatttctccaacaagataaaagaatggggtaactatgcctagggattgacctgctggctctgaccaagtcataggtgttggggctcagacactgatgccccaaaatacagcattttgacattccaaactgaagaagcttcaaggtgtctctgacattcctgcatcccacattctctttcaaaggctttatctaccaaagatcgagacccaccaggggaaagaattgtttttccttcccctccctgtaagaccgggaatgtggccacacctgaacagaacctttcacaggatgacatacaggttaatctctgttccccatcccttttccttggtaatctcaaccaaattccttttctgcccccctcccataacctgttttgctgggatggtagttaagcttctgagtcacttgaggggtgggtaaacatgtgagtctacttgcgtacatgttaataaaacttatatgccttttctccaattgatcggccttttgtgagttgattttttcagagaaccttcagatggcaaaggggaggatttcctttggcctctgcatgggaaacagggactccagggtgttcatgagagtattgctgaaattgggttcttgaggtcccatctggccgaggagcctatgaagccaggatgggaaagatggagtggggtgaaatcaaggaaccacctacaatgagaataaagggcaggatctataagaataaggaagtggagaagtgagtaaatagaaaggctatagtccaagatttggaagccttgatcttacaggtggagtatttccaggtagtgataacgtgcaaggtgtggtgcctgtgtgtggttggagtgtagtggaggagtgttaccaaggtcatccaccttcttgaagccacccagcagaggcaggcctgggaggaaggcagcaattgtggcaagaaaggaaaagtcctggaggtcaagaaatgagtggcaaggttaggggtgagagggaagagtgaagccctgagaagtgaggtgatggacaggatgtggcctgggagaaacgtttatttgggaaagtgatgactatcctctctttgtcctgggagtcaaggaaatttggcaaacaaccacccctggagtgggtttatgaggggtgggattttgaagcaaaagccagcttttcattagacaagtaggtagagaaagtgtaaacaaaaagtgataatataggagaattacaacgggtcaggagttcagaggctcattggaaggagtgagtaggcttggggtatgtttaaggagggctggttagcaggatggagacagatgactttatatgagttctgggggggtcaggacttttactagagtttactaggaaaccaaatccactgcagaaacaggcatagatttatgtaactgtggtaggggcccattagagatcttgtgttactgatttactaattgtgctactgatttattactaattcattagctgtgacatacactttcagcaagtgactaaaaccttatgacccagagtaaaataattttatatcatgacccaggtagctgtgtgatatgtgtaataagtgggcgtgtgtgtctaactaaagattcaccgagcaacacttaacttctactatatgcaacagcctcttatgtttactattctgttctgttctaattcattttctaagaaaatgctggtcatgaaccactgtgttgattttatgatccgttaaaacattacaggtcaggcatggtggctataatcccaggactttgggaggccaagatgggtagattgcctcagcccaggagtttgagaccagcctgggcaacatggtgaaaccctgtctctgcacaaaatacaaaaaaaaaaattaaccaggcatggtggtgcacgcctgtagtttcagctacttgggaggctgaggtaggaggatcacctgagcctgggaggtagaggctgcagtgcacagtgatcacaccactgcactccatcctgtgtgaaagagtgataccctgtctcaaatcaaaacaaaataaaacattacagccgcatttgaataaagtgctttacactatcttgagcatgttttggtaatagttatgttctgcataacaatatcccataagattataatggggctgaaaaattcccaatcaaagcattactcacgtgtttgtggtgatgctggtataaacctactgtgctgccagtcatatgaaagtatagcgcatacaaatgtgtacagtacataatacttcataatggtaatacttatgttactgctttatgtatttactatgtttttatgttatttttagagtgaactttctctacttaaaataaaaagcaaattgtaaaatggccccaggcaggcccttttggaggcactggaggagaaggcattgttatcataggagataacagctccatgcagacctttcagtgggacaagatgtggaggtggaagacagtgatattgatgatcctgactcatgtgggatcttgctaatatgtgtgtttgtgtcttagtttatagcaaaaaagtttaaaaagtaaaaaaaaaattaaaaagttaaaaatagaaaaaagcttatagaataaggacataaagggaaaaatatttttgtacagcagtaaaatgtatttgtgttaagctaatgagtcaaaaagttaaaattcaaaagtttataaagtaaaaaagttacagtaagctagggttaatttattattgaagaaagaacctttctttttctttttttgagatggagtttcgctcttgtcacccaggctggagtgcaatggtgtggtggctcacgcctgtaatcccagcactttgggaggccaaggcgggtggatcacctgaggccaagagtttgagaccagcctggccaacatggcaaaacccctatctctactaaaaatacaaaaattagccaggcgtggtggtgcatacctataatcccagctacttgggaggctgaggaaggagaatcacttgaacccaggaggtggaggttgcagtgagccgagatcgtgccactgcacttcagcctaggagacagtgagactccgcctcaagaaaaaaaataatttagcataccctaagtgtacgatgtttataaagtctacagtagtgtacggtaatgtcctagggcttcacattcactatactaaaggacagtgacacaagtcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgcgcacatgtaatcccagctacaggccgggccccctttttatgtttagatacacaaataccaccatgctacaactgcctacagtactgagtatagtcacatgctgtatgggtgtgtagcccaggagcaataggccatatatcctaggtgtgtagaaggctgtaccatctaggtttgtttaagtgcactctgtgatgtttgcgcaatgacggaatcacctaatgacatacttctcagaacacatttccctcattaagtgatacatgaccgcactaggtgctgcttcctaggcatctctgggaggaagaacattaattttaattttctgtacctagttcatacttggggtttattgtaccatctgggagaaaccaggaggtgtttagttaggcctttccctgctcacaactttcataggctccgttttccctgcaggatcatggaagggcacctcctgagcctggcccaggagcccatactcaccccttttacaccgcctccgccttcccgccatggttgatcgttctctcctcagttatgcctcaggtccctgtcctgcttccactgtgcatagtatgctttatggtaactttctccatgtgttgtcctctcttagcagtcagggagctccctgaggaagacattctcactcgctgtaccccactgccttgcacggggcctgtgcagaatgggtgctaggttgctttgcctgagtgagtgttgtgatctcagaagttctggcttaggcttcttgtccctgtgcttttgtctagagaggctttgtgagggacgctgattctgttggatagcctttgaatgattttcattctcaattgcatggatcgctttggggaacacagaccagctggctgtgcttggcagcaaggtgttgtgtggtggaaatggctgaattccacatatcctctgttactcacagacatttaggggagcacgtgccatccctctcacaattttgaatacataggaccgggtgctcctcacccttccatttcagtgggatagtttgtctagcagctgctctgtgctgatgacattatgaaatagggattttaaaggacctctgtgcaaatggagcccctcaacccctgacgatgtgttctgcacaaatagatttaagtaggctttttatgcatcagaactgcctgcaatctgaaacacaccaacaagacaggttcaaggatgaattaacaaaggttcagcagacttaaatgatattcagaagtcttgtggctaagtcaaattataaataaactcatgtgtgtggtgtagaactgtgtgtgtgtgttggttttgagagactgatagaaggaagaagtagatggagtattattttcttactcctgatgtgtctcccaggctggatgatgacaaagaacaaaggagaagttgtcaggctcagtcaaggagaagggaggagcgatatggtttaagtgtggaggaagagaattgaagggacatttgtgccactttacgcacccacagagctgtttgtgtaggtgggggctgggcagggagtgtcaccagagactttgacttctctgcctcagaacttcactcagtggggtgtctgtgtgcctcagattaatgtcagcctgctcagggagaagcaaatatgtgtcctctgagggataaggcacatatttcacataccctctgttctggatggagctgagctcaagggactgggtggagaggaggtcctcttctctcaaacatggcccttctttctcgcagccatacttttgctaatcccctctctctggaatagttttcttattcctttctccctcaattatcattttactccttttaaagtctacctggtcttcatagatgaacccagagcttatcttttctctgcagatttcttggtcacccaaatagtggtaatttttcttctgaacgcccctagcacttactgtccatatcacttctgtgtcatgtataacagaatagcagatggaggaagctcagtgtttttgtgtctcatatacataggcaacttccatattattgttctgtatgttatcttgtctccccaaatacagccccaatgtgtcaattcttaccatgtctgctacagttcctaggggattttgcagggggaaagaagtgagttgtcatgtaaatgaaataatggtgtaccttgactgaggatgtgagagaattttttgtgcatccctgggcacacagctgtcttagtctcttgtgcccctataacagagtacctgagactgagtaacttataaagaacagaaatttgtttctcgcagttctggagactgaatgtccaagatcaaagtactggtgggtttggtgtcccataccagctggttatctgtttccaagatggcatcttgtagctgcatcctccgttggtggaagtgatggaaggaaggtcaataaggccctacctagttccctccagcccttttataaggtcactaatcccattcatgagagctctgccctcatgacttaatcatctcctaaaggatccacctcttaatgctatcacaatggtgatgaagtttcaacatatgaatttgggggcacacattcaggccatagcagcagccttatatgggaactgacaatattgtctctaccggggctgtcctctatatagaaatataacaggagccacatgtataattttaccttttctactagccacattaaaaaagtagaaaaacaggtgaaataattttaatgtattttatttaacctagtatatcccaaacgtcattttaatacataatcaatgtacaaaaaaagtttttttttttttcgagatggagtctcgctctgttgctcaggctggagtgcagtggcacaatcttggctctctgaaacctctgcctcctgggttcaagcaattctccggctttagtctcctgagtagctgggattacaggagtgtgccaccacacccagctaattttttgtatttttagtagagacagggtttcaccattttggccaggcttgtcttgaactcctgacctcagatgatctgcctgcctcagcctcccaaagtgcagggattacaggcatgagccaccacacccgatccaatgtacaaaaatattaatgagatatgctactgtcctttattttatactaagtctttactaactgatgtgtattttacgcttacaggacactgcagctcagactagctgcacttcaagtgtttaatacttacatggggctagaagctgccatgttggagagaataggccctgcattcttgatccttagtctaacaggagcctcttagggatcttctgattattccaggaagaagcaagaaaggttacagggttgtgtttcatgtattaggaggcaaattaaagctttaagagaatagaaacagagaatttaccaatgaggtgcacttaacttttttctcccttagttttcttcccatattcacatttaccacagaaaggagaaacaggaaaaatttacaacagaaaggagaaactcaccaagtacttacgcaaatacaagtagcgcatgggatgcattctttttcttctgtcctgtgcacctgccttaccttttcccagggtgagtggatgatagcgtggcatctttgcaggaagagcttgtagagaagaaatggtgattccagccacctcagcctctgcttctgatagcctcttgctttgttcctgaagttaaataaccaaaatatatgcttataaagtggtgatgaaaaattacttcttggtcaataggtgtctctgatggcagcaaatccatgttgcatttgtctttttctcttaataaaggacttgatggactgtgacaagattggccacctattttagagtcattggaattaaattaagacatgcccacactacctaatttcataagggtggtgctggagggagaagaggatagtacatacagaaggaagagggtggcccaatatcgacatgttaatacccaggactaaaaacaaagtctctactgttataaaggccaggaaggatgttctctttctacccaggcaaacactgtccaaattttatccacaggaaaatcaaggctcagttattcattgtgtacagctgcagaaacaatagaaaatatagccccttggttatcagagcagcattatccaaataaaattatcaggctcaatgtagccttgactgaaatgtgtggaggtaacatgctgcttttgttcttctaaaacaatgtatgaaccatagtcgatttatttttcctagtcctggttctgttagtgcctgagtggccttgagcaaagcactgtctctgtggctcaacttctgaatttatgaaatgggtccaggaacacctttcacacctatatcccagcattatgatgtgaaaagcagcctaaaaattaagcgctacattgctatgaattgtaaagtgtggaaacatggaataaaatacctcttaagctccattgtttattatgaaaaacattttcagtagtaggaacagctgtgaatcaggcagcccaacttaattagagtcaaagaatgtgcgccttcagctgctttttattgatagtgtttgcacgtttacttcctgaatagcataaatagaggtggagtaggtttatgcagggaagaataagtacattggaacaacctagaagtggaatcttccttctgtaaacaatattctcaataccagatacaggcccctctgttgtagcaccgggagagtaggagacctctttttaaacctagaagtatatgcatgtggttaattatacatttacaaggtaaagaaagcatccatcaaggaaatacttggagcaatattggcccagcaaattcagcttttaaatataattcgtattggaacaactggcatctccttcagaaagaaaaataaggtggtcaaaatgttgattctctaacctaccatcttggatagggctggatgttaagtcactggctcttacaggtgatgtgggcagcacgtagactgggtgttttcgagtcaagcgcataaaaggctgcaggttttctcctggccacccggggcactgcagtaggacggcacctctcctgaaataaagctaatttaggctcacctcagctcccccatgggttgggatatgtgtgtgtctgctcttgctaagtgccagatttataattttgttctcttatgctagtcctgcagcctcttctttccatccccaccccatgccagccaagcagaattggggggatggggagaggactctaaacagacagctccttagcctctcagaggcccctgggaagagccacaggataggcaagggtcaagggaataatagcttttccttcttcctgagaagccttctagaattcccctaaagaactaggggacgcaatgtgaatcaaatagagaagccttcctgacttcaggatgttagggatacacattttttgagggcggagactctcattgttcattttttttttcctgtccagcaggttctcggtgtggtggttaaaatgacttccagcttgggccccagacatttctttggaagaatcttgctttaaaacctaaatttaagctaagccccatagaaagagcaaacgaaacttcaaagaactcaaaatagagcatgtaatttcatgtgttgtgaaggcttatgaggaaagtggctttagtcaggtgtcaacaccttctcagggttacaaggaataacctagtccagctgccattgcagatgtgggggcgcaggttgtgacaggtggcccctcaggtggggagggctgtcttagtgctagctggtctccacttgtctgttctgcttcccacttgagagtactgtgttcattcctcctttatggggtgttcccccatcatgtttttaagtgtcagaatgttgggcagagggttcttttctgcatcatcctataaagcaatcactaaatatatcgggctatgaagcacttttcctttaaaaaaaatttttttttctttagaaacggggtctttatgtaacaaacctgcacgttgtgcacatgtaccctagaactgaaagtataataaaaaaattaaaaaaagaaacggggttttgctctgtcaccaaggctggagtgcagtggctcaatcattaatcactgcagctttgacttcctggactcaagcagtcctcccacctcagcctccaaaagcactgggattacaggtggcctcatttctctctctctctctctttttgttattgttgttattgttgttgttgagacggggtctcactctgtcacccaggctggagtgcagtggcatgatcacgactcattgcagacctgacctgggctgaagggatcctcctgcctcagccttgtgagtagctgggactacaggtgtatgccaccatgcctggctatgcttttaattttttgaagcaacagagtcttcctgtgttgcccagtctggtctccagctcctaagcaatcctctgacttggcctcccaaagtgctgggaggtgtgagctatggtgtccagccttcttttttcaaaatcattttcatacctgctttccctataacacctcgaggtagggtgcgaatgggcacagaggcaagagagctgagcctatatccagagcccaggccagaacccaattctctggatgaccatgcttcttcggtaagtatatttttgtggaatatttggagctcttttgacacataaagatttactaaacaacatattcacatatggcaaaatattatctataaatagcttcaaaatgtctttgctttagttttaggttctgatttgctgtggtgtagtgaggacagaatttttcttttgctgtattttaattgcaatagcgagtaaacaaaccttttttccccccttggttatacttttctttggtttccttggagttttccttggttacattgaaaaccacccagtatttgcatttgcatgggttagttcttaaagtcctaagtgggtcctagtgtttggaggttttgtagaaatcatatctttgtgtagtacaggccacacatggggagttgaatgtccatgtagtcattggagaagtggccagagttgggtgtcagagctgctgtttggacttggacagatcctgagtgtgtcatccttggccaggcactcattctgtacagccccccaggtgtggctctagggagagagcaggtatgcactgctgggtctgtcctgttctctgtagcttctggatgggaggaagggtgaccttttccaattgtattttatatatttgacatatttcaagtacattttaactttgagtcttaattttatttttttccacagctttagtaggaagattttcaatgacttcctcagcacatacaatttttctggttttaatttttgtaaaaacttgatccttgatgtttagattcacctttttctccccttaaaaatccagccaagggccaattaatgatagttgctatggtaactttggtgaaattcagaatgttcctaatgcaaagagcaatatgcttgaacagtagatttcatttaaaatgtagaagaagaatttgctttggtataaaggtgttcagctgaaccttcatgaagaaagttgccaaggactgaaagtgcaaaaggttatagtttgaaaagcttatcatgggaatttttagccatcttttaaataaataaatctcatttggttgcagcatgtttgccctgtacataaataaagcttagattttgtttgggtctccaaaacatggatttaaaattctgcccagttttatgtcccctcatcaaatgattttaccatgtattagattataatgttagtgatgtttctggcttatattaatatactgctttatgttgaaataaactcattttcatcctcaacacataaatttcatcaatttcagaccttaagcacggttatcaacctgttagatgcttctatttgactttgcttaaatagcgctgaaggcctgtcagatgactagggggaagtttttcctaaacaaattcaagttattttgccaattcagtgatttttttttaaaaaaggatttctttaataaaatgaatgttatcacacccttaaaagtgacaacacccatgtaaaagaagctgattgtatatctaaatatcataaaaaagatcattgaatttaaacttcttcagagttttgttttgttttgttttgtttgccactgtagccaccattacaagctcagttataagtaataagtgaactgtttctcatttattttcctttttatatctgtcctaggcacattttcttacctaggagtttactaatcatttaacctgaggactatctagaatatatgatgtttaatattttagtcacctgcatttatcataactgagcatttgatccatgccaaacactgttttaagcacaatagtgtttttttaatgtaatatataatagtgacatttttacacactttgattgctgtgtaaatgtttattggtatttctttctttctttttttttttttgagatggaggcttgctctgtcacccaggctggagtgcagtggcacaatctcagctcgctgcaacctccgcctcccaggttcaagcagttttcctgcctcaacctcctgagtagctgggattacaggtgcccaccaccacgcccagctaatttttggatttttagtcgagacagggtttcaccatgttggccaggctggtctcaaactcctgaccttgtgatctgcccaccttggcttcccaaagtgctgggattacaggcgtgagccaccgcgtctattggtactccatattgtcagtttgaatggggggatgtggatgcggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaatactcagacacatggaatatgtccagtccttttcaaaattcaaaatggtagaaccatattgggaagccatgactggggacaaggaataagctttatcaggccctagtcagaaaggagtttagggctgactggagttgtaggacatgggagcctatcctcacatctggggatcaccccttgccgttcatgtgaccttgaatgatcactgagcctctcatctgtggttttcttggggaatgataccaagtcataggactgctgtgagcactggatgtaataatggatacaaaaactgttttagcagtgagcacagtttccttgggacttggtaactgatagctgtcaattcctaatcctcatttaaattattataaatgtgaggtgaagggaaggagaaattcttgttagtgagaaattagcttactctttggcatcaaagtgtgacatttgtctgtggtatctgttaatcaagttctattgatcaagctaaggtcagatccttctcttatagattaaatattctttttttaaaaaaattattggttgtttttttcttggttttcagtttataatgaatgcctatcttttaagattgacctaggggagcagtgtaggataaaatatcaagttccctgcgaaagattctgtgcttctgaataacaataaactacaaggtcaactttctagaataaaattcttctgatctaaaaacatatccatttggggaaaggtcagagaaactgagattcaataattcatcttttgagggttcatcttgtttatgcgagtcatttctttgaacagtttgatcaggttttgcttcagtaagggaggtacgaagatacaaggtacgtgttgcctcaaggagagaggttgtaggtttgccctttcccctgtaatggccggactaatccaccagcttatattaggaagattagccatctgttagcttctaaaacagaggcaaaagtttctgctttcagattctcttggtgtgcgggcttgggaaggacagatgggagctaataaatatcataccttgaaaggccaagcacccggctgagttgtcctatccactgttaagtccagcccccacagcagtcctgtgatgtaggtgttgttcctcccttcaggtaggaggttcagtaatcattcagggtcacacgactggaaaaggctgaccccagatgtaaagccaggctccccgctccttgttcttccactgtgttctaaactccttcccagcttgcgcttgacacagccttgtcttctctccctccgtgcctcgcagtggtagggttccatggaacacgcaggtgaacagtttgacctatggatgagccgatctggagagcctgcctggtgggagcaggttggtccctgcagtccagagtctgcacacagtccttccagtgagtgtctctggaggctgtatttcctgattacaactctatagttttgtctactagagctgacacctttgttttctgtcacttctcaggccaagaagtaactttttttaggaaaatatctttttccagtaaagatgtcctttcatctcgccaccccacccccatccctgacctcttctacgtgcagtcttttttgtttttgttgtttgtttgcttgttttttagatggagtctcgctctgtcccccaggctggagtgcagtggcacaatctcggctcattgcaacctccgcctcccaggttcaagcaattcttgtgcctcggcctcccaagtagctggggctacaggtgcacacctccatgccaggctaactcttttggatttttttagtagagatggggtttcaccattgttggccaggctggtctacaacacctgacctcacgtgatccgtccgccttggcctcccaaagtgctgggattacaggcgtgagtcaccatgtccagcccacatacacttttaaaaataatagtttatcttgataaaatctgaattaagctgttgtttttatgaggattgtttctgactcctgtttctcatttcccttttcacctcccctgtcagacacatacactccacgtccacaccacacatatgcacactgcggacttcaccactcacattcactttactttgttaatctggctgcaaggaaatttcttagcccttgacacggtatgtgaagagagttctgttggcagctcaccatggtatttcaaatgtgtgcctcaaattgagagtgccggttggaaataacaattcactctaagcagtgcttttcattgaaatgtaaattgccttatacccgttttcattcttgcggacttctcaggaggaagacaggttttatgttacaagcattgaagagaaaatctttctcctggtatctctttttttagtatgcaacaagattgaggatgattcatttaggcaactctggtctactctaggagcttgcatatctaacaatatgcagtattctcaggaattttaccagtgtgggattgctggtactttgaggggagaaggataacttcatatctggatttaatttctgagttaataaaccgccatcaccctggaatgcccatttttatttgtttccttatccatttatgaactaccttaaggcatttatcaaatagtgacttaaatctaaaaataaaattaatgtcctttgtttggaatgcttttagagaccattaggacttaggagcagtgcagtggatgtggagagaatgaaagattcaacaataactacataaaaccctaaggtcccactcaagtggggcggcctggccaaaatgtagctcaaaacataatagtggctatgagaaaaaagctattttgttgtcattgttataacacccagcaaggaactgtataggttatagggccttttaaaatttttcagctggataccactttatttttattgtgactttcaaacacgaaaataccattatgttaaaaaaaaatactatggaatctgtgtggcagaatgtatttaagctgaacagattaaggctgtaggaccaaagggctgaacaaccttgagcatttttctttaaatattcaagtttaaaagcatattccttggcacccctaaaaggaaagcccagtaaaatgaatatgacatttagaatatgtagcattggagattttcatcttttttttttttttttttttgagtccttgggtttatcagctggaaactttcatggcattattgcatctttacatagtaataaatgtgtcataattgacatgtgctttaaaatgctctcacttcctctacttcctggaagattgtttctgtcttgcatgttgtccttgctgtgttttatgatgtgtttgtataaacatgatgaaactattcatgttcttgttgatgcttctctgaatggttagcactggctctctgggtgtgttttgtttgctaaaccttgaaaaagtcttagtagatggaatacagtggaaagattaggaagatgcctttttccctcatacttcctttaattaaataatgtgaaaatatactgatttaatagatgtttctgtgagttgtgctaaatagaattggtaacagtgttacagttttatagggctttttatctgtttgagaggtatgcaggatttcttttttattattattttttattttttgtagagataagatttcactatattttccaggctggtctcaaactcttgggctcaagtgatcctcccacctcggcctcccaaagtgctgggattacaggcgtgagccaccgcacctggccgatatgcaggatttcttgatgtttctcatcttcccataacttttctcttttcctgacatgtgcttttagcctctgatagccgtcagcaaatacctggctcctgttggttgttcagtcctctttttctcttctctcacatacctaccaccctccaggcaaagcaagtaccctgtggttctctgcctaatttatatgtctcggaacatgctgctcccctcaccttaaatgccctgcataactcacaagactcttaggacctttgagttgtaccttcatctccagaagttctccctggcatttgttctgcacctcccatggctccacatgcccagagttactgatttgtctcctctcgattctcctggaacacccagtccacctttttttttggtttgctcacctgccatctcccatgtcatagaaaggctgcagtgagacacagccctgttcatgaccttagtaataacatcataagcaggttatcagtaaatgttgatcaactgtatgaatctgctgaggttgtgaaaagggattcggagaagtttgagatgcatttggccccagtagttcttacctagggtggggaaatcaggcatgtacctgaggaaggttgctgtgctgctaggcagaggagttgtgaagtgaaacagagcacagcatgcacctgtggactgctttcaggccatgttctctggagtgtgaggtgccggacggctcaggcctcctgtccctggaaggcagagtgggagcaagcatcttgctggtagcggtcagaggctaaagggaaaggtagcactgggatattgccttaagatgaataggatttccataagctggggtgaaggaatgaggaggagcacaaggaaaagattagcattgagaaggagcaaggtatttgggcaaaaggttggagcagagatttcctgttctggaattagcagtgggagggaaggaagaaaggaatcccagaagccagttacggagagccttgattgctaggctaaagatatttgggtgttatcctgacgtacagaagagtgtgtgaaggttttgtaactttgaagaaatgggagcaaacagtctagtgatgaaagcagaggaatactgggcagagaaggagacttttgcagtagtctaggcagggagcatcctgacccaagacacagtccgctcttcactcatcctacaaagtgagtcccatgtgccaggccatggagagtctgtgatgagtagtgtcccttgaggagaaaggggcatgaaaacaaaatcaccttagttgtcacgtttctagtgagaagattccaacctgaaggaaaatccataggaggtgataaggatgctggttgactgatatgcgtaccagcatagtcacaggatgtgcagatcgtggattgcagatctgggctttgttcacagtgaaacaaacaatgctgcctgtgctgctctagtcacttaaccggacatctccctgatgctgtcaacttcagtcccttttaactggtctcctgctgcttcccttgtccccacttgctctgttctcaacatggcagccagggtgatccatttaaatcttaagtcagatcgcgtcacttctcttccccacactcacggtggctctcgtcgcacccagagtaaaagccaaagtcctcatgaagatccacagggccccgcccgcccctcaccacccctctggcctcatctcctgctcagcccagccactctgagcacactggcctccttgctgttcctctcacccctataaagctccccaaggcccctccttccctgtgtgtctccatgtctgatttctcacctctttgaagtctgctgaagtgtcactgaccaccctatttacaattgtaacctgtcccccagccctaaccctggcccttctgacccctctgaccctgtcctaccttttgttgtcatgactgattaccttctgccatgatgtgtcatttgctgttgtttcttgtcagatcctccacactgctccccccaccccgtaggtggctctttttttggaattaattaatttagtgattttttttctttttatttggtaggctctttaaggcaggaatcagcttctgttttgtttaacgatgtgtctcaaatgtctagaacagtgcctggtacaaagaagaagctcagtcaatatttgtcgaatgatttgtaatttatttgctcttactagtacggcctagttaacttttccccactaccaagtggattttgtttatgagaaagaaaggttgatcctgtcacagcctaaattccaaatatagttgccccttggtatcctcggggaattggctccaggagcccccacagatgctccagtccatgctataatgtgatgtagtatttgcatataacctatgcacatcttcccatatatgctagatcatctctagattatttataatacctaatgtaatgtaaatgttatgtaaatagttgttctactgtgttgttctttaaatttgtattttttttattgttgtcttgttagttttgatctgcagttggttgaatccacagatgcagaacccacagatacgaagggccaggtgtatattttacctgttatttgttttcttcaaatgacgtattttctctttgaaattcttagagcagagttctataaaatgggcacaataattagaaaagaaaatttgaaagcgacttttcaaataaaagaaatgtggcaaaagggttcagtcacatattagaaacgatttgtaatctgcaaggctaaagtggaggataaaaatgttgtaaccagaggataaggtccactggttctctggcttgcatggtctgggtgcattccacttattcctaacaacagtgacaagttctccatcattattatcttgggggaatttcagatacccccacaattgtacatgccctcagcattctgttgcctcttaattcgagaactaaacacacacagcacaaaatgctaaataaaagcacatgatagaatacaagatggaaaagaataattcctaaaaggaccacaccgcagaaggtttttagttttttgttgttgttgttttttgttttgttttgttttgttttgttttggtcttgtcacctagcctgtttttttcctgtgcacacatgcatcattgacatacacatatacactcaaccctccttgtccctacctcctccccattaaagaaagctgttgaagaagattcaggaaatcagaacagagaacgtcgacatgtgcaaacctttggataacttttaattagctagcctgccatcttataagtaactttcaaaagtgaattgggacctttttaaattcccagctggaaagtttccatttagactgtgagggtgttttcttttcattacataacccatttgtcagtggaggcagtatctccctgcaggaggtaaacattggttcttagaaggcaaaaataaataaataaatacataaatacataaattttagaaaccctatttaaatgtataaagcacagatatacatacctatatataaaagatatacaataaatagatatacaatatatctatgttataaaaatatcctcagggtgagtacagtaatgaaaatggttgagaagcactggttgaacccacactcagaggcaccagcctagagcacaaacggtctgctctgcatgttcatgcttttacgtggtgtttgatagtttaacagtgagctgtgtccaagggcatgagcctgttaggtaggacatggacttatcatgatcaatttggtctattaggcactttttggttagagggacagaattgctcaggtgactcagttcctggagggcagagggaaggccttgctgggctgccagggaccagctggcaggagtagagtctgggaaggagaagggtgtttgaaatgagtataaccatcatccctctcctcacaggaccattgtggggtagtgtgttaattcattcttgagtcactataaagaaatacctgaggctgagtaatgtataaagaaaagaggtctaatggcctcatggttctgcaggcaatgcaggaagcacggtgcttgcatctgcttctggagagggcctcagggaacttacaatcatggcggaaggtgaagaggtagcctgtgtaccacatggcaggagagggagagagaagggggaggtcccagctcaaacaaccagatcttgcatgaactacctgggtgagaactcacttatcaccaaggggatggcacaaagccattcttgagggatctgcctccatcatccaatcacctcccaccaggccccacctccaacaccgggaatcacatttcaacatgagatttggagaggacagacatccaaaccgtatcaggtagtgttgaggttgttgaggtaagtgtatacaaagctcttagcacagagtgaagctcagtgaacaaatggctcttcttatgaagagcagccctcagcggaggcatggcacttccttcaagagaaccaaacttggaaaccttgaattaggaagtgattactcactttacagggaatgactacggtaatgatatatttgctttctgttacctaaacttagcagcttacatatttatcatctaatggtttctttagctcagaaatgtgggcatagctttatgggtcctctacttagggtctctcaaggctgccttaaagtgttgactgggactgggttctcatctgtaggctcagctagaaaggcatctggttccttgctcatgtggcggtcagcaacactgtatttcctggggttgaaggattcataggagcttgcacttgaaagccagcaagaaaggagagtgagaaagacaaagcacaagtctgccagtaagacagagtctcatatgatgcaaggtaatcacaagagtacagtctgtcccccttgccatctactgttgggtagaggcaaatcacaggttctgtctgtactcagggagaggggcctacacgaaggtgtgaacattgttgggggatcatgcggagggagtctgtttgctacaaatggtattcatattcacatgtgtttcaaacagtagaggaaaacgtaccaaatatttttctttctttctgtctctttctttctttctttctttctttctttctttctttctttctttctttctttctttcttttctttctttctttctttctttctttctttctttctttctttctttctctttctttctttctctttctttctttctttttcttttctttcatttattttttgagatagagtcttgctctgttgcccaggctgcagtgcagtggcacgatctcagctcactgcaacctctgcctcctgtgttcaagcgattctcctgtctctgcctcctgagtagctgggattacaggcacatgccaccacacccagctaatttttgtatttttagtagagacagggttttaccgtgttggtcaggctggtcttgaactcctgacctcatgatccacccacctcagcctctcaaagtgctgggattacaggcatgagccactgcgcccggcccaaatctttctattagcaaaacatttggttgataaaaatattggcttatattttaataatactgattggaaagcaagataaaggcactttgtgctgcctgatattaactgttaacagccactaatgctgccttctgcggtttggagtttattgaggacacagccctcttctttgaaaacgtggctgtctgatatcttccaaccaagggagcttttcaggacctcaaaacttcttgctttgtaaggaataattgaaatatccctgcaaaggtgattttaaaaaaatcttttctaaaatgtaaaactttcttttattatttgtgcaatgtttataataagtactcatttcagtgaagataaccattgctttgtttcactcagattcattgtcaagctttaaactttcatttgttttctaaattgaaaaaagccatttttggattgttcttacactggcattcttaaatgagaagtttggcacttcgtattctctactgggctccccctccttacactagcttggagttatgctcagtcagctctcctctgtatgggagaatgttgaggaacaatgctgagaattatatgggtattgcaaacgacaaagtgagagtgctgttggagattacgataccacaatgcaaaacaatttaatggtttggaggtacatttgtaagatgacaaggaaggatgattgaccacacccttaaccaagggttaagaggccctgaagaatatttggaacctttttttctgctgtacacaggtgtactggccaccacctatggcccttgaagtggggagaggttggtgttttggtgattagactttgaaatattttatgattccatgtactcagcatatcctaagtttctggctcactgaccaaacttagcaaggcattgttaagttatgggcttcttacagtttggaactcccggataaggaaaaaacaaacattctaactgtctcacaatagtaagagcaaaaagcctgtgcagtccccaccatggacattgtgattgtgcatgacatacatattcaaatttagaacggagagatgcttcagcattctcttggaccaattgtttttcagaatgcagggttgaataaacaagtatctacatatttccactcttctgaatgccacatatttgcataatgctggacttttcaatgtttttgtagttcttcttcattgaatgcatccaaattgtgggaatgtggcagatggtgttatatccatttgacagatgaggaaactgaggctcaataacttgacttgcctgaggtcatgtcacacttctgtagcagagacagaaacagagccaagccctcctcattccaaacctcaggcaggagctgtggtgaaaagcagggagtcggtttgcatcttggctctttcatatgccagcattgtgaccttgggctgttactgaacttcaaagcctcagttttctcctttgtgaaatagggagactcccttctcttagggtttttagggttaaatgaaaatttacaaccgtccctaaaccttgcaagcactcagtaaatggcagctactgatgtggtttatgttggttttggcatactgctatttgcacaactgggtgttagttgagcttacctggtgtatctccttaaggcccattggatctgagtatctggcattctaggcccataattcagaatcagtggaagagacaatgttgatacatctctgaggcttggttacctgggagctggcttgatgtctggggttctagatagtgcccccaacaggagagttgttacggggtgggatgaggggctttgcccgcaagaggatgaaaagaaaatagtagaaacaggagagtggcttttgggcaaactcttggatttgctgttcagacatattagcaattcgtttagtgaagaacagagcagggatgtgtgatgggcttccattactgtgacatcaaggatttgaattctgaccacctggcagggaatttgggttctaatttgccaccagtggagatagcacaattatgattgtcttaacacaagaagccgtctcccctaacctactctcaaaatctatctcaggtactaacgctgacacagatctgctgccataaacttggttgtcttttttgtgctggagagggtttcttctgaaatgtaagcacctgggctcactctttctgcccctctgtctttgaatcagacagcagctttacctcttggcctcttagcagatttattcttaagcaatattaaaagtattgttgcttcttgtccaaatctcctttccccattcagaaataaaacaactcccttaaaggggagagataccatcacctccctacttggggcctgagaggtgttgcagaaaataaaattctctgagctctttgggccaattgttccttagattttaataccttagcatgttgtctgtgcagttttttaaagcatggcatcacacacatacccagcagcatttgatgaaaggctccagtttcaaggtaagatagtagtgtcaagctgtgcaaaatggttagtcggcctactaactcaactctggagcaagctgcttaacctttttaagctacctgtaaaatgagaataagaagagctgcctcacagaattgttaccaagagaataggctcacagtaagaactcaattgttaatttccttaaaaaaaaatcctgctggggcctggtggctcatgcctgtgatcccaacactttgggaggccaaggcaagaggattgcttgagcccaggagttcaagaccagcctgggaagcatagtgaaacctcatccctaaaaaaaaaagacaaaaattaactgggtgtggtggcatgcacttgtagtcccagctacctgggaggctgagtcaggaagattgcttgagcgtgggaggttgaggttgcagggagctgtgattacaccattgtactccaacctaggtgacagagagagaccctgtctcaacaaaatgaatgaatgaataaataaataaaatctattgaaagggggaaaaaaagcctcgaagaactttatttactttcttctgttgcatgctaccacttcctgaaagaatagacatttcccaatctcccaagtaattaaaaatgaatgcagatactgatttagagtggctgcatttgttcattggtagaggtagggacctaagaaacggagatgttcttcccatagctagactgtgtggctaagcatagcattgctataacttaaaatttttttcttatccattgtaaaaagcttataaaatatagaaatgcataaaaaataaattccatttacagccttactctatagaagtagtaagacattttggtgtctttgctctttctttttaacttagatttgtgtgtgaaatagatcatgtctacgaaagtgcatggaacatatatgtatgaattaaggaatactaaatatacgggtaccactttccaatttaagagctagcacattgctagtctctatgagccccttttgtgcctggctcttccatttattattatttttttctagaatcaagttagttctgtttatgtagttttatattgtgtttttgttcctactgtatcataagtatttttcaataatgtcatcattttaggttgctttcttatctttagagctcaaggtaattacagatcatagaatagcctttccggtaccgtgccttatatactcatttaattttacaacatgctgtgagctgcagcagctccccattttacagatgtgaaacctacatttcagaatgtttaggtaaattgccttgatgacagagtatgccaaaggactgagattagagtccaagtctgtgtttccaaaacccttgccatttctaccatggacaggctgactttatggggctgtatgttggaggcaccgtgtacatttaaggaattgaccattaaatgtgatgatgacgttatgggaacttgcttaatgataaagtaggaacaaaaacacagtccgaaactacataaacagaaatatagtatttctgcctaattctaaacaagaataacacatgactaagttctagtttttaagtggtactggtgccagaaaattccagatgaaggcaagcttccacaaggaatgtggaaaaacaaaaataatttcttgaccaggttcagtgactcatgcttgtaatcctagccctttgggaagctgaggtgggggggcatcacttgagctcagaagttcaagaacagcctgggcaacatagtaagaacccccggctctatttttaattttaaaagaatattaaaaataataaactataaaggaaaataactttttgagaatcggaacagtattgcatgctctgcttttatttgaagagtctatagtgttgggttgtctggtgttcccccttatcctcccttaattcccccaccttcctcccaccccataccactatgaagtgaagtctgaacttttatgttctaagcagccctcctgctgcattttctttttccttttcnnnnnnnnnnnnnnnnnnnnagtttcacaagaggtctgaggctaaaatcttgctataaaaaggataatttctggatggcagttgcagagatccactgccgtgtggctgtctaagacaaggcttttgtttgtaagtctctattaaatgtttctttctgataaactggatttgtcaacctctttcttcggcctctcagctcccttggcctttggaggtaggttagcttagatctgctcacagcagaacaccacgctttctgcctgaaggaatttcttttttcttttcttttttttttttttgagatggagtttcgctcttgttgcccaggctggagtgcaatggtgtgatctcagctcactacaacctctgcctcctgggttcaagcgattctcctgcctcagcctcccaactagctgggattacaggcatgcaccaccacacctggctaattttgtgtttttcgtagaggcgggggtttcaccatgttggtccgggtggtctcgaactcctgacctcaggtgatccacccacctcggcctcccaaagtgctggtattacaggtgtgagccaccgctcctggcccctgctgcattttctacagttgtacagttgtgcatctgtgattgattgtgctacaacctgggaggaagccactctcctcctttgctttgcccatgaagacgtggccctgtaaagtctagaagaataaaatggttgctatggttgctgtggcagctacaatgccaagctgaaaagctgactagaaagtcgcctgcttatctttggaaagagaggggactccatttggcacagatacagttgctcattatattctgcaggtatagtcactgtggcatccttgggcacattctgcgaactcaaagatgtgtagagatttggaagatgaataaaaggctgtgtttgtttaggtggaagtatggctgttattaagtttagtgagatggtagtggttaacctcaccaaagtattcattaatataagcatcaccttcagctttgccacagtgttttttggggataggaaaattccctgcctgtgaccagtgaatagtaaaacactactgggattttttcaaatggccattaaatgccaacagccaccaccacttgctgagggacaataaaaggagtggaggaaggcagtcagtcactttgtgtatgtttgaattcttacactgtaggtgtccaacctaaatagtgctgtcattggttttagttcagttaatcatgcctgaattaaaatagatttttttaaaactgtgattgtgggaatagtgcaacataaaatagttttatgaggccctacttcatgtctaaagtgtaaaacaatttgtttcaaaagaagagaatttaaaaacattttctttatttttaatacagggtcttactctgttgcccaagctggagtccagtggtgcagtcatagcttgctgcagcctggaattcctgggctcaagtgatcctcccacctcagcctcccaagtagctgggactataggcatgcaccaccacagctggctatttttttttttttaattcttggtagagagagagggttctctttatgttgcccaggctagtcttgaactgccaggctcaagtgatcctccttgcttcagcctcccaaagtgctgtgattacaggcatgagacaccatgcccgacctccaaatattttcttatgataggttactcctggaagcaataaatatgatgtaaagctcagattgactttttaattatctttatttttaaattttgcttttaaatttccttttctttttcttttcttttcttttttttttttttttttgagacggagtttggtcttgttgcccaggctggagtgcaatggtgcgatctcagctaactgcaacctccccctcccgggttcaagcaattctcctgcctcagcctcccgagtagctgggattacaggtgcctgccatcacacctggctaatttttcatatttttagtagagatggggtttcaccatgttggccaggctggtcacaaactcctgacttcaggcgatccacctgcctcagtgtcctaaagtgctgggattacaggcatcagccaccgctcctggctgctttttaattttctaattcatttatttttattgtggtatagattgagttttgttgtcataccttcctgtgtttgtggagtcttagaaaagaactctcaggttacttttttttaaaaattttatttattttttgatacagagtttcactcttctcacccaggctggagtgtagtggcatgatctcggctcactgcaatctccgcctcttgggttcaggtgattctcctgcctcagcctcccgagttagctgggatcacaggcatgcactaccatgcccagctaatttttgtatttttagtagagacagggtttcaccatgttggccaggctagtcttgaactcctgacctcaggtgatccacccacctcagcctcccaaagtgctgggattacaggtgtgagccaccgcacctgacctcagcttacttttcttttaggccagacagatattcatttgtggagtacagatattcttctgttggttggtgctgtttagcagtatctacctagaatcttgtgtctcacaagacttgaccagattgataggcacttttcaaatgccctgctaaagctgctgaatccctgaatgatcaaagctggcactgactttggcagcggccttgacttttagagcatagcgtgctaacaaagaggagcttgcttcctccaaacagtaatagggtaatgtccagggatcagtgagcgtgttcctttcacccagtactctgcaccttgcatctcttcagcctcctgccaccttctactgttcgacacctcttgtcctggtggtgagggagcaggcagagtctttggatacagctcagctaagtggcttcaaagtcaggcaggggaactggtagctgagcctccattgcctggggttatctacttgtaaggtttttctgccttcctaattcttattactactattttactgccactctccctccatttgtgttactctgtataaccaacacctaagtgcgaaagtcctgggcttcagtctgtaccttctctatatggtatagatggatgcaggtgagatttcctgccaactcccaaatgtgtagctccagcccaggccacttccgtgagccccagatctgtgtgtgtgattgcaaactcaacattctccgccactgtgtactatttcaaactttaaatgtttaaatccaaactcattattttgtaaccctccctcctacctataagccttcccccgacaacaaaataacatatttggtctctttcacgtccttatcatgtgaaggacgctctcatccacttaactttgcaagctgggagttaataccgtaatctcttgctttccctctgtattcagtacattttatcagtttagattcttaaatctctgtccttaggcccagcatgatctagccctggcctcactcactagcctgatttccagctgtccctctctgccctgcttaggtggaccctcctccccttagaggccttacaccagcccccacttgctgaaatccaccccacctccccactgcccaccatcctcctgatttcatgttcaaaggtcatgtcctctggggaggcttcccttgatgctcaaatgaggtcagtgtctaggggggtaagctcttgtggcctgtatggcaccctcactagagtcttaagtcccacagcaataagggctttgtctttgcttacagtatatgctcagtgcctagggcagacccctcaccaggtgagcatttgacagatatttgtctagtgaaggaatgagcggatgaatgaatgagtgaatgaatgtcaggcactgtgccaagcaatttgtacacatctcatttaatccaggaaaccgtcgaaactgcaaatctcaactggggagtcaacccagagctgagccaacacccaagcccaggctctttctgctgctaccactggcttccttgagggagagacagttgctgctatttgattttactgataaaaatctgtgatgctacagggagaatggagcaggacttcttctagtagagaaattagggagacattgaagagacttgcattttaccgatgctaatttccttagggtcatttctttaagaaaaaaaaaatcctcttaagtaacaagcttggggagctgtagagctagatcagagattttgctgccaacctctaagtaacattccaagtccactttccactgcttcctgaggaggcctgtcagagttttgcaggtgtattcctgatctcctggcttggagctcttattcagtctgcttcagctcttcctctctactattttggttcttgtctctttagaccatatttattcattcaagaaacttttactgagcacccattatgttctaggcactacgctggttgcccacctttattcctgttcctggtaagcatctccttaccattgcccctctgctcagcaacccccacacttttacaggaactatcattcattacgtaatgaggtcttgaacttatgatttaagttcaacattaattagacactttctgtgtagcagatactgtgctaggtttggaagtttaagaagagacacaccctgtgccttgaaatctgtttacactaccatcaaccacacaagaatgggcagatgaactagtgtgaagtcaggaagtatccatagttttctgtgatccacaaaagcactacagattttcaaacccctggacagctctgaggacttgatccattcgtaggtcaaacattgtacagaaagtaacccgagagagctacttgagggcaggacgaaggactgggctatttcccctctctctatcaccttcctcaccctcattctcataccctatctaagtactagttcttgccagtaagcttcttgcttccaatgtgtgaaaatgtaagcacttaatgggcaattcctaagtactactatctttttccctgaaagcagtggcatgaacttatctcaaagtttggaagttaatgggaaaaatattgaccaataggcacaaatctatgcatcttatttggatttgacataacagttaagacaactggactccaaaatagacagtaacagtgatctccagaatcaaaagtgaaaaggaaatattagagcatctacttttctaacttattgtctcaagaatttcttttttgctttatacaaaaatgtacataatattctggaactaacaagtgattatagcaagattgcaatgtaaagatgaatacataagtaaatcacattcctatatattagcaatgaacaagtagaatttgaaatgaaaacacaacacacttacatcaacacccccaaaaatgaaatactcaggtataagtctaacaaaacatgtacaagatctatgtgaggaaaactgcaaaactctgaaagaaataaaagaggaactataaatgcatgaagagatatttcatgttcacagataggaaccctccatgttgtcaagataccagttcttcccaacttgatctataggtccaaagcagtgccaatcaaaatcccagcaaataactctggatattgacaaactgactctaaagtttatagatagaggcaaagaccccgaatagccaatacaatattgaaggagaagaacaaagttggagaactgttgctatctaactttaagacttattataaatctacagcaatcaagacagtgtggtattggtgaaagaacagacaaatagatcagtggaacagaatagggatctcagaaatagacctacttaaatatagtcaactgatctttgacaaaggagcaaaggtgtgatacaaggcagaaaagataatttttttcaacgaatggtgctgaaacaactggaatccacatgcacaaaaatgaacccagacacagaccttacaaccttcacaaaaattaacataaaatgaacaagacctgaatgtaaaacacaaaactctaaaactcctagatattgtacatgttttgttagatttataatagaaaatctattatacatgactgtaggtttggcattgacgttatatacaataccaaagacatgatctgtgaaagaaagaatcgataaactggacttaaattaaaattaaaaatttccgttctgtgaaaggccatgtcaagagaatgaaaagacaggccacagactgagagaaaatatttgcaaaaaagatatatctgataaaagactgtttttcaaaatatacaaataattcttaaaactaaacaataagaaaacaatctgattaaaaattgggccaatgggccaggcacggtggctcacgcctgtaattccagcactttgggaggctgaggcaggcggatcataaggtcaggagttcaagatcaacctgaccaacatggtgaaacccatctctactaaagatacaaaaattagctgggcgtggtgacacgcgcctgtagtcctagctactcaggaagctgaagcagaagaattgctcgaacctgggaggttgcagtgagccaagatcgcgccactgtactccagcctaggtgatagagcgtgagactccttctcaaaaaaaaaaaaaaaaaaaaaaaatgggccaaagatatgaacaggggctgggtgcagtggctcacacctgtaatcccagcactttgggaggctgaggcaggtggatcacttgaggtcaggagttcaagagcagcctgggcaacatggcaaaaccccatctcaactaaaaaaaaatacaaaaattagctgggcatggtggcacatgactataatcccagctactcgggaggctgaggcatgagaattgctggaacccaggagagccgagatctcgccactgcactccagcctgggtgacagagccagactcccatctaaaaaaataaaaaagatatgaatggatacctcaccaaagaagatatacagatatacagatggcaaataagtatatgaaaagatgctcaatatcatatgccattagggaattacaaattaaaacagcaatgagatatcactatatacgtcttagaatggcctttatgatgggctggtacagagggtggcttccagaacccctctgaaaaccaaagatcaagtattagaatttaataaagatcagacccggtttggtggctcacccccataatcccagcactttgggaggcggaggcaagagaattgcttgagcccaggtgtttgaaaccagcctgggcaacatagtgagaccctgtctctggttttttttttgttttgttttgtttttttttttttaaagatcacgtgagaggcatacaaattcataggaaaaaatacgaaatggacaaagaacaggagtagccaattcacaaaaaagtaaaactaaaagcttccagcatgctcagttccacaaaatgacaaaaccatgcggtcccttttttctacctgttaatttagtaaaagcacaaatgcaagcatgcatacagcccctacatgtaccctctgttttaagtatcctgatcctctcggggaaataggtgtaccatgtaccatgctgatgacagtgtgctctgggggagcctttttggtaaacagtttggctgtatatatatgtgtgtgtgtgtgtgtgtgtgtgtgtgtatgtatgtatgtgtgtgcatgcttgcgtgtgtgtgtatatatatatttcatactttaatgtctgtctttaaactctgcttaagaaaaccatctcaagtgcagtaaatgccacatgtttatcatgacaccacttagtatagtgaagaatgggaaatcttaatctagccagccaatgggagtgttaggcagacttcacaaatgatgtgtagaaagactgaataataacactgaacaatgtttatgatcgtattgttgagtgagaaaagcaagactcaattgtaccttataaactctctcttttatagtacttgccaatttgttttttgtttgcaattccttgtcctttttttttttttgagacagagtctcactctgttgcccaggctggagtgtagtggtgcagtctcggctcactgcaagctccgcctcccggtttcacgccattcttctgcctcagcctcccgagtagactacaggtgcctgccaccatgcccggctaatttttttttgtatttttagtagagatggggtttcaccatgttagccaggatggcctcaatctcttgacctcgtgatcctcctgccttggcctcccaaagtgctgggattacaggtgtgagccactgtgcccagattccttgtcctttttaaactgtctttatgtctagacttgggagtatcctgagggcagagatgggtcataggacagaacatgagaaaagtatccgtagtacttttacccttagtagatagtcaccctcttggacctaagggtgtacctgtgggcagaatgaataataaaactttcttcccacccaacatttcctaagagctgctaatagttttccatatcttaaaattatgggaaacaatatttagagagctccttttcacactgaatagatttaaatgattaattttctttcttttttttttttttgtttgttttttagttttttgagatagtctcactctgtcacccaggctggagtacagcagctcaatctcagctcactgtgaactccgcctcctggattcaagttattctcctgcctcggcctcctgagtagctgggattacaggcacccgccaccatgcccggctaatttttgtatttttggtagagatggagttttgccatgttggccaggctggtctcgaactcctgacctcagatgatccacccgcctcagcctcccaaaatgctggaattataggcatgagctactgtgcctggtcttaatttttatttttaaccttgttgaatgttattggatcattaagaaggttttccaatatagtattagcaactgcaataaagatgtgtctttcttgggggatgcagtgatgacggtgcagggcccatacaggcaggggtggcgcctgagggtcccgggccaggcagcagcacacaggtggcaggatccactcaggctgcatctcccgtggtgctcatctggctgctgccatctgtgctggaccccgccaaggtatagagtctcatggacacgatctggaaggacccagacagtgtgccatcgatgtcctctagatcagaggggcccagggaggtgactacttctactcctttggggactgccaccgctaaacagcctagcagcagctgcagccagactgccaagcttgtccatttcaccctctcggacctaagggtgtacctgggggcacccacaccagacttgcagtaaccacctccttggcacctgcccccacctccaagagcccagaagacacacctggcctccagcaggctgggccttccagaagggatagcagggatgcattctctttgcacctgtggggagggtctcactctgggcacccctctcaccagctgcaaggccttggactcatgctgaacagtgtgggagcctcagttccaacatctatgacagttggatcatggccttacccatgaagcattattgagagaatgaaaggagaacagagatgggcttgcagagccacatgctgctggctccacattcccaggaacaaggatcctactgcatttttgtctttatataaccctattatatggactacattctgccataaggaaaggaaaaccttggatgcgatggtttaaacaaacaagtttgtttttccacatagcatgaattccagagatgggtggctaatggtattggttcaacagctgtgtgatggtaggggtcacatctccgagatccttttgccttgccctcatttgcttgttacttcatggtcacaagatggctgccatgtctccaagaatcatgtctgtgatcaaggacaaaaggagtgggggaagaagaagggccaagctcgctggacctgtcaacttctatcaaaaagtaaaacttctgtcagaaacctgtttcctgctctctcctcctgcagattttcacttaggtgcccttggcctgagctagctaccactgcacctgtagctgtgaagaaagttaagacagtagggaacagagttgtattggttgagtagaccagtcatgttccatctactgagactggcacactgcctcctgaaataaaactggaatcccatttaaacaaaaaaaggaagtgtctttcttaaatgagtttttttttgttttgttttgttttgttttttttttttgagacggagtctcgctctgtcgcccaggctggagtgcagtggcgcgatctcggctcactgcaagctctgcctcccgggttcacaccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttaaatgagttttatacagacaattggcatatagtcctttcatcagtatccttaggtcaagattatattacattgcagattgtctccagggtactttggagatggattctaattcttattctcatattgcagtaacagggaaactgagagataggggtgtgtcagagtttgaaagacaaactatttgaagacagaaactctagtggagcttgattattagccaaaatacagaatttactattaaagaagagggtccagaatcctatcccaagaagttacttgggcatccaaaaacagatcgtaagacacattgaaagtgtggaactcagactttgtataaggcttttgtatcttgagaaggaaaatttaaaaccttaggaggattgggagcttcacgagttcatgatccttctctgcaccaagtttacacgtgctaacctttctgctttagtagctaaacttttgattccatgaaatcaaaaccttttaattgctttctctattggtgatctttaagagataacttgggcttattggtgtcagtctgtaaagaaaccaaactctgaagtgtgatactatctattgaattagacaggggaaaagctaattagtactatagtgagactggagtgcttctcagatgttacctagtggcaactgaggatgtggaagtttacagatttttagacagtctatcaaattacaatcttcagaaaaaagtatttccaatgactgcaatgtttcgcctctatcaactannnnnnnnnnnnnnnnnnnnnnnnnnnnnnncctggccaacatggcaaaaccccatctctaccaaaaatacaaaaatttgctgggcatgatggcgcacgcctgtaatcccagctactcaggaggctgaggcaggagaatcgcttgaacctagtaggtggaggttgcagtgagccgagattgtgccactgcactccagcctgggtgacagagtcagagtctgtctgaaaaagaaaaaaaaaaaagaaaaaagaaaagaaatgttacttttgcactttcgtggccttggctagttttaaatgctttttcattggtagaaggcttacagagatcatgaaacattaatagttaccatttattgtgtactctttctgtgccaagtactgtgctaaatattttaggcatattatcacagtcagtccttacagcactcctttgaggaacatggcattttccccaaaatacatttttaagaacccttgagatttcaaagatcaagaccagagcaggaagggaaagctctgggtctgaaccaggtctgtctgccaccaaaacaccactcttgatagggatgatgatctggaacagtggtaaaatctggcataattcaaacacttaaactagtttgcgtatatgtataaaattcctagaattccttataaaacacacttatgacattgaagttcagtaacttcccatgttccatataagccacagaaatattgatttgccacagtgaaagagttagtggaagctattgggccatccaaaagaagctaaggctgaaaaggctacatatggtatgattccaagtacatgacatcgtggaaaaggcaaaactacagagagtaaaaggatcagtggttgccaagggctaaggggagggagggatgaataggtggagcatggaggatttttaggaatgtgaaactattctggatgatactgtcatagtggattatacattcgtcaaaatacagaatgtgcaacaccaacagtgagccatcacatgaactatggattatagttattaataacatatggatattggctcatccattgtaacaaatgctccacactaatgtaagacattaatgggcataggtgaggggctatacggaaatcctgtacttttcttttaattttcctgtaaacctaaaactgctcaaaagtctatttgttgccttttttttttttttttttttttttgagacggagtcttgctctgtcacccagggtggagtgcagtggcatgatgatctcagcttactgcaacctctgcttcctgggttcaagtgattctcctgcctcagcttcccgagtagatgggattacaggcacccatcaacacaaccggctaatttttgtatttttaatacagacggggtttcaccatgttggcctggctggtcttgaactcctgacctcaagtgatctactcaccttggccttccagagtgctaggattacaggcaggattcccttcatttttaaaattactgaccccaggccacaagacatcaatcatggtaaaaattccactgtccttgatggcacacttgatattttgctagctctgtggatgagcttttccttatctgttttctctctcccattccagctgccagcatgctagctgcttacgtttggtctacccactcccagcctgtcctacctcctgccatcagattaatcttcctgaaatggagtcctgagtctatcattcccctggggaaaaacctttgttcatgctactctccctcctcggtttctccatcacctgcatcacgtggtctgtcctctctgaaatctcgttagaagcagtcattgaaatcagaagtgacctctatcatagtatgttgtttgtagcttgttgacatttgttcagacactcttgcattaaacatcacgttgtacttgcctccccctccccctcagttggactgtaggttacctgatggttaagactaagactgttttccctccaccttggtttttgaatcacctggagtgcttttaatacagtgggtccttgaaaaatgcattcagctgaattcagtgtgtctgtgttctcagtctatccagagctctgctattaggtgaaatggaagagaaactcattgcctatatgactgttattgtgacgtacagtgcaatagctgatatgtttctgacattagaatgctctcatttattggtatttgatcactggcatattatatttgggatttgtagccctactttgactgctctactatgtattgaatgaagagtttagattggtattaatatgttttaaccagtacattttaaaccagtcaaacatctaaccacatgcaaaagaagggcacgtacttatcatgcttcttcacatgcttaccatgcttgttacatgacaaagggttgcctttacctatttttccttttagaagattgaaaatatttaaatgatgctgttgttttgatcactgttttacattctttgaagattgaggaatctggtgactattttatcaagcgatttttctcctggagttttcttttttaaccttttgtggcttaattccagtaaaagattttcaagtaagtgaaaatgagttgcatatatccattaagtctttttctttatcttaagtaaaagggggagatgaagtagaaatatttagcaactcagttattgcctctagcatttaagagttcagcttgaagaaaagtagttgacttgaaagaatatgacttaaggacagaggtgagaaggagataaagaagtgcatctataggaacaaatttgtttcttatttgctttaaaaattgtttaagtaaagcacatttcaccaagttgaatttcagcttgagagatgtccagatgtgaaacggcaaaactccaaatactgcatatactgtgcttttagaaaaataaagtagtttttttgttttgttttctttttattctttaaaaatgaaggtcaagaaaaatatcagcaggaaagtcagaagtggatttagatatataaatgtcctcattgaggaacaagggggtgatcctttttttttttttttttttttttttgaggtagagtcttactctgttacccaggctggagtgcaatggcgagatcatggctcactgcagccttgacctcccaggctcaagcaattgttccacttcagcctcttgagtagctgggactatgcgtgtgccaccatgcctggataatgtttgtgttttttacagagacggggttttgccatgttgtccaggctgtctagaactccagggcttaagcaatcctcccgcctcagcctcccagagttctgagattacaggcatgagctactacacccagccagggatgatctttttaaaaggaagtatagtttaataataatatgcagaaaataggcttaagattttagttgactataaacttaatataaatctataatgtaatgtggttgcccgaaccattcttaaaatattaggttgtttcagtatgttttactgttttgaggaaagataagcatcctattaagatttcaggtggacatactttttaagcttttgtatttgtttcacttataaaaatcatcaagctataacaaaacttaagtcaacttgtgatgtttgccttccaacagtagctgatggcatatttttttcaagttcatactggattatagttgaattaaaagttatttcttaattctccaggataatagaaacattaattgttcagagaaactccaaatataaggaactttagagaaaagatgtgtttgagtatgtgcgtgtgttgggggagggggttgccggaatacatgatggaaacttgtctaaagaattctagtgctttaactagagcagaaaatagagcagaaaatagccacagatgttaactgacggttgaacatgtgtgaattggatctttgaaaatttacacatggattttctttgcaagttatgtgcttcacagagaagaaaggtatatgttcccttttgcatgtctgcttgctttccaaagactagctgctatcttaacttaaaaaattttatttttcatgccagaaaacattgtattttaaaaattgataaagacactccatttgtaagtacttgttttaaagtaatatatctagaaggcaagatagtggccccctttcctgtcaatgtggagttccaaagcagctgaaggtagaaattaacagtcggtaagagagctatcaaaagaaaaccaggagccagagaccaactactggtagtcagtagtaattctgattgtctactcaatctgccaaggaaaactaaatacattttttcccctgagtcaggttaacacttaaagtataaaaggaagtacattcaggatctcatatgccatagttcaaaatatttttttactttatatatcatcagatacatacgtgcacacacatgtaaatatgcatcatccatgggatgtgatctcagggagataagtaccaactcatatattccttttaaacccactcaccattgccccaatttttgttccttctaactgcattcaactcttcaattcataatcatacagattcatgcaaataacagtaacgtgtttacctggttttacattctaatgttctatttctagaactgcttaaaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgtaagttcaccagaggagttgggaattgggaagagagttgggtagcaacaactagaagttagatccatcgcatacgagtatgcgattgttgaattacatccttacctggaaaatgagctgttgtaagggttaaatgaaaacctatctaaagcacctattttagagtaggaactcactaagatggtagggctgctgcttttataaggggactgtattagtccattttcacgctgccgataaagacatacctgagactgggcaatttacgaaataaagacgtttattttattttatttattttttgagacaagagtcttgctctatcacccaggctggagtgcagtggcatgatctcagctcactgcaacctccgcctcctgggttcaagagattcttctgcctcagcctcccaagtagttgggaccaccaggcacgcaccaccatgcccaggtaatttttctgtatttttttagtagagacggggtttcaccatgttggccgggctggtctcaaactcctgaccttaggtgatctgctcaccttggcctcccaaagtgctggaattacaggtgtgagccaccacacccggcccaagaaagatatttaattggacttacagttccatgtggctggggaagcctcaagatcattgcagacggcaaggaggagcaagtcacattttacatggatggcagcaggcaaaaatagagagcttgtgcaggagaactcctctttttaaaaccatcagatctcgtgagacttattcattatcatgagaacagcacaggaaagacttgcccccatgattcaattacctccaaccagcccctcccacaacacgtgggaattcaagataagatttgggtggggacacagccaaaccatatcagggacataagtggaagaagggatataaatagagtttaggatttcaactttgatgtatgtaagtaatggcggttcttctgggtgctgcttggcagtaattgaacggaggttatttgcccaaagtttctttgaatttatcagctatttaccaaacactattgatggagttgacaggaccacaaaaaagactcacagcattttcatctgattcctagttttcaggagaaaaattaaagttctttgggagaactttaaaatgttacatttaaatatagttaataaaaaatggcttttgggtccagtgttaacgttagtaaattaatgtgattgagtttcaagtttttggcttgtgcatgcttaaaactttgtgagtcaagaaattcctattataaatttattatcttaaaaataagatctgctcccataccagagaagatgagacaatgagtctaccatcctaacaaacccaacacagatatgtttcaaatctttttccatctctttttattatttttttaagtttacatacatgaattcattttttggtgtaaaattgcacaagttttaacttatatattcctgtaatcaccaccaccacactaaggatactaaactgctacattattcctaaaagtagcccttgtgctacttctcagtaattaagcacaaccttcctctactccaaacccttggcaactactgatctatggttttactttttccagaatatcacatgaatggattcataaagcatgtaatcttttaagactggcagcctttattcaacgtagtgcatttgagatttatccatgttgtgtgtaatgatatgttcctttttattgctggatagtattgccttggagagagataccacagtttgtttggaggacatgtgggatgttttcagttattgctgattatgaatagagctgtcatagacattcgtatacagagttttgtgtgaatatagttttttatttctatgggataagtatctagcagtactgggtcatatggaagatgtatggttaactttataataaatgaacaaaccattttccaggatggccgtgccattttgcattcgtgccagcaatatatgtgagttctatttttttctgcaacttcctcacacttgatattaagctttttgttttagccattctaacagatatgtggtagtatctcagtgtagtttattgttttgcatttttctaatggctgattattttagctatttaaactcctttgacatttcatatagaagttttatttgctcatttggtaaactatctgctcaactcttttgcccattctttaaaattcggctttcttattgttgagttctgtgagttcttcgtatatttggattcaagttctttgttggatatataaaaagcaagtattttcttttagtgtgtagcttgtctttttactcttatcagaatctttcaaagagcaaaagtctttaatttcaataaagtccaatttatctttttttttttcattaatggtttgtgcttttggtgtcatatctaaaaactctttgcctaatccaaagccacagagattccctgggtgtttttttttcccaagagttttatgttttacatgtaggtctgtaacaatttcgggttaatttttatataagatgtaaggtataagttaaggggggttttttgcctgtggatttttaattatctcagcaccacttgttgaaaagactactccttctccattgaattgcctttatacctttgtcaaaaaccagttgaccatatttagtagagacggggtttctccatgttggtcaggctggtctcgaactcccgacctcaggagatctgcccgcctcagccttccaaagtgctgggattacaagcgtgagccaccgcgcctggcgcattatagtaagtcttaaaactgggtagtatgagtactctaacttttgttttttcaaaattattttagctatttaaattcctttgccattttcatgtataaagtttattattggcttgtctatcccttgaaaaaattctgctaggattttgattggaattgcattaaatctatagatcactttgagaagtgacaactgtgttagatcttcaagtccatgaacatcataggtctctcctctttttttttttttttttttttgaaacggagtctcactctgtcacgcaggctggagtgcagtgagtggcacgatctcggctcactgccgactccgcctcccaggttcaagcgattttccttcgtcagcctcccgagtggatgggattacaggcacacgccaccatgcccggctaattttttgtatttttagtagaggcgaggtttcaccatgctggccaggctggtctcaaattccttacctcatgttccacccgcctcagcctcccaaagtactgggattacaggcatgtgccaccacgcccggcctaggtctctccttttatctagattgtctctgacttctttcatcagtgttttatagtttttatctctctttaaagttgaagaatccattgattctgatgtttgggggttttttgtttgttttttttacctttcttcctaacagaaatgttttcagaatctgatttaagtttcttttactgcagtaggtacactagaaaacataattatttgtccagatctccatcttatttagtgttggacccaggccctcaatgacagaaggtcccctttaatagggcagtgactatgtgtaccaattccacgggtctagccagcttttcataagtgacaacagaccagagagcatacttacgtcactatttcctatttctctcatctttattttcagttacagtttctgtctttggggaaaagcaggcaaaatctaatttgtaatggatagaactagctgtccacttaaacaatagaaaactgagtcataaattctgtctttataaaactcctccatacttttggaaaatgactcacttttaggcagcgtctgccatagatatttgccagaaagtgatctaacttggataagcttgatgctttgtacaagtttcagagcccctgtagagaaagctcttaggaaccagagaccatcgtgtgcctgtctgtgtcccgtgactttcagtccatcaacacacgtcactgtagcattttggaatgttctggttcagttgctctcagatgttagctacttcagaaccacctggagggcttgttagaacacagatgattgtgtaccactcccagaatttctggttctatagatctgggataggtctgagaatttacattttgaataagttccaggcattactgaggctgctagtttggggcctgcttggagatcaattcctctaatttctgtgtttgtgtcattcaaaagtaattgataattaaaaaaaaaaatgcaaccaacagtaatctctataaaatcatatatgtttacaattaaatcattcttacaagtaatgagatggtatggatttgttctcaagttattggatggaaacagaaacttctccactaaggagccctgtccatagctgatgtgagagagaaaacaaagctgggccacattgctttctgccttcttcttttatgtaaccaggagggagcatatccctagaattttttttttttttttctaaaggcggagtgtttctctgtcgcccagtctggagtacagtggcgcaatctcggctcactgcaacctctgcctcccaagttcaaccaattcttctacctcagcctcctgagtagctgggattataggtgcctgccatcatgccctgctaatttttgtatttttagtagagatggagtttcgccatgttggccaggctggtcttgaactccagacctcaagtgatccacccacctcggcctcccaaagtgctgggattatgggcatgagccaccgcgcctggccatttaacagcttaaggttgggtctcaagtcctatttcttacctcaaggaaatgtacgatgtttatatttatttctttcatttaggcatgctaaattctgtatattgacagcagacttaacttgaatgcagaaaggagaattcagcagcactcaaaatgaatttacaacgtgacagtgtatgattcattctaaaatgcttaccattgactaaaagctttactcctatgtaccttgatagagcagagatagtatggtagagtagaaagatcaatcattaaccaaggaaatctgttctgtgtgccttggacactcaatacaagggccttggaagccacttactttgaatatcactttagtcaggaaattgaggagtttttggaatcgatctttttaagtttctttttggccttgagattttatgtttttatgtttctatttatttctgcctaagtaaatgaccccgttttctttcttaccaccatccatccccattacaaattacatgcctttttgtaaaagatcttaacctcagaaggagaggaaatgcaatcagcaaactcacaaattttctttcagtcttaattttcttttgcctttttttttttttttttttttctgtgaggcaaggtctcactctgctgcccaggctggaatgcagtggtgtgatcatggcttactgcagcctcaacctcccatgctcaagtgattctcccagttcagcctcccaagtaactgggaccaaaggcaggcaccaccacactctgctaatttaaaaaaaaaaaattttgtaagggggagagtctctctatgctgctggggctgttcttgaactcctaggctcaagcgatcctccctcttggcttcctaaattgctgggattacagccattgaaccaccacgaccagccttaattttcactgggaaagattattgaactgtatgctgtgttcattagcaatctcgccatatcaaatttttgctacctgggttgaaacagggaatttgcatgtctttctaaaatgcatgcatttttgtctgcagatgtcaaataggcaaggcacagctgaataagacatggaaatgtagcttgttacaagtatagtgtgtggaggaatttctaatctctttctgtccaatcagctatgcagtaagagctcagttttcatcctctagccctgaatagaatgggggcatcatcagcaatctattctggagcatacatttttaaagtgctttgaagagaaaaattttcatctactaagtagtgaagaactcctgattaataatcgcatttcttttaatttgtttaaattgagatgattaggagaaaacaaagatgggggaaagattcaggattttagagagttattacatcctgattcgggtgattatccgtactctccacctcggacacactgtgagctttatttacgtacattttgaggcagacaagattagctagatcccaggtgtccattaccctgtgaccttttaccaatacaggtaagaaatcttaaactcaagcagaaacctgtacacagctgatctctttaggagtctataaatctggggcatgtgctgtgagatgtgtgcaagccttgttgggtcactctctgttaggagaaggccccccagttaaggcaaaggacaacccaacctattcccaaattgacctgtgtagcagaatcagctttggtcttaataatgcaaggaatcaaagagcctttggtgttgaatgaagtatgctataccttagccagaagcctcacttctgacctgtgcttgatatcctgtgtattgtgacttgattatccatacatttgacttttcaagactccctgaggctgggataattagaatagcctggtaaagccatttaagagttttttaaataacaatttagggactgtagtagggttcctgttgccactgttctccaacagcacccagcatttgagaatcagttagtaccgatccgatccagtgatatataagcaaaaattctgattgtgggaaaacagaagagaaggcagtgttggctgttcaagccacatgtctaggcataaatggggaggccatgatttctcactgcttttgacatgaaaccacaaagaatgtctttgttaagaatcaaaaaacataagagttgaacaagccaaaggaagaaatgatatcatggcctagttgaatcaactaagaaatatttttatgttaaagaaattctttaaccttataactagggcattcacattcttgagtatattgagtggaagattcctctgaaaagaaagttcacatcaatagcctttgaaagatttagggaatattttgcagtgtaagattcgttatttaaaatctgaaatatatttttccttcctacgactcttctatgtgtttatagtaacatcaagacaatgacatcctgcaattgcactagaatgtattacaaatgcatgccttgtgccaatgtattcaacaaggaagctatctttttcctctgtcttattttcattgaggaaacccatgcctatgcattatgcatgcgagtctggtgtggtgtttaagtaacctcccatgggactgccgtgagactgctgtgagtctggatttgggggagagctgtgtcttggcattttcaaatataagagaaggatgttacctgatactcagagaatcttggctgaagcttagcatccctctctggattagcttagtgttgtttcatgatactattttttgttttaaccagttgtgccattgtttgctgatggaaattgttacatgccagccggcaatgctagggtttcagataaatagaatatcagcatcattcttcatatcagcaaaatgataagttgtggttttgcccatcatacttaaagctaatttaggacttaaaatctggagccatgcaaatttataagaactgcttaataggagacagtgcattagttgatttagtggttgaatttccagtgaattttttttttttaattctgtgtagggacccattttaagataatctggaaaagaagagaaccagggaggaaaatacagtgtgaggcaggctgggtggcaaaatggaaagagaggtaggctttgggattaaataaagccagtagttctcatattttctgtatggcaagagctcctttagcaggctgaaagttctgtggaacccctctcagaatatttttaaatgcataaaataagctggactacaaagaaagccagttgtattgaaaagttaccaaaatatttaagaaaacacttatggcacagtagtatgtgcttttttactaacacacaaaataacaagttctagttgtgggacctaatgacttctatagttttgaaatggtgatgggcataaatgatatttcacaattggcaacaactgtgaagtgatataaaaatacgggtatttctgttggagacaaggtcatagatactgccaatatctggtgggtggtccatacattcataattgaaggaaaatgctaaattgtagaggctaatgcaaagtaaaatgtaattattttcctgtcccagtccccaaaacaagagcttgtggatctcagattaagatcccctgggttagaagaacttggctagaatattaacatagccttttactggctgtaccaccttaggcaagttaacctcaaaaagtctatttcctcatttataaaagcgttgatgagacctactttgtacagttgtggaaaggcataggaagatcatgcctagcctcactctttgtgtacaaatgatgacttgaagcacgttaggtcttctggccagatttcttttggcagtgatagaataaaatgacacttgctacacttgctgagaggtaggggcagactttatgctaggcagggaactcaaagattacactgaaagcagaaaactcctttacctttagattttcttaagagttgtcgacccttaaggagtgtcagaagtgggatataatatggagaaaagagaaagcattataaaatatgtggaaaggagtctattaggaaatttcctcctggccttgttgatccaaagcctttagttgcaaagaaacagctttttgttcattataaatgttttaacaataactagaactggtgttgccatccaccccatttgggcatgagcttttttcttccaccggagacgtaggtccccagatgattgattggctgcaaagtatggacatgtcttgattgtttctagaaggggcgggaccactgccttcttggattgtaactactacacctgcagagccccaaaaggtctggctactctattagattaaggtttaacatgtgataatagtctagttttattacttaaggggaaactcaaaagtgtggataccttgattttgtctggatattttattaagcacatgtacctataggccataaggatgtgttctttttctggctggccactgagtgtgtctgtgcatgatgctgggcagctcttcctttctccctgacagcttttaaaggcaggatactgagtgtttgatccatcatctcagtgagggtgtgaaatcagtgaggcaatggagcttcagggtttccttgtcccttgggtcatggctaacaccccatttaatgtctccttttcatcaaaaccagatttgtcgtctcacttatttcccagtgtctggccaagatagtgatctttatgaaaacaaactggaagtaatgcaagccagaaaagatgggagagcttcgcctctgcagaaggaagctgttaaggggaacagatggagacagggtctaaacagcttcaagaaagtgtgcacttgctagtctcagaggtgctccctgtcccccaagagctgtttgaatcaggagctgcttaaggacctgaatgacttctccaactctgccagggatccttcattagccctgcacttctgagatcactcagtgccccccatagacctctcctgctcttctgaatgcagaagcaggagtgggatataaagtgaaaatatagtaaattctaacctagtgtggcttgaaaaagaagttgcaatttatagagaattgccaaatatactgtgatggatcactaattttcaacatataataatttattaaaacactaaggatgacgtctataattgtcgtattaatctctgaaggtatcaggactttacaaggttcctgtgccttggccatcattgtgatcatttatagtgactaatcaatttgacaactatgtggcatatgaatggtaagcattcttggcaagcaaagggaagaaatgtcttatctgcatttaccagatctcatgtcttggctgtttgcagttatttacccctttcttccattaatctaaacttccaagaccctaagctcacattgtatcctgtattaacttgctaactaacctcctgtttttgtggttttctttctctgatctaatcagtccaatcagaagaaagattacacttacagatgcacatgctgatgtcatgacatcatcctcttatttaaggatctccctttgcttccctatcaagtctcaacttctctggccatctagacctcaggtgaggtccttttatcttagcgaccttgttctttgattcactgacatggatcttgggcgccattaagatggtttatttgttgtcagacaccctttgttcttttctgtcctttcactgtggaatttttctcttggccaaattctatccattcttggcccacactgccttcctagcattcttgtatccctctctcactgtctcgcctgcacaatttggtatatttggtttactattggtcttctgttatttcacatattacttgtttttccagcaagtcagagttccttaatagaaagtattctgctctatttattttatatattataattcttagcaaagcaccagcacacagtaagtgttcaataaatatttagaggaagcaggtaaaaggtgtcatgagttagatatttccaataggaggagatggacccttgatggggtcaaccagcatcaagtgtgcctcttttacaaaaccaggaacccaatcttctccttttttcaaagttgatccaggcttatggaattcagttcataaaaaccaagctcaagggagtgaatgccaattcaataacaatgaaaagtctaacctctaggtaacagaaatatctgtgtcagccattcattgcatcctttttcttgtagcaaggcttccagcaggcgactctagggtcattcgtggccaatatgattcatttgcaccagctctgaagcctagtgcatgccatttagactctagggacaccttgcaaagttcttgctttttactttcaccccttcctcatagatgactctttgctttttaaaggaattgaagggctattctatagacaggagtaaagcctgttcagagatgttctaaacaccagattttgtttgcttgagaagcaaagagaagataatttagacaagggcaaaagcaccatgagaagactttgaaacagttttacccaagttgtaactggagaagaagacttgatgagtcttgtgaattaggcagatagcattcatgagctggagagaatgggaaatgcagagtgcaagggagattagttttgagggagcaggtggcagtgttgagtgatgctgaggggagatcagaatgttgaaagagaagtatgactgatatctggttagtttctttgttttgtctttcttgagctgctttcaccaatgatgtacatatgaaaaagggatgttatgaataagttaccttcaaactaaattaactgagtggtttttacatggagcttcaggatatccagaagcatatgtctaggaataaaaatggttatttttgagggctgggcgcagtggctcatgcctgtaatcccagcactttgggaggcaaaggtgggcagatcatgaggtcaggagttcgagatcagcctggccaacatggtgaaaccccatctctactaaaaatacaaaaattagcctggtgtagtggcgcacgcctgtaatcccagctagtcaagaggctgaggcgggagaattgcttgaacccgggaggcgaaggctgcagtgagccgagatcgcgccactgcacttcagcctgggtgacagaccaagactccctctcggaataataataataataataataataataataataataataataatggttatttttaaagtaatatttaatgtgaaattcataagacttgaaattgggggaaattggaagggattaattcctgtcctttgactcattgtcctttaacacagattagtatttttgcaatcttagaattatgtatttatcaggggcttctttttcctgtggacagtgtcaaggggtgttttgaagtgacttgagcccaggaagtctgtttggataaacactgatggactgatgtagaacagtttatcatctctgagcaactggtaatcactcaaacacatgtaagaagctcagtggttgctttttgcaactatcaatcatgatggttgtgtaatgcaaataggagtaaagaaggtttgattagtctgtaacagcagctggcacattttttttgtaaggggctggatggttttgtgggctgtgtggactctgtccttatagtttgaaagcagccataggccataaacaaatgtgtgcagcagagtttgaataaaactttatagaaaatgaagtttgattttcatgtaaactaatgtgttatgctattcttttttaaaaactttccagccattaaaaaatctaaaaaatatccttgacccacaggctgtatgtgccaatccctggtacataacatagaataggatgagtttcgggaagaaacagtacaaaatacaggctgctatatgtttgcaatagtgtgaaaagaaagtttacccagcgttttcttggcaactgagacttcttgtaccattcattttcaaaagtcatttcaaaaccaggaattttttcctaatttctccaaactgattatatcagctttctaaaatatttggtgtgtaatcaaagtacagttttgttgctggatttcaaaggctgcagtttagtactaggtttctcctgtttcaaaagaaattgtgttatgtacataaatatgtacgtgcacatgcacacacaggagggctctttaccttaacaatttgaagttcttctaatttcctttttgttcactactaagtgattctttattctccatgtgtcagtttatttccagatgtacatcttagttttcttctggtaaagtcctgtttcttcctgtccttgctgatagaggaaaccacataaagcatttcttaaaattaagaaaacaatgtcacttcagctgtgaatcctgtaaactttaagaatccattcagaatgcacttgaatgggaacattttgtaaagaaagctgaaaaatggcagtcagatttttacagaacagcccaaaggggtgttttgtgtgctaatgattagaacttttgcagattcttgcttagtaattaggactgacagatgggctctgtattagtccattttgtgctgctataacaaaacacccaagactaggtaatttgtaaggaacagaaatttatttctttcagttctggaggctgggagtttcaaatcaaagtaccaggaggttagggcccagtctctctgcttccaagatggtgccttaaatgctgcatcctctggaggagaacaccatgtcctcgggtggcagaggggcagaagagagagaacctactcctgcaagcttgcctttttaattttttaattttaatgtttttagagacagggtctctgctctgttgcccatgttggagtgcaatgacatgatcatagctcactgtaacttcaaacccctaggctcaagcaatccacgtgagtagctaggactacaagtgtgtgccaccatgcccagataatttttatttatttatttatttattttgagggacagggttttgctatgttgtccaggctagctcaagctcttttgatagcagcattaatctactcatgagggttgtaccgttatgacgtcaatacctcccattaggctgcacctcccaacactgctgcattggggattaagtttccaacatgcaaatttggaggacatattcagactatagaaggctctgttcctcggaacactgtctttttaaaaagaagtgcatttaattattcaaagaatacatgattatatttttgtcttttaaaataatatggataaattgaatttctcatttgaccctgtctcctccactcaatacttcttcccttcccagagataatgtcttagtctatccaggctgctataacaaaatgtcataaactgggtggcttagaaaccacagaaatttatttctcacaattcaggagactgggaagtccaagatcaagacattggtagattcggtatctggtgagggtctacttcctcatagatggctgtctgctcacgtaatctcacctggtggacagagccagggatctctctagtgccattcatgagggctccaccctcatggcctaatggcctcccacaggccatatctcctaatactgtcatattctgggttaagattttagcataggagtttgagggggacataagcattcagttcattgcgggcaaccattgctatcaatgttttgtaatcattttctgtgtgtttatgtaaataaatgttcatgaagtatgtttcctaatagaaaccatatgagaccaggcatgctggcgcatgtctatagtcccagatactcaagaggctgaattgcgagcattgcttgaggctaggagtttgagtccagtctgggtaacataacaagaccttatcattataagatgaaaaagaaaaaaaacccatatggatgttatatcctacagattataatgaaaattgcttttttttcctacttgatccatgttggagaacacaggtcagcatttttcttttgccatgctttcctgaggattgggtgggtgggggggtagaaggtgatagaaaaccctttgcatatgatatggtggtaagacagcctcctatcctgtaggcgtggtcaaggtttaaagctgactatctcatggggtgctcatgagggttcttcaaagactctgtcatctgtgtcagtttctgggagtctaggggtccaccaccagtcctgccactgtgatcatgttgccctttcagacagccctagaggactggacctgaaacaagccctggactggctcgttcttgtcggaggaccactccgtgcccttggaaacatcaggcactctttgcccccacacccacagcctctgagaggatggcccagacccactgcagcagcaatttcccttcactcccatgccaccagggcagctagccacactgcctctcatgttccaggtccccagagaaggggtgccagcacctctctgtgtctctttaatggtggagcactcaaatcaagcccccaactggcctcactgaaatccggcttgtgaagtaagaagctgatattcctactctttccccaatgggaagagggtgctgaatggggatctcagtgcagctctttccaaagaaatcctccctcacatcttgctcttgaccctccctgtgggagaggagcttaagcctagttcttagttatctcctttttgaagggcagatgggtgttttttttttaactcactttggtatctgatattgctagcatcttgtgttagagccaaaacttgcagtgtagcatcctcatcatgtgtatactagaaacttacttgtggaattgttggatgatagagggatggtgcagtagaatgttaaattactcaccgacggggtctcaggtacatgccacacgcttgccaacactttacaaaattgatctttaaatgtttttaccaggcttttgaaggaaaaagacacatatatctcaccattttacttttctttactaggcagttctttatatatttattgagcattttaatttttctttccatgaatttcctgttaaagtcctttgccctattatttatatatatatatttttttatttttttcttgagatggagtctcgctctgtcgcccaggcttgagtgcagtggcacgatcttggctcactgcaagctctgccccctgggttcatgccattctcctgcctcagcctcccgagtagctgggactacaggcacccaccacacctggctaattttttgtattttttagtagagacggggtttcaccgtgttagccaggatggtctcaatctcctgacctcatgatccgcctgcttcggcctcccaaagtgctgggattataggcgtgagccaccgcgcctggcttgccctattattttaaaaattgtctctatttattgatttgtaattctttatatattctgaatacgaaccctttgttacatagcaaatattttctcccagcttggccttgtcttttaactttgggaaattggactacatcaaaggcacgatgaataatgactttgtgttgtgtctggcttaaaaaggccatccttctccagggttataaacaccttctcctatatattcttctcatgctgtaatagttgacattttacagtgttttgagggttaatccatcagggatattttcatgaatagtagaactctaacttaattttttcccacatggagagctagttatttcaacactgtttgtggaaagccagtagcatggtgtgtggccactagaataagggtagtcaaagggctaaagtggctggagtggggagaatgacagataattgctaaacatcctactgatcaaggttagatgacttctcagtctagaagatacatacccttctgagaaagccccctgtaggagtgaacacccaacatcctttgaccggttttactatcagaacatttacatacaggcagaactaaaatctgtgattatctggatgagaaaacagttgtaggcaacttactcatttttctgaacaagaaaaggttctacataattacgttctctatgaatcttttatcagatttaatagttaagtctcttcaaagaacatgagatattctttttttaaagtgagcctatgatttatttatcctcattaatacttgttttccccaacccttccaagctgtttgggaatgttgtgtgtcagggatcagtgaaggtcatgaagatgcctttaaggcctgattaacctgatttgaaaaactttaaaactgaccttctctacatctccccattattgtcctacgtttcacagtcagatcaaggcttattatcctttccactggggaagtagcccaaatcatagtgtgagtgaaaaacatttactaagaagtgtgagtcttttaaaccctcttgtgtttcttttaagaaattaaaaccaataatgactatcagttgaatttggttgttccacctttattttatcaaaatccttggacatacattaaagtatttgtcccttgggcaggtgccaaggctatgaagttggagcgtggcatgttctagaagcagaaagaaggctggtgaggtagggacacagcaggtagggagtagagtgaggccaagccccaggtcagggctggacctcagggcctaggtccaggtgaaagcactgggcatgatgctgagggcagtagatgctgtgggaggattttaagcagggtgacaagatcaggcttgtactagatgagaacgttggctgtgtaaagatagattgacagtaagcaagagtgaatccagaaaaaaataatctagaaacctgttgcagtgatacaggtgagggatactttgcctttattggatttgaaagtataaaaaaaaaatgaacatctgttgtttagagtaaaagccctgtaaggtatggtataaaatgaaacattttcaaaaatgcccatgtcacaaaaaaattttttttaaatcagctctgtgcaggaccagctacctaatttgcagggccctcactgccaaatgaaaccgtgggacctcttgtgcaaaaataaaataatttcaagatggcaacagcagagcattcaacgaacatgggaccctgtgtgattgctatgcggcacgccctgggtctgtgtgacaaaatggcttgagtcagtccctgagaagcttctccttgcctgttccataaaaaggctgatgatgactcctgtggtctaggcagagaggtaaagataagctaagcttgtgtagctactactgttattttgtttgtttgtttgtttagactgcttcttgcagagcagggctaccctaccggcagtgcgcccagagtaacctgttctttaactcaaaggctttgttaaccttaatacaatgtaaattacagagaatgtcggaaacaaaactggcagcaggtatttatgactagaggaggtgagtagggatggtgatgggaattaagagaattgttttttgttcttattggctgtggttgatgaaaacataaactaggagaaggaaataacattaacattaaatttgttccttagaactatttatttctcctagcacgtacccatttacctggctttccaggagcatattctttttttttttttttttgagatggcagagttttgctcatgtcacctaggctggagtgaagtggcacaatctcggctcactgcaacctccacctcctgggttcaagcgattgtcctgcctcagcctcccaagtagctgggattacaggtgccagccaccacgtctggctaatttttttgtatttttagtagagacagggtttcatcatgttggccaggctgatctcaaactacagacctcaggtgatccacccacctcagcctcccaaagtgcggggatcacaggcgtgagctaccacgcctggcttccaggagcatattcttaaacagtttggagggaaaatggtttgggcaaaagacttcctgttaaattgtgtgctgctttctttttcttttttaaagaactggtaatacagccgggcacggtggctcacgcctgtaatcccagcactttgggaggccaaggtgggtggatcacctgaggtcaggagttcaagaccagcctgaccaacatggcaaaaccccatctctactaaaaatacaaaattagccaggtgtggtggtgcacgcctgtaatcccagctactctggaggctgaggcagggagaatcacctgaacccagaaggtgaaggttgtagtgagccaagattgtgccattgcactccagcttgggcaacaagagtgaaactccgtctccaaaaaaaaaaaaaaaaatttggtaagacatggcttttggctttttatctccttctccacttattttttacctgtggaaaatgattcagaaaccggacagagctttgcataagaggtgtaaattgtgaagttccttaactctgaaaattgaagacataaatatatagaattttcccttctagtatcactgagggaagaatagtggctgtgggaatttggtagtttgggatattctgaaattgtttgctgtcattttcatttgtaataagtttacttggcaagttctgtaccaaagctatcttgagggcaaagtttgtgaacaccttttaaaacacagtttacgtttctagaaaaaagatcttatgcttactaaacaaaattcctttcagcagttttcaatgactcagagccctgatatttgcatagtgattcggccaatggaagttgactttgagataattttggttaagataagtctcctggtttatgcttttaaaaggttaggttaataaaggcctgtccggaatagtataatgtgcagtggtttccagccacttttgattatctcaaatgccacctatagagctgggtagtaatagtgatattaaggtattatttcagagggacccacaaggccaactttggactcttgacattaaacactgcaaaattccaaagtgcagacagcttggcaagtttgagttctggtgcattctgttcacaactatttttttttttttttcaatagtgcttttgtctttctgctaaaggtcagactgtagttgtcgagtactggtattgttcctgaattattcgggaagagggtggaaatattgacttagtttttctattataatatcctatcacaatgctggattttaatgatttaaaaatgtaaataaaagtatttgcatttttagactacttgtgagcagctgccaattctaaaatcactatgggtgtttgcagctcttttctgggctcattttacccatctttgatcttctatcaacatgcaggtctgtgtgatgggctagaaccagcatgtattttgtttagagtcagactttgttggaatcctggtgtcacaatttggaccctcggggcagcacccagattaagtaacctctgtaatatgggggtgccaccactgctttgcagagctgttagataaagtaatgcatattgcctgctacaaagtagatgttgtatttgagtgtagaggaggggtgtatttgcccattctcatgatgctaataaagatatacctgagactgggtaatttataaagcaagaggtttaacagactcacagttccacatgcggctaggaaggcctcacaatcacggcagaggatgaaggaagagcaaaagtatttcttacatggcagcgggcaagagagaacttgttcaggggaactcctctttatcaatccatcagatctcgtgagacttatttgctgtcacgagaacagcacaagaaagacccgcctccatgatccaattaccttccactgggtcgctcccacgacatgtgggaattgtggaagtgacaattcaagatgagatttgggtggggacacagccaatccatatcaagggggggtaaggtttaagtgcagagccattgagtccaggctgctgccacgtactcttccagggcaatggaggtagtctgagtctgctccatggagagtggccatgagggacccagagctgacctctgcctgcctcaagccggattacaattctgttgggactgtttttcaactgcacccagctgatctagagagagtttataattgatgtgtgtttagctctgtgtcagcatcactggtttcttaaggagtctcactcaattcattggggctaaaaacatgaaatgggtttaactttctctaggcactgcttaccactgtgccctgttaaatccccccttccagtctctgaatggtggattgggcatcttctatcattctttcatctttccaaatctcctaatgttacatccagttcatcttctgtgcctctcctactctctcttctgagctctaggccctctgggatgctggggtggagaggagaggatggaaatggggagcaagggactagtaattatttaactcgccaagcggagttggtggtgagaaagtgcctctcgtagcctgctgcttttgtgtggtttgttctgatggtggggtgtctgctcaggtgatgtgtgactctcttggggctgtgtttggctttacctcagcctcgtttgtgagcagcctgtgcaaaggacagcagtgtccccctttggtattgctgggtgttcatgccccatcaggcttcaactcctccttctagtgagtgtcctggtgcttggcccatcagctgcctggcagcccaagggctcctgcccctctgacctcaacactccttcaaaaggaactgtgtgagttactgcagtcctgtctctctgtccaggggttgtagggaactgaactggagcgggaatattccagtcttctttcctggaacattcccttgaggctctgcttgcatgtggctccctcagtgggcctgccactcccgaatctctgactcaaaaatgggtaccagtctcatgctcatgggtgtgcccccactccagggactggatgccaagttccccctactccctgacatgctccgttctgctgcagtgccagcctggaagggagcgggaaactgtgaagtcttcagctcagccagcagtcagactaggagcaagatgctcatctctccttcttgcaggtatcctagtctctcctagtgattctcttggaagtcccccaacccctacctggttggggaagcagacagtaacctgcactagaaccttgccctccccataaagccaacatcaacctttctccttgtccttgcatgggaagaggggctgtggtcaggtagtaagactggtcctctgacctcctggggaagccatagggggcagtgtctgaccctacttgtttatggctttctgagtagggtacttagccctgttgtgctcagctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacctttctccggctcctcgcatggaagagggcctgtgcatacagctagtaagacatggtcactctgacctcactggggacacccataggacgccagtgtactgacctacttgtatatgactttcatgagtagggaacttagccctgtagtgctcagctagggcctgggcatgtattgtaaaaataagggaaacaagccgaagaagcgaaggagtccattttataaggagtattagtaagtattgctctttctagtagtgacccaggatgttcatgtccgtgtgcatccttttgcgtagcagtagacagagtagagggcaggagcaagcacataatacattacgtggcagttatgatgatcaggattcatgatacagtaggcttaaaatgataatatatcaaccttaggaaaggtatggtaaggggtactccagtggaacatcaccttatgaaattagctgcaggaattggaggttcaaagcgccccaagttttcttcagtttccccctcctgactctatgccagtgacttagaaatataaaggtgtgttctcttggatggattgtttgacttgctgcttcctcttcatattcacctaagaaatggacggtcaaaataaatggaaagtcttactttaaatagcagagttgatgattaggttcaggtaatctatttcattgttcatttattaagtagatacaagaaagaaaaaggaaaccactgggagggtatgagtgaaatggctagctctttttgggaaaagttaatctggtggcagagtatggaaactagatcatccaggggaagaggagttggaggtatggagcactagattataggtcagtgttcagaccagaggtcaaagggcctgaccacagtaagtggcagtggtagtgggaaggaggggatgaaatgagagagaggcacagagttgctggaagccaacaacggactggaatgagaacagggaatgactttgcagcattaatctgggatccatgaaaggagagggtaccatgaacagaagtaagggagttagaagaaaagaccaatttgagggtgcggaacatcagggctacccttggcctatagtgccttttcaagaaggaaaagatgttccctcctccaggcacaggacctggcctgtagcacacaggctggtctgggctaggttctggtgcacagtgtgccacctacacaaccatacatgatggccccggggaagattcctttagagcagcaaggttcccatggagtaagaaggcctcaacacttcatcaagggcatagccagactctaatgtcgaatgagtgatagtgcttattcctgtattgattgcagaaaaagccatcatgtaagaaaagcactccttttgacagacacctacctaatctacacatatcacagcttttcttttttttatcgtgatgaaatatatataatgtaaaatttaccattctaaccatttttaaatggacaatctagtggcattaagtacatttacaacattgtgcaacatcatcattctccatttccagaaatttttatcttgcaaagctgaaactctgttcccattaaaaataattccctattccccctcctcctagccccctggtaacctctattctactttctgcctctgtgatctgcctactttagatacctcatataagtggaatcatagaatatgtgtcctttggtgcccatctgactttttaacttagtgtcatgtcttcaagtttcatcgtgtggcatttatcagaattttattccttttcgtggccaaataactttgtattgtatggatatataccacattttgtttatctattcatctgttgctgggcacgtgagttgtttccatgttttggtgatcatgactgatgctgcagttaacatggggtgcaggtatatatttgagtctttgcttctaattctttggggatattataatacctatactggatcacaaagtaattctacgtttcactttttgaggagccaccaaactgttttccacagtggctgccccatcttacattcccactaacagttcataagtgtttcaacttctcatcatcctcaccatcatttgttattttctgtttctttaaaaccagtagccatcttaataaagtaatattgcattacagttttgatgtgcatttccctggtgtcccagttctacttttatatacctgcttgtcattaagaaagctctacttttcaagaatgctggaaagagcagctttcccccgctataaactcatagccaaccttcacttatatgagaacatgcagagcatagtttcatctcctttgaaatactgtaataagagttttagatgtatttgattcaacgtgcagaatgtttattttttgtgtgcgtgtatgtgtgtatgtgtttgagacagcgacttgttctgtcacccagactagcatgaagtggtgcaatcacagctcactgaaacctcaccctcttgggctgcagcaatgctcccacctcagccctctgagtaggtgggactatgggcatgcaacaccatgccatactaattaaaaaaaaaaattgatagagatggtgtcacactgctgggcacaagcagtcctcctgccttggcctcccaaagtgttgggattacaggcatgggccactgtgcccggccactatttttcagttagttgtgagcatttaaaaaaacagaagaactcataaaaaatctgaatcttccacttttcaagaaatcccaaaggtcaggcccttgtggtccacatttccacaagtagctgtgagctagagccaagttgcttacagcccccacccagccagcttcgttccttaccggtaccggcctcacccctgcaggtatctgtttccaagcccgccctgttagagtggattttctgaggctaaagttagtttggatttattccaacttatataaataatcgaggtgattagatatgactaatacttctgttctacctagctacttaatacctccactgacactttctttcctgataaaatctgaaatctcttcatttatccttgcatcccttgagccccttgagggacaggtcttatcaacagattggtttctactggttaaaagttgcattaaatttgtctcctcatacctggaacaattggatatcatgttttgcatctgcccatcaggtagatacacccttttagctctgccacattctaacatagagtggctcttctgtcattgccacctaattgtaggcctctgcttgctagttgtatccactgtttacgttatagagaaatcttttcacatatgtaaggactttatatctgtgtgtgtgcccattcatttaatagtctttgtatatgctagaattaaggcacaagaaatacaaatgtttcatgtctgtggtcaggaaatacagttagcaatggctgtagctgtttagattgtgaagatgataattggccgcttcagatcctgtgtcttacagataatcagtactggaaggtgtagggtgaagctgcgtcacagccatgaaatggaggcattgtgaaacccaagccggcccagaacaccctcgcagcatgatttgttattgcacagagctggctgtactgctgctcaagccatatttcctgaaactcaagaacgccagagtggaatagagttctcttataaccagctcctgttccctcaaaccttcgcatgacaccccttgtggttttcagcccgtctctctgtgtggtcgctaatgacttcattaaaggtgaagcatttcagtgatcaagagccagtgcttgatgatggttggagggacgtaaatgtgcaagcgggcctcagagcctaggtggaccggcctccttgccttcactctcaggcatcacggccctccagcatgtttctctgaggagctgttgatcatttgcccaggagatggagctgggaacctcgttgtcaccaagtcagtaccaatgatttgtgcttcctgtcagggaaacctgtggtgcatgtgtttgtcttctgcttctcagccagtttctttttgcatccatcaatctcttcttatctgtcttctttttcctgactgggcatagtagtcagttgtgagtttggacttgtattttcttattttgtaacagtttgtttcctggcttcatcttgcccctccctcctaaaagctccacttgtcttttatttctcaaggtagatgggacgaggttttttgttttttgtttttgtttttgttttgtcaggttgacttacatttccccccattagggtgtgccgcagaaagaagttttctctatttctgatgtctatgtcaatacagaacaataatgaaattgttaggcaggtgaaatggtacttaactatctgtctggaaactcctaagcgcctgcaagtctttctgagtgagaatttactgtggatagcagttaagatgccccattcctgaacatgctgtaggaatgggtcctggtaggcatcactttctagccagtccaaagccacgctttcctggcagcctgttcctctcatcatcttcctgttcccatggccatggcaccccaaatgtctgctgctctgaccaaaaagctggcagacagtaaataaactgacttctaagataagaaccttcatttgaaacaatttttaacatgccttctttgtcaaggagtaaagaccctgaatcccccaggggttcctacagcccacgatggttcacaagagagtctacaatcctcagagccaagaagcactgagactcaaggacagggccacttgacagagagagcagttcccagccgacttggggcctaggaggatattctgggtggcagggctctaattgattattaacctacatataaaatcaaggacatatagccaagcacagcagcaaatgctgccaccttgtgagctgcctgtggttgtgctgggtggagatggatctagctaaggcacaccaggatgcagcttagagagaacttggtcagatttttactgcttctggtataattggaacactttacttcttaagcctactgtgtaatgttatgtgtacagagtgagtggttgcttaattaagtgctttaattttttttggtcatatatacacgtggtgcaaaatgtaaaaggcccaaaggaggggacagtgaaaattatatctttctcccacccagttccccttcccaaaggtaaacattattgccagtttcttttgtagcctagtgggaataatttctgaatagttatccatactttataggtaactctatagcgatagaactatatgtagttctatacagtatgtatgtagttatatacagtacatatatatgtctacagtatatatgtagttatatacagtatatatgtatatatgtactatatgtaaatatatacatatgtagttgtatacagtacatatatacatatctatagttttcttctatatagttatctctacatatacatacatatatacacataactatgtatataaaactatacaattgttacactgttgtgtaacatggatgtgtatacaatagcgatatgattaaatatttcttattaatgatgatttcctgcagcctttcaatcttgttaaacacaaggaaaattagaaatggaccgaacagaagtggcatcataaaaggcagctactgtttgggagcaagggacatgccgtggagaggaaatgtgtggtggtctgaaattgcaccagtttccactacaattttaaaaccatgcctagccttgccaaaggacctcgggggcaaaggttaagccgacacaccctttaggtcatggtacacagtatctctgggcacatggtggactctggtttgtgctggacccctaaaagttatttccttttatccctggttccctccctcccataggcaacattctgatatgtatacaatgtatcatttagatttgtgtgtattcttgcaatggatcttgttttgtgtgtaagtatttttaatttatgcaaatggtatggctatctcattctgttccttagttttttttactaggctttgaaagttccatccattttactaggtgtgaatccacttcattgctatctgtctttgtagggccaaactgagatttggaaaatacttgaagcaatctttgtgactttttacccaggttttttcacatgttgacacacatgacaaaaagtgcatgtacttttgtgttactgttttactcactttactatttcaactttcctccattttgctaatttgtcataaatattaatggctgtatagtattccatttatataatcagttattacttcacactctctcctgtcatcagacatctgagttttttatttttaatatcattgtggttacatgcgtatcattggtctttgttgattttctttttcttaagccagaacagatgcccaatagggaattattgagccagagaaaaattctcctatagcatgtgatggaagtggccacattttacctcttgctttatttccagaaatgaacacaggtgtctatatccatttaatacacccctttttggccgggtgtgttggctcacacctgtaatcccagcactttgggaggccgaggtgggcagatcacttgaggtcgggagttcaaaaccagcctagccaacgtggtgaaaccccatctctactaaaaatacaaaaattggtcaggtgtggtggcgtgtgcctgtaatctcagctattccggaggctgaggcaggagaatcctcgaacctgggaggcagaggttgcagtgagctgagatcatgccacagcactccagcctgagggacagagtgggactccatttcaaaaaaacaaaacaatacaccactttttatttgtagtgcactatacttagagctgttgccataggaattgatataccaggcgtcatggtggtcagcagacaaataggaaactcctgttatgtcgtcagaatgagttgcagagagtaccatctgctacctgtattgtacatctttctgttcctctgtcacgcctggcacaagagcagcattggtttaatcatcagcagcccttctgctctctgtagtcaggattggcagtaactcattggtgggcaacactgccttggtcttgccgcttgcactgtgaactgtaactacggacacacatgtcaggaaagaatggtgcttgggatgctcctcctatctgtgcctcaaacgttttcactcgagggatattaaaaagtggcctactgcttataaagactgtgtgtcagtgaagaggaagaggtgggagtggagagtgggaggcatttgcaagaacatatgttggattctttttttctcttcttggtgacaatgattgacggcatctagtgagtccctgtttgtcacttccttggtacagctggtagtggaggtgggggaaatcaataagggctggacaaaggacatagctagaggaagaaagcactgcaaatatggtattaagatgacattcctcacagttgaatttttcactgtgctattacttcacactacctgctgcgagctattctcttttgatcctttaggctgtagaggaatcagtctgtgtaactctccctcattcaccacctccaagaaagggttaactttggacataagataactgtagtttaaggggaggaagagaaggaaggaaattcatactggatacagcttttgccagttttgtttcttctatgttgaaatatgggctggctttatggcattctcttggtgttctggaatgtccattatttaacaattccatattgaatacttgcttggggcttagaagagggaagtcaagtgtaggaaggagttgtggcaatttaagtaagtttacaatgatcttattaagcttgttgctttcattttcctgcctacgttggggcaaagacgtgttaaaagtgcaagaacagtgattattttgtggttagagcatgtgcacagtgtagacaaacccaggaaggagaatctgcttcatcaagtcttaagttgttatttagaccaaaatgtatgcgtaagcctcagatgactgttgatgtgccaggaaacttctgctgagtactttcggttctttcttctttactttacctctgcaccccagctcatggttatcttgtaaaactgaaggtgctttgcactgcaaacagacatgacagctcagtctcccctgtagcaagttctagggaaggcaggttggcagagtcccatttttgagctcagttctccaaggccctttggtcagcttattttcctgcagggtgtcacatcccacagtagtctccacctggaagacattggatctcatatgttcagatcagtgtagccacgctgctctgtggagaacagtgtgataaatccttggtagcattacgctttaaactggtggccacttgcctacctccttttaatttcattttgttaacaattgtttcttgaggacctgttgcatgctgggtgcttttttcctgggtgatttcacatttagcatctgttttcattctcatgacttctctgtgaggtagcaagtattgtacccagttttctgatagaggaaattgtggcccagagagattgttgtaccccaaagtaatgaagatgaatacagttgcagaaccaagttagaagccagatttttggagatccaaggtccagtgaacacagctgtacccccacagacacttccgaaagtgaccacagcctcttcagccagtcctgaagagtatgttcaccttcatctgtcttaaagcacaggcacacctggctttgggaaagcatagtttatcaagatctgaattggctcattttagttttagaaaaggtttcacctaaggcttctgcttaagaagagagcattcctaggaagtgagcttaagccctgttcaccctattaatcttaagtgatttgtcagagcagagtggcagagaggtgtcctgcagaggtgacaacctgaatttaaatcacagctcagccgcttactagctgtgtaatcttgagcaaattacttaactctctgagcctcttcttccttctctattaaaggggagtgatatcaatctcatcagattagtgtgagaatacattcatataagtgccaagtacctgctaagtgctagtccatgtgctaagtaaatgtgagctgcaattgtttgccattggcattatcagtagagtgggagtctcattatagcagaaacctggctctcctgaacatatgtaaatatttacatagcccctactaaatgccatttaagagtgtatctagtgtaaggcaataggatgtgtttagcaggaggagtggatttgttcagggggtgcaacagactgggatgggagaagaaggcatgtttgatagtcaaaatgctggcatacttcctgcgcaaggaagtctgtatggctaaacagtgctgaactaaacaaatactgctgaaggtcaggtgtgaacagtgaatcatattggcggggcatggtctgggatatggtggtgagcagtaaaaactacaatagctaccatgaaaggtacctactatatgccaggcactgttctagtgcttttctcctattagcccttggaagcagttctattattatcccattttgtagattaggaaacagactcagattaattcagttacccaaggggcacgtaactggtaagtggcagagctttggttcagtctcaggcgtcgagctctggagtgtgtgtgtgtgtgtgtgtgtgtgtgctttcaaccattgtgttagatgcctctcaagacagataaggtccttgctattgtagaattcacagtctaactgagtgagccagtcaaactaataagtattatatctagtctgccaggtagtaataaatgcagtgaagagaaaattgggtgaggaattttagaggatgatgggagttgatgttttagctagtgtattagtttgttcaggctgccataaacaaaataccacagattgggaggcttaaacaacagaaatttactttctcacagttttggaggctggaaatccaagagcaaggtgtcaatgtgtttggtttcttctgaggcctctgtcctcggctttgcagatggccctttcactatgtccttctgtcttccctctatgagcgttcagccctgggagctctctgtgccctgatcaccttttcttataaggacagtagccacacctaatcacctcattttaacttaaccatctctttaaaggccctgtcttcaaatacagtctcattttgaggtattaggggttaggacttcaacatataaatttggggaggggaacacagttctgaccataacactctgccctctgcacccccaaaattcatgtcctcctcacagcaaaatacattcacctgcattcaacaacctaagccttaacccattctagcatcaattctaagtcccaaatctcatctaaatatcatctacatcaaagtgagagagactcaagtatatgattcatcttgaggcaaaaattcttctccagctgtgaacccgtgaaaccagacaagttatttgcttccaaaatacaatgatggggacaggcttaggatagacatttccattccaaaagggaaaacttggaaggaagaaaaaagggtcatgggtccaaagcaagtccaaaacctagctgggcaaattatgttcaattttaaggcctgaaaataattctttttacatgatgatctgtcctccaggcccattgggctggcagaattttttttttttttttttcagtatttattgatcattcttgggtgtttctcggagtgggggatttggcagggtcataggacaatagtggagggaaggtcagcagataaacatgtgaacaagggtctctggttttcctaggcagaggaccctgctgccttccgcagtgtttgtgtccctgggtacttgagattagggagtggtgatgactcttaaggagcatgctgccttcaagcatctgtttaacaaagcacatcttgcaccgcccttaatccgtttaactctgagtggacacagcacatgtttcagagagcacggggttgggggtagggtcaccgatcaacaggatcacaaggcagaagaatttttcttagtacagaacaaaatggagtctcccatgtctacttctttctacacagacacagtaacaatctgatctctctttcttttccccacatttcccccttttctatttgacaaaaccgccatcgtcatcatggcccgttctcaatgagctgttgggtacacctcctagacggggtggcggccgggcagaggggctcctcacttcccacacggggcggccaggcagaggcgcccctcacctccctcccggatggggcgactggccgggcgggggctgccccccacctccctcccggacgggggtggctggccgggcagagaggctcctcacttcccggacggggtggctgccgggcggaggggctcctcacttcccagacggggcggctgcggggcggaggggctcctcacttctcagatggggcggccgggcagagacgctcctcacctcccagacggggtggcggtcgggcagagacgctcctcacctcccagacggggtcggggccgggcagaggcaatcctcacatccctcacatcccagacggggcggcggggcagaggcgctccccacatctcagatgatgggcggccgggcagagatgctcctcacttcctagatgggatggcagctgggaagaggcactcctcacttcccagactgggcggccgggcagaggggctcctcacatcccagatgatgggcggccaggcagagacactcctcacttcccagacagggtggcggccgggcagaggctgcaatctcggcactttgggaggccaaggcaggcggctgggaggtggaggttgtagcgagccgagatcacgtcactgcactccagcctgggcaacattgagcactgagtgagcgagactccgtctgcaatcccggcacctcgggaggccgaggcaggcagatcactcgcggtccagagctggagaccagcccagccaacacggcgaaaccccgtctccaccaaaaaatgcaaaaaccagtcaggcgtggctgcgcgtgcctgcaatcccaggcactctgcaggctgaggcaggagaatcaggcagggaggttgcagtgagccgagatggcggcagtacagtccagcctccgctgggcatcagagggagaccttgcaaagagggagacgggagagggagacggagagggggagggggaggggagggggaggggagggggagggagaggactggcagaatttcttcaaggccccaggtggcagccttgcttttgaggccttggacaatgacagcctcaccctctcacactgagacagagagagcctcaccctttgaaatggaagagagccttcctcgcccctgggcctgaacactttcgttgtggggtgagagtagtagctttagggaccattcttcctttttcttgaaggataatacatgctcacacccagagccagatagatctattgtcccatcctgtagcatctcagaagcctgctgctgttgtgtcctgtctctgtcccctttagtccaagtcagcagtgtttctgctactggtagaaccccgtctctattcctggcttctgttgagatggccaattagatctgtgagtcccactgtcactctttagggagtgattgtccagtcacactgttggtgccctctccagaacacattctcatttttttgcaatatggataagctgagaattttccagatctttaagttctggtttgtttagcctaacaattttttctttaatttctctcacttctcttgcactttaatagaagcagtaaggagaaaggaaagtggcaaggaaagcacaacaggctttcaacacttggcttagaaatctcagcagaatatccaaggttgtcacttacaagctctaccttccacaaaacacaaaaatgcaattcagcaatgttcttggccattttataacaaggattgccttttttcagtgtctaataacatgttcctcatttctgtctaaaatctcactagaatcacctttcatgtccatatttctagcaacagtctctcttagcatctgagacaacgttctgtggaacacagtttggggaagcttgccaaactcaacagattatactatatcatctccccctgaaagagaagagtgagacataagtcctctgcagtctgttccactcctactagatcttgaagtcatatgttgattcttttcatggtattgtgtgcctgtgttttaaggaaaataattagcattcttaaagcaaagcaaaaattttactaaagaaaataattagcctttcatgtcactttcttagagtgaaccaaataagttttgtatgagagaaagataggggcccgtagatgcccactttagttttgcagggtgggttcctacagccacgttcccctgggctaataaggctaatggaatcatggtggcagttttgcattggcctccagctaatgaaaagttttgccatgagaacttaacttagtccttctgatgcttttactgcctgttgacacagaaggtggaaaatgaccaactatgctatacataaaaacaaagtccagatattcttatattcttttagaatatgtcttatgtgctgatttttaaaatattaagggaaaaattgacttgtgatacttgaaagttcatagaacagggcactgcattaaaacagggcttatgcaaataaaacacatttttctgttcttggccagcagttctaccgtcaggatacttattccatacagcactgtatgatacagaccaagatttatagttggtgatttcctgagtaacaactcagatagcaaatgcctccacaaaacaactttcgtatgttctgcaaggcacaaagtagtacaatagaaaggattgtttgcttcaggatttttgtggggtggtttctttttctttttcttttttctcccacaagacagaatttttcttcttgccctaaaatttgaaagatttctcctttctctccccttctgccacaagtagtcccaccctaaaaaggaagatgaggttctctagcaacccataagatgctcataagaaatagcttaaacttttgctttgaaacaagacattcacatattggggttgtgggccaataaactagtcaatagaaagaatggggaagaagcagtgaatgcaaggacagtgttggtggggaagggggaatattctggttttcgtttctgtggatttttaggccaaatttgaacacaggctcttgatgacacatgaagtatctctaacttgattttatgtatgcacactttatgtactatctgtacataagtcatagacatatagattggactagaatttagagttcagaaatgaacactcacttgtacagtcagttaattttcaataaaggtgccaagacagttcaacaaaggtagtcttttcaactggtggtgctgggacaactgggtagccacatgcaaaagaatgaagttagactctcacctcacatcatatacagaaagtagttcaaaatggatcaaagacctaaactatgagataaaagagaagaaaacataggtataaatatataacatataaaataccaaaaatataaacaacaaaagaagaaatagataaatgagacttcatcaagataaaaacatttttgcttcagataacaccattaagaaagtgaaaagacggctcacagaatggaggaaacactttcaaatcatataccaaataagaatcttgtatactgaatatgtaaggaactcttataactcaaaagtaaaaagacaaataattcaactaaaacatgagcaatagatttgaaagacatttctccaaaagtatataaatgggctatatgcatataaaaagaagctgaatatcattagccatcagggaaatgaaaatcaaaaccataatgagatgccactttgcatccactaggatggctgtaatcaaaaagacagaagaatattggtaaggatgtgaagaaattgaaatcctcatacactgctggtgagaatgggaagtggtacagctgttttggaaaacagtctggaagtcctaaaaagatgaaacatagagttaccatatgacccagcaattctactcttgggtatatacccaagggaaatgagaacatacatcagtgcaaaaactagttcacaagtgtttacagcagtatcattcacaatagtcaaaaagttatgggggaaaataacatgtccaaaaactgatgaataaataaataaatgtgatatatccatacaatgaaacattattcaagaaaaagatatgaagtccagatacatcttacaacatagatgaaccttgaaaacatgctaagtgaaaggtcacaaaaggccacatattgtatgagtctatttatatttacatgaaatgttcagaataggcaaatctaaagacagtagattagtgtgttaggggcttgggggtaaatggagaatgactgtttatggatataaggtttctttttcggtgtaaggaagatgttctaaaattgataatgatgatggtctttcaaccctgtgaatatactacaaaccattgcattatacgtgttaagtgttgagtgtatgatgtgtggattatatctcaataaagatgttaaaccacacacagtcatattacataattacacagtcatattgaattccgttataatttcagatttatggactaacactgaatactcagagtattaagcgacctgttccagtgcatatagctggtgatcacagagccagacttcctgaacatcaggccaactgtctctccattgtgattgttacaggaagtttgaccccaacataccatacaagtcacacttaaaatttgtattggtgtggccaggtaccactcacttgttcatgtaacagatcagcaagcccctgaaaccgaggctggcaatagcagtttaattcctgctcctgtaaggttcagtagtgtaggctgggggtgaggagacacaacagctgctgctgcttttcttttttttaaccaacaagaatgaccttgaaaacatggggttctttaccacacaattattcagggaccctgtctgatggaagttcttctaccttctccagccagcagatggggaggagagagaggaggtttatccatgggaggttttcctgagccacacttaggggtggtgcacctctcacactcatttccccacaccttctgtggttacaacccagtcacttggcaccttacagatgctgtggggctacgaatgcagactctggtattgaaggagctacattgtctggggtatataccctggggtttgttgtcgcctgccaggaaaatttaggacacatacacaaggagtttaggagcagaaggttaataggtagaagagaagagagagaaacagcttcctctgtaaaggagggggtctcccagcagaaaggacctgctggtggtgaatgcctcgagtgttatagtagggtttcaagaggcagtgtctgatttacctagagctcatagattggttcaatcaggtatgacatttacatagtgcggggaaggctggtttccccaccctaatcttcttatgcaaatgggctgtccagttagggccatcttgtctgctcctttacagtacaggtggctggcagagaagggaagatggagccgccatcttgaacatgtctactccttagttcccgctggcattcacctgtgcaagctcccagcttgctggctgctctttgatagaaaatgatttggggctgcttttcattaaaaagaagaaccttaccaaggactcccatacccttgctatctgcctgcgtgatttcttcttaactcctatatccctatctgggcttgaagttttctccttatacttaaaaaatcaatccaaaggctagtcagcccgcatgatgactgggcacaagtttagaagtttcatatcatggctcctgcttcattgtgagggattttaatacctttagagcaatgttaagtacccagtctgactggttattctgtcagcagagtctgtcacctgtcctagaagaatagtcttgtttgttgctcctagactggctgatgattgataggagtttccaagttgtatcttattggaaggacctttgagagctctaggcctgtgggccttcctgaggaggtgactgcatttgaataggctctaagtttcctatatcttgcctctgccctgctacagcactacaaggggaaacctggaccatttaccctgcctgttgcaaggtaggtgacaaagaggaagttctgagagaacaaatgaagccccaggaatctactcaaccctgacagtgaatatactatcttctgacctcatactgaaacagtgacaacatctatgtctccaagccgtggaactctaccgctactctggaagcagccctgcagtgttttgttatcacttttgttttacactaggctagaggattcagtttggtgagttgtgagaaattaaaagttggaattagaggagcagaggctggcccctgtcagcttattgagctgggtagccttagccttttctgagctttggaaaacctcagatatcatgtcagaaaatcaacagaatctgagaaaaacaccggaaaatcatcagcaaatggtgattctgatagcatctcttccttatggggtcatcatgagaagattccatgataatccccataaagtatcaagtccagattttggcaaaagatcatgctcaataaacactagttgtcattgataataatagcatcatcttttgactttcaaggcagagaaaaagaggtatctccattgatgcctaatgttaaaaaaagtaacattttgtaaatctttggcaatatcttaaaatattttatgatgtaactgtgatgcttggaaaactttctttttagcagtcagaatctttcataaccatatgttaagtacttgctttgtgtaaacaggttgccaggcacaaagggattataaagagaaagaagaaatggcctttgcctttgagcagttcataatgtcataagaattagccatggctatattttaaataggttgtagctaacctaagtttttgctatcagtgttttatttatttatttatttttaattttttttgagacagagtctcactctgtcgcccaggctggagtggagtggtgcgatcttggctcactgcaacctccgcctctcagattcaagcgattctcctgcctcagcctcctgagtagctgggactgcaggtgcccattacgatgcctggctaatttttgtctttagtagagatggggtttcaccatgttggccagggtggtcttcaactcctgacctcaagtgatccgcctgcctgcgcctcccaaagcgttgggattacaggcatgagccaccatgcccggcctggtatcagtgttttaaacctactgcacatatatcctaatatagacaaaaatgtgattacctctttttaaaaacaagcccaactctaaaatatcatacttcggggagcttttatttttgcctcctgccccttgctcccaattgtcaacttatctccccctactcttgctaccaattgtcagtttacccccagcccctacccctcacacatataccccaatttccaggttgttataaagcattcatatatttttgtgtaaaaaatgatttcttgcatttttccaagataattatttgaaaatgtaattatttgaaaacagattgtgttttaatgtgaaatcacctaataccctaattagtttatttagcttagaaacttggtctagagcagtggctcttaacttggccatattttttttaaggcggcattactattgatttcttctttacaaaatttagcaagtccatggtattcttacttcagtttatttgacacaaggcccacatgagatgtgaatgatatgcatgatatgtgaaaaggaagttcatcatcatcacatcttacctgttccttgttcttccagtttcacagccgttagaatgttagagctggcaaggactttatcaccaaattcttatcaccaacacccctcctttagcagaggagagaaactgaagctcagagaggtgagggtacttgcttgcagtcacaccaccactatgtggctgactcctggtgcagaaccctcccttcaacccagtgcctctccctggctggtaatctcttgtctgtttttctttttttttttctttttgagacggagtctcgctctgtcgcccaggctggagtgcagtggcgcgatctcggctcactgcaagctccacctcctgggttcacaccattctcctgcctcagcctcccgagtagctgggactacaggcgcccgccaccacgaccggctaatttttttgtatttttattagagacggggtttcaccgtgttagccaggatgatctctatctcctgacctcgtgatccgcccgcctcagcctcccaaagtgatgggattacaggcgtgagccaccgcacctggccctctgtttttcaactcccttttctgagctgtcaccaagtcctcttactgtttcctggaactgtctttcggttgtcttccttcccgtttcttcctggctgatcccgtccctcaacatctcacaatgggaaaggcctgacagaggagtcggtctctgaggcgtccattataccatattaattttctctaattaccactgtcagcacattactcctcttcggtgaggctgccaggagctccctgcttcttgtggctacaaatgtcaacaccgtcctcacatgctagaccttccagagcctagcttcacgggaaggcccagcttcattgctcttttctccctgtgagccccagaggcccactgtcttccctgggttttcttcgtgagtcagccatgtttcttttatgcctttagtttctgttctccccagcttccggttctctccctgcctttccaactacagcaggtcctccaataatgtcgtttcattcgatgtcatttcctcataatgttgatgaagaaaaagaaggggccactgtggagttcgtgtggtctccccaggtctgcgtgggttttctctggggactcgttttcttccacgtcccaaagatgtgcatgttaggttaactgatgtggctacatagtccccactgagtgtggtgggggtttgagtgtatcctccaatgggaacgcatcttgtccagggttggtgcccacccccctacctctgagctgctgggataggttccggccacccaagaccctgacctggaataagagggtgaagaattttcttactttttttgtttttccagtcccttcattatactaaaagtttatgttaatctttcttaattgtatgtatagctcacatttatttcagtgtttaacatagaagtgttttggtctttatttagaagtttgttgatgtttttgtgaccagaaatatgcaataggaacttaattattttttagagacagagtcttgcactgttgcccaggctgtaatgctgtggcctgactacagcttactgcagcctcaaactccagggctcaagcaatccccctacctcaaccccctgagtaactgggaccacaggtgcaaaccaccatgcctggctctttttttttttttttttttaagagagccagggcctcactgtgctgcccagcctggttcaaactcctggtctcaagcaatcctcccacctcaccctcccaaagtgctggaattacaggcatgagccatagcgcccagtgtaacttgtttatagaaattagcctatggtaaaattgattttgttatacattattttgcttaaattcatagttcccaagtaggtgaggacttactgtactccattcttcaaggccaagtccaggttctaccacctttttaatgttttccttgattgctgcagtgataacccaattattcccctttactcccaaactttttctgattatatcctaccatgtagcattgcacatcatagcctctcatatggttctctggcttttccttagaattgtgttgccttcttaattatatttaatgctctttgaaggcaaggcttatgtttatatttttatcatatatactattcccctcccatccgttggaaatatgttcaaagaccctcagtcgatgcctgagactgaagatagcaccaaaccttgaatagactgtttttgcatatagatacatacctatgctcaggtttaatttataaactaggaatagaaagagattaacaacagtaactaataataaaacagaacaattataacaatatactatgataaaagttctgtgaatgtggactctgcctctgtctcaaaatatcttattgtactgcacttacccttcttgtgatgaggaagggatgggagtgggatagcatgagatttcatcacactactcagaacgatatgcaattaaaaactcatgaattttgtattcctggaactttccatttaatattttcagactagttgacctcaagtaactaaaactgcagaaagtgaaaccttggataaggggggtctactggattccaattttatagtgcctaataaatggtcagtaataaccacttattaggggcttgttgaacttctacaagttgttgttcagagctacaagcagttcagacatattacagtgttggcaacttgggttgggatcagttgttaatattggggcacggtgctctactgtttaagtgttggcaggatcagtggctactgtgttaatgatcctctagggagactgtctatatagatatggtgctcacgctaatagttggatttgtagatcagtagctgggtggcagggaggctgggggctccctgctgagaactgcacaccgggttcttgaatcttgcagtaggtaatagttacttgagaaaggagtatcctcatgactctggcagatcctcagcacaccattgtgacatgtgaactggcctgtctcctctcccactgtaagtccttgagccagtaatgaccttggtgttctcttttctacaatactggcacaacatcttaaggtttaatctgatctttgtctaaaatatttttttcagaacccattaagtacggtgtcttcccaaaaaagataagtgtgttgtcataagttcctggtattggaaaaaggagtctgtgttatttaaagaagccttgtctgcttccttaattccaatgccccttttccatgccttcctacctttcctggtagtcattcctggactgaggtaactgcagattttatagtacttgggactatgcactccctaaggcacagaccgtataagaattgcctctgccaagggctcctaaacttggaattattttttctttaatgtcagcaggactaattccacctatacaaaatggtttggccttttccttctttggcacaaaagagacttggcagaggctcagataaaggtgaagttgacgagctctggcatgggagtgagctcagcgcttctgggctttcattccccctgttcgtctcatgttcaaaatccccattccacccagaaagtcttcccttcccaccagtgacaccgaaagatgtttcagatccttcttcctttgtctccaacacacacagcgaaatgctgcatgccttcatttgcagaaagttacccaactggaatcactttaatattttttttttaatctctttaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataaggtaaccaagatctaattggttttggcttccagctaaaagtgaaagtttggtatttcatatcctctcccttcttttactcttagtgtttctgtaaggatttggggggctgggggatgtctttggagcctgttaatagcattcctgaggcagcagcagttttaaaaagcaaagtgtttctatttctggtctgacactaagagacctctgacttatggggcttcccaatgcctcccccaattattccttcagggaagtcactcttgactttattagtgccagtaaaggtaaaagtgggggcatgctaccactccttttttcacttgaacttgtggccctaaagagttagggccaatgtgataaaacaagtaggaaggtcgaatgatcagccaagaattcttttccatttcatgtttaaagcaagatacgactaaccactttgtgtacaactagttttaagaattgtttcagggctaatttgggaagcattagaaaataaaaagctattgtagcccttttagaaacatcacaacagctgagtgtggtagctcttgcccataatcccaacacttttggaggccaaggtaggaggattgcttgagcccaggagttcaaggctgcagtgagctatgatcacaccactgccctccagcctgggtgacagagtgagaccctgtctctaagataataatagcaagaagaagaaagatcaacaataaaaaccgcactgttatttaaatttagaaggaggagggagaagaaaacaaaattaaaataaacatcaattttatagtaataaaaatcccgattttttagagatacatatcaaagtatttacagatgaagtgatagatctaggatttgtttcaaaataattgaggggaaggtagacagatgataaaaagctggccatgagttcataactgttgagttgaatgatgggtacataggagttcattatactattctgtctacttttttacatttgaaattatatattcagaaggaaaaggaaaaagcaaacgccaacctaaaaggctcctccattagcaatgtatcttcaaaacagattttttaaatgtctggtgttctattctgcaatatgtgacctcttgtctgctgcaggtcaaggtttctaaagcttctttgaaacttgatctttatttttttaatgcattcagttctttatatcaatattttttatctgcagattttccagtattctgaacagttatttctcttacagctgtagggaatatgttgcatatagttggaaaaggaatgatttcccatttattgcatgattcatagtacccttcacttctttaggcaaaatatattctttaaatatgtatattaaatacagatagaatgtttgaataatcttcaaggttaacagtagacaagattacttgtcaaatttattttgagtctgtttttctagtctggtcaaaaaggtcactgagcaaaagtttttgccttgaataatgttataaataaaaatgtttacatttattaaagtaaatttgtgttcatgaagtttcactccagagttccagctcattataatcttccacaagactttaataaaacaatcatttagccggctaaaattgaagtttagaaaaattttttgagaaatgtttttagaaattcagagaagcccagaaaaagaccatctgtatcctctctccacaaaataaatattagtccacattttagactacagcttgtctttttttcattgcttttattttggttataatcaagatctaggtctgtcagtaccaacacgtatgtagatttgatgatagagttaaagcgtagttggggtaggctccagctccactgaaagggaattacagattttcttttggctttcatgaactgtgagaatcaggctgggaagacgggcccttcatggaagtgagcctcagagcagtatgtgtgctagttcttttctcttcctggaatgttgtataccttgaatataggagtgtccttcctgaccagctcagggccctcatggcagttgcctcatggcaacttaaacaggtaccttctcctcctggcatcagatatcctattatttaaatgaatagcaacttctctttaggatggggacaggggaaataatattcgcaatttctggttatggaataaaatacttgcggggcgtaggcaggtgatgacatacatccccaagtgaaacatcacaagagggaggccacccctgccccatcagatccctggaaggccgggtggcacagaggtgatgctgggagaggagcaggaaggagggaggtgcagcaggagggagatcgtggccagctgtggcgtgggagcccatccttgctgagctaaaagaaaaaaacataagacaaatggaaaggacccctctgtggattgactacagaaaagaggtttgtttttttctttattaaatccctgaaagtgcctagtgttcttgatggaaactttgagtgatttgccatgtaatcataaaatcttattttagcgccttttcatctctcatacgaaaatgaaaggagataaatattagcaaatagataatgcaacttcctgatcttgtgttcttcaggactgaagcatgtcacatagccctttgcaaggagagctaaatcatgggactaaggcaaagatgttgaagcacgagggaacgctcaataacccagccccagcccctcgtgccatctggaaaccatgaattcagtgaactcgggctctcgctgcagggtctgcctagactgcagccataaaatatgtcagccttggcactggcagctttgatggccatcagttaggcagacaggagcttttgtgctacccccttctctttgtcagcttatgtacaaccctagttcctcattaatttagggttggaaagatgtcctgagtattagagttcaactttccagttataagtattttttccatggccacctccgccctccacaccaggtctgagttacatgcccacgccatgtgcactgcagctcctgacacagtctctcttgcacatgccatagtgtattgtaaagtgggcaggcaccgtatgtgcctctatgccccatccccagcaaatggggcagggtcttatccacagtaggaacttggggaatagctgttggatgaaggaatgaatgacaatagtttcacataagccaaaggattccattccttttcttaccttctgtgctttatttggtacatactcagtatgctgagtgtgatactcttcctctaagaacggtgctcaagcctcctgcagaaccacctaatgggtgtgtgtaaaaattggattcctgggtcccaccccagactactgagtcaggcagcatctcttgacccaggaagcggtactcttaataaatcacctgcaggtgattcttttcttctgcactttgagttgagaaccactgctctaacaggtgaataaacattaatataacaaattgcaatacagttgtagggaaggaagataaaggtatgccacgatagaaatacatatagggtagaattcattcatccatgcaacacttatgaagacccattgcatgtcaggcactattctaggcactaatggcagaatagtgagccaagcagacaagggcctggtttcatggtggcggggaggcagactaagtgaatttatagctgtgaattgtgataagtgtctgaaggaagacacgaaagccagtgttatgggtagatagcaacggccaggagatgggcttctcagaggaggagtttactctgaggatggaagagtgagaagaaagtcacctgtgtgcagtcaagggtgggcactgggaagaactgtccaaagagagggagctcatttgtgagagacttgccacaaggaggaaaagagcttgtccgtagcagagtggttgaaagggacagtggtggaagatgaggccaggaagagcagagatgagattgcacagccatgcaggccccatggagcacctgagatttcatgctatgttgaggggacagcaatcagaagccttgtgatgccatatggtgcagtttgcgcttcagaaacatcagttgctgctatacagagaacaaaccagaaggaggataagaggggagacagagtccagtgaggggataactcagtccaggtggcagtgacctgcacagacaagaagtgaactgcttcaagagggaaaaccaagggtggatcctgaaaaggaaatagaaatggatggagggccatgagaagacagctgggtggacagtgggagatgaccaaggaggagggagcagtcccgtccattctaaatggggtgtttggtggtgaagggccaggaaggtttccatggtggggacttgagagattagagagtggtcccaagcagactggggcaggcaggagaaagaggaatggacagaagggccttccttggagaggtttcagtctgacaaggttcaaagatgaatagtactctgaacagcaccttgataattgtaggtttataataaattcttgtcaaataggtaggtgtgccttagatagggaaggcatgcacacagtggttagcagtgtgaactgtagaatcaaaatacttcagcgtctagcttcgccattaactttggctctctgagcctcagtttcctcacctgtgaagtgggaatacagattgaatatccctaatccaaaaatccaaggtgttccaaaattcaaaactttttgaagaccgacatgacactcaaaggaaatgttccttggagcatttcggatttcggattttgggattagggatgcttagtcagtatgtctgatgcaaatattccagaatttgtaaaaatcagaaactcgaaacgcttctaatgccaaacatttcagataacagatcctcaatgtaataacaacagtatctgcctttgtggagatattgtgaggcacaaaatgatccatgcagggcacttggcatggtgcctgacagacatgagcatctagtgaatattggaggcagtgcttgttctaaggtacttgagcagtaaaatgagtataatatttggacttgaagtccaaatattatgggattctgcaagggagtcttaaccttgagcctaacaagttaggtcaactcaagcatcttacttatttgtgccatcagtttcctcatctgtaaaataagcaaatttggataatgttatttgtttctaaactacctcctggttttaaaatgctctaattccaatatgtagaatgttagcatccaatgatgacaatgtaattcctcatctatgcagtttaaactagatgaaccatgtttgctggtgtaatagctcagcagtggaaaaacagcatatacttcctggtctaatacctgaaagaaattaggtgtatggataacagcaacccttggctaaatctgactgtagacatgtcacctcatctaatagtaatatacaggactggagcgggaagaaaagacttgttaaagatgattatagtggactgggattatttcaagcctaattagaagaccattttcattctaagtgaagcaaactcagtatgttgacaatgttattgctgcaattcactaacgaaagtgtgctaacatgaatcacaggattctgaagtcagcattctcaggtagtttaaaaggatgaaggatttgaaatctgtcatttcatttgttgcagaaatatgaccaagataaccacccttttcttcagtgcctcttaacatgaagcactgaaattttttctgaccttaaaggtaaacgaaagttccaagcctaatcttgtattgtaataattataatagctaatatttactgcattcttaggtgcactttgcaactaaataccttccatatattctcagattaatctctgcaactcaaagaagcattttgtggctcaggaaccaaggttcagagagatttctatctttcctgagattactttgctaacaagaccactaaacacatgggtgtctttgttacataatttgggattgttggagcccaccagttttggacaccagaagccctctgtggtcaaacaagattaggtttatttaacttgttgggcaagaaaagtgcatacccatattgccacagtgaagagaaatgagtagatttgggcttgtgctgggtggttctagtagggatttagggaagcaagaacccattttcttttgggtgtcatcagaaagtgggatcaatttggtgtcttggtaatttttatctaagaggtgggaagattgaatagggacttagattgtcatcagtaaagaaagcagagtacctcatattagttggaagagggggacattatttattttgtggcacagagggttctcatacctgtcttggttcagacttgattgtggattgtttctatcttgttcttccatggtcacagagtggccttgtctgaaaattatttgcataagcaaatttttgctgagttataaacactcaaacagtatagcctgacctgtcaactctctgggctctgtttattccttttccttcttcccttccttcaactctcccttcctctatctagttcattagtagttaatttttgccttccaaagaataatcaaacaatctaggtccttcattcttctctgatagagtgttagcatagggaaggttttcagatccggagagatgtagtcttgaatcctaggtcagtcagttgacaactacttgactttaggcaaatcacatcatctttttggtctatctttccatatctttaaaaaatagaaatttattccattgtgtgaatgcaccagagtttatttaatcttattcacccactaaaggacatttccattattcccagtttgagtctattaaaataaagctgttatgaacactgcaaaaaaaaaaataggaatgataattacctttcagggtgttttgaaaattagggttaatttacatgaagtgattggaacacatggttcaatcacgaatagtggccaccattgagaaggcataaacatttgtcaaatgttaatttgcttatactttatatttctaacagcaatgaaaatactttttatacaacaaattattagattgtagaaggtaacagaaggtggggagagccaaactttctgaatgtgattatctactactgaatgttagttatatggtaaaacttgctatagttattgttttgtacatttattaaaaattacaataaatagataacatggtgctatgcatttaattagtgaaaagcacaagatcattttaaagttcttaatggttcattcctgataaatttttatgagatacaggcaagaatgctatacttacaggctgtgcagaaggaatgactatctgatgagggctataaagaagaaatggaagatacacaaaagctatttttattgtaggggtagaaaaagatcttgttaaatatttctgctgaaggtttgtttcttatatacaaggccaagatcagggttaaattagaagaatcaatactaaagttagttctgaattgtgggatggtttttgttttcatctttgtattttgctatattttcctattttccaggttttctgcagaaatattctattcatgattagaacaaaaaaaaatgtagtcttctaaaaatcctgtctttttctgaagttgctaggcctctcagccatggttgccaaaatctggacaccatgcatgtgtgtgtatgtgcgtacacacccacgcctgtgtacatgtgtctcataaaacatccttaagcatgagctagacattaaacagtcttggagattctagttcagaatttacctcaaacgtgtgaattatggaaattcatggttcatcacagatggttgggatgttgccaagatacatcctttagcacgcctctgtttgctttatgtgaacattaataactctgttccaggagaaatacaattgaaaagcatcctgtacatgaaaaaagttattgcaaatgactcactttttgtgtggttccttctctccctttttccctcctatcgtcactttagaagtctggccttcattttcgacacacagataataccgtccagtggttaagagcgatggagtctattggtctacccaaggtaagccttcacgcactggaatctgaactagaaaggcaaaggggtagtacacaaacatctctttatgagcaatgactttggagactgggttatgttaatgtagaaatgagaaatgtgaggactaaaaaacatggaaagacctatccaaagtaacatatggcaagaactcagaatgagggatgtgcccagattgagagcagccaggtaaaattgtgcacaaaataaaggcagaacaagctatagctggtagataggtgagctatctaaaatagccaactccctttcttgtgttgctatttgtacataaagattctaagtctcagccacttttggtggctcatgcctataatcccagcactttgggaggctaaggtgagagaatcacttgaggccaggagtttgagaccagcctgggcaacatggcaagaccctgtctctattaaaaaaaaaaaaaaaaagaaatctcattgtattagtatacactttattactgtaaattattataaatttattttttgtaaattattgttattattatttcaagacagagtctggctctgtcgcccagtctggagtacagtggcttaatctaccacctccgcctcccatgttcaagtgattctcctatctctgcctcccaagtagctgggaacacaggcaagtagctgccccatgcccagctaatttttgtttttgtttttgtttttgtagagacagggttttgcctcgtcggccaggctggtctcagtctcctgagcccaagcaatctgtccaccacggcatcccaaaagtgctgggattacagggatgagctaccatgcccggcgtataaattatcattataaatcataatatcacttgtaaaggctagtgggttatagctcttactcctaaaatagatctcctaaatataatttaactcagcaaacattcagtgcttgttaaatttgaagagcaggcatcctaaagtctgtgagagaattaggcaagtggaggaaatgaggaaataattacatttgataaaaattgtagaactatttttttaaacttgttattttgaaataattatagaatcacaggaagttgtaaaaatagtacttctatgtttatccttcattcagctttcccctagtggtgacatctaactgcagtacatgttaaattgacattggtgtattagtgtaaactagactacagacctttttccattttcaccatttcatatgcatttatttgtgtaagtgggcatgtgtgtgcatgtatgtgtgattctgtgcagttttatcccatgaatagatctgtgtaaccaccaccacaatcaagacacagacacacagaagagtggtccttctgattgcatccctcccccagccctgttccctggcaaccactaatatgttctcgatctctatagttttggcattttgagcacaatatataagtgtaatcatatagcgggtatcctttgagtcacatcgtttccactctgtatatggtccttgagacccatctgggtcaatagcttgctcctatgtgttgcttagtatgtacagctattttttttttttttttttgagacagagtcttgctctgtcacccaagctcgggtgcattggcacaatctcggctcactgcaacctccgcctcccaggttcaagtgattctcggggttatcacttacaggcatgcaccaccacgcctggctaatgttggccaggctggttttgaactcctgacctcaggtgatctgcccacctcagcctcccaaagttctgggattacaggcgtgagccactgcacctggcctgaaatctgtttcttatcaggctgttagtttcaagtttaagaaaaagagtaagaaatagtatgtaggataaccccccgagttatcaagtgtaacctcccgagtagctggggttacaggtgggcaccaccacacctggctattttttgtatttttagtagagacagggtttccacatgttggccaggctggtctcgaactcctgacttcaggaaatctgcccgtctcagcctcccaaagtgctgggattacaggcatgagccaccatgcctggcctgtacagctatttttaaaaaattatttaggagtggtctcgctggaggtcaagaggataagctactggcttatgaagacctctgttgtgccaggtgtgcagtgaaaaacacccactgccacagaaacagaagattctttaaatgtaatttattaatgcccatttttaatataattgtgctcatatctgttttaggtcagtctcattttatcttgaaatgatcagtgtttaaattttgttctgccatttttaatcaaactattttctcttctcctaaaatgcccagaacgttaaatgctgtttccttctaggaactggctgtaatacataattcatatttctggattgtgatttagcaactactaactagaggctggatgataaaccgattaataaaaaacgaatttaaacagaattgttttgtataaggcaacatcaaattcagataatttcattggatttgatagatttgatgtaaaccttttcaaattgtatgtatttagggccaaacaagtggtgttatagagcagattttattttaacattggtttttattatgaagtcattgatatattgcattgcaggggcaagagactgtactgagttgactttgatgtatcatatttaacttgtattccttcatttatcaatattaagtgcttactctgtgctcagtatcatgctaggtgccagaaatacaatgctgcataaaacattctggtgaatgataaattgatctcatctccttgctgaaggaagtcatttataatggctttccaggagaaatataaatataaaagattcttgtttaaagaaaagggaagaggcaattgtagttattctctgcttacataaaaaactttaaaccggtaatactcttttttgttgttttttgagacggagtctcgctctgtcgcccaggctggactgcagtggtgccatctcggctcactgcaatcttcgcctcctgggttcaagtgattctcctgcctcagccacccaagtagctgggactataggtgtgctccaccatgcccagctatttttttttttttttttttaatttttagtagaggcgaggtttcaccatgttggtcaggctggtcttgaactcctgacctcacgtgatctacctgcctctgccttccaaagcaccaccatgcccagctaatactcttctgaatttagggatcctcttctcattgatactttagtagcaaatgcattaaaggaaagttggaaaggctttttaaatttcttaggctactgccatttctttaagtacttagtaattatatattttgtagctcaagaaactttgcttctttcttttctcagcttttctcagtgaccaataggaaattgcacttgagtatcacgtactaccatatgatgcattattttagtttttgatgtcagtttttataaaatatttacttaaagtaaataatgtctaaatgattatcttaattttaaaagcctcaagcttaattattttttgtgtgtgcttaggaacagagaagtttggtgcctcactctgaaatctgtttcttttgttgatttgtttgttcgtttgttttgttttgagatgaagttctgttcttgtcacccaggctggaatgcagtggcacgtgcttggcttactgcaacctccacttcctgggttcaagcaattctcctgcctcagcctcccaagtagctgggattacaggcatgcaccaccacgcctggctaatgttggccaggctggttttgaactcctgacctcaggtgatcgcctgcctcagcctcccaaagtgttgggattatgggcgtgagccactgcacctggcctgaaatctgtttcttatcaggctattagtttcaagtttaagaaaaagagtaagaaatagtatgtaggataacctcccgtgacacacatttacctatgtaacaaaccttcacatgtaccccaaacctaaaataaaacatgttagaaaaaggaaaagagtgtgaaggtgtattcaaaactttgatgttcagacctttcagtctagtaatttcatatttagatgattatccaaaataatcagatgctcagaaaatacagaaatattcattgcagtggcttataatagggaaaaattagaagcaaaacaaatgttcaaccatggattaactggctaagctagggttcaaaaatataaacgaatcatatacatctattaaaaataatcttatagtataatgaaggggatgggaaataattgtgttctgtaaagtgttttaaacaggttacactaagtacaattttgttttcacatgcacacatatatataaacctaaaaaaatcagagacatacagaaaaaaagaccagaagaaaaatagggacaaaattgctaatagtgacaatctgggaggtggggtcatagatgtttttccttcataccttatatactttccagattttatttggtgaaaatgtcttactttaaacagattttttaaatgtgtgtgtgtgtgtgttgtatatgcatgtatacatgtgtacagagcacatatgccaagtttttaacaatgcaataaagtggctaataacaaggacacccttctcaggcccatgggacctctgggaagtcacaggagtgtgaaggctacaggaggcagagcccacatgtgctcatatgccctatgaaatgaaacactgccactagcactgtggacacagccttcttggagtagctggctggggaccccaccatcctcctgtggaccactaagaggcatgctgtcaggcaggggtccagatatggtgattggtctatctctacagcaagatgaagcaatggcagagaggttcctctatatttaaataattataggatagcaaggacaatcaaaatagggtcattttgggaagttaaaatacttgtgagaagcaaaacatataataaatattgtttcttttgttttccagatattttatccagaaacaacagatgtctatgatcggaaaaacataccaagaatgatatattgcattcacgcactgaggtagggggaaaatgcagctaaaaggtgctctaagaagtagatttaaataaaactaaaatttcaattttaaaagaggttttaagttactttaatagtttgaagaactttttattaaattccattgttttggatttgctggtacaaaattaaaataatggtcacatataagcaattcttgaacttgaaaaatgtttttctgatttttaaatctaactcaaaatagaaaaccagaaaatgattgaaaaccattaagtacaataaagagaaaatttaggttgaaacttctagaaatccaattgtaatgtactactatattcttgagttatgacctagtttacaaatataatgcagatatatcaaatgagcaactttaatagtcataattttggtttaatgagttaaaattataatttagttcaattcttacaaattaagaaaatagaggtaagaatggtttcttttgatcttctgttcaatagaatttgtaccctaaggataaagaagaaacatagtagtttggtgtaaattagtcaaatcaagacacattcattattttaaagcaattgttcaataacttaatttttgaaaatgctgaaattctgctagttcacagattacattttatcttattggcctggaagaaatgtgatttttagatggtaacaaagattattctaaaaatccagtttgtggctgttgtcttgaatgtacacaggtaatggttttggaagacttcatgtctgattaaattttaaattacttttagaacatctgccttgtgttttcatcactagaagtcattttcctggcagagtactctgcctagaggtttatgttgacttcttcctggctcttttcctctccaaaggaaaatgcttctacaataattcatggtggtgttggctttctagagaagaaatttgattatgtcatataatttgactttttcccccagtcagtacttatgggattgctttggaagatgacagttgctagaaatatagaccaagtgtaggtgcctttgctatgatttttttttattctagtaacttagaacaactggttaaaaaaagaaaaacagcaacagtaaaaacaaacctacttcatgctgccttctcagatgtggcgagagtatcattatgccacaggttttctaaaagctccttgtgcaaaagtgcttatgttgaggaatattttcaacttgtgttgcctgatattctttattaaatatttttctgatcttagaatgataacactatagttagtactgggtctatgagctgctaagccagccacgactagttaatgccattgctacatgtgtgcatcacagtgctaatctctagttctgtcgcatgctcgtgggctgtctcgtataagtttcaattgattttctgaaatagacaactgggacattcatgttaaggagcttataaacaaatggtatgctaagttcctttctggtgatatcatggttctcctaaaggagctatctagagctgcacttagacttacatgtgtatttgccatggttttaacaatggcttgaatagcttggtaaacaaagaaaaaacaactttttgtttattattaccaattgtatacaaatattgatgtgatattttccaggactgtgtttttcagttattcatcatagacatctccattacttttactcatcctggaggggattcctgttgggtcatgtcattcaccagatctgatcttaagtaggatattttatcttcaaaagcaatatttatttagtaaatagcattctcctcgcttttctttgttctaaattattgtatagctgcctctcactatggagccgagaagtcccaagtgtatcttgcagctttttccaccaaaacttgttcctgctatgatttaaaatgcagtcagtcactcaaaggaggctgatattctgctttgttgtgcaagacacatttgaaagctgaggaacaatcctctaataaatacagtgggtttgataaatactcttgctgcatagttagaaatgatgatggaaatgaactaacatgtcttcagcttttatatcctggctgcaaatacagcactgctgctgtatttgagagttgttattacctggtagagtaattaggcaggtcagagattctgattataactcagaagccagcaaggaagtttccctaggaagttaagcttgccaggcgctgccttcttcctgccccagcctgtgggcctgacttgatctaaaaagttagctcttagccctgaccaaacttgtctcctattccctgtcatcttgatttgggcttaacaacctaacttctgggtgcttatgcttgcttcctgtttgtatctgtgttcccctttgctgcctgcccctcaccttatcattttatttctgatcccagtctcgtgtcctaccactcaccaatccctgtgtcagtttagcttggtgttctcaagccagactccatgaacattaccacagcagcaaagggaggaaattctcaagcttcacctaatgtagacagactcaccttagcggtggatggcatcttttttttttttgagatggagtctcactctgtcaccaggctagagtgcagtggtgcaatctcagctcactgcaacctccaccttccgggttcaggtgattctcctgcctcagcctcctgagtagctgggactacaggcacgcactactatgcccagctaattttttgtatttttagtagagacggggtttcaccatgttggccaggatggtcttgatctcttgacctcgtgatctgcctgcctcagcttcccagtgtgctgggattacaggcatcagccaccacgcccggccacatcattctttttctaaagaaatgtttgtctttttctcattttttcaaaagtaatgtatgctcattgtggaaaaaattggaaaatccaggaagaatgttaaagaaaaagctaaaatacccactatctcaacaccaagtaaaaaccactgtaactattttgatatctttgaacttaaagtgtatactgcgtatggcatgttttacttttgtggcttcttttggaatgttataaagcctctgccttgaaaaggaaccagtttaagagtgagagccttactaactagttactatactaatttttaaaaaatatctggaggccttttacgtaagggtaagaacacttttttgacatgttgtttagtgcccaccttattaaagatgtataataaatgatattaaacaactgttacttgtttaaacagtcataaaagtgagttccttgaaagagttggaataatttagtagaaatgatgttttgagtacttcagataccttaaagagcaggtgaaatgcccaggtacgttattacaaacttactacactggaacctattctgtaagacccatactacaagtttcactcattttgtttattatttataactagttttgagttgtccttggctattatattattttgatacctacccagaattgacataatcttcgtggcaccagaaacaaaagaataccctttcaaacctgccatgattacagatctgggtttcggatggatcacttgtgagtcagaacatggcgcaactttgggttcttctcccatggcgagtcagaccctggccacaggcatcaggctaaactttctttgtttaaaaaaaaaaaaaaaaaatcagaccgcatttaagtacccggctttcaggtaggtctttatttacaatctggtccccacccctgccccccttccccattaccctgaaataatttactttcttaagtctcacttgaccagcattgtataatccattgtcctgtcataatgatgtattggcctgatccattaacattattaaaagcttatgtatgccttttaaatattttttttttaattagttgggctttctagaggttttcatcccctgggagacaagggattgactgtacccagtgatccttaggcttttgggctgatttatcatctcagatcatgtttctagtcctgcctccacttagttagtggatgtgaccaccagtgctggaccctctttctacccggtgtttctgtcaccacctatgctccttggttcttccttatcttggggcacttcctttgttttctgggactatttagtttactcaaagttcttggtctttattctttcatgtagtataaatagtataaaaatatctatatataaacaaatataggccaggtgttgtggctcatgcctgtaatcccagcactttgggaggctgaggcaggcagatcatgtgaggtcaggagtttaagatcagcctggccatgatggtgaaacctcatctctaccaaaaatacaaaaattagccaggtgtggtggcaggtgcctataatcacagctactcgggaggctgaggcaggagaatcgcttgaacctgggaggcggaggttgcagtgagctgagactgtgccactgcactctagcctgggcaacagagggagactccatctcaattaaaagaaaaaaaaaaaagcatggtggcacacgcctgtagtcccagctactcgggaggctgaggcaggagaatagacccaggaggcggagatcacaataagccaagatcgcgccactgcactccagcctgggcaacagagcgagactccgtctcaaagaacaaaacaaaacaaaacaaaacaaacaaacaaaaaacagatatagaagaaacaaagtacttgtgttttaataatgctccccaacttgttaaagtcaatataaatacacattcgctatttatctcttttttttattacaacttcctttttggacactgtatattattctcttgattattgttttgaacctgtggcctttctcagacttaaccaagattaatatctctttctttttgatgaaccagattgtttcagcttggtcagtctgagctctttctggcccacttccttgtccttctagcaccgtccctgacattctttgaaatatccttgctcgtggtcacaacaggatgttccagtcctatcctgattatttctgctttgagatgtggaaccaccactctctagggattcctcttaaaagtcatgtgtttatattaatttttcaagtttaaccttattagcttactggattctgcttttcttgctgtctagttcatttgaccattgagattcttctacatgggcagccacaaacggaagctatgtctgcctctcctctgtgataggattactcttcccgctgctgatactgtagctgtgtcgcagcagccatgttttcaggtgcaatggtgatgccatggctctggcagacccacttctggttcaccagccgtccaggtactctgggagctttgtggagtagagtttgtctagccagctcccacacagccaggtggctgtcttgcttaccaggtggcctttgaacctgctcctcaggcattaatgcataactttccttgtcttaacactctgttcccttagaaccttttccttccctaagaaactgattgaacccttatatcagattgattatatctctaacagtgaacatatttgcatttataaataagatttccaaagacagtttcttagctcaaaggacaggctctaatcctaggttctcagaagggatatctggagatggcagtatttggaagtaaggtgagggaggcagttgcacctgcttatttctttcaagtccttccttgctcagaattctctctgtgctctgaaccattcctttccctttcctcctctttctgtcctaaattagtatggtggttatgcctttctgtcttcctaaattctgagctcttaagagactatgaaccacatcttgttacttcatacagcttacgtgctattgattccaagttaaagtctctggagtttgtatatttaactcttcaggaggtttaattgaactaatttctctatgataaggctacctcaggattcctttggtttggggctgaaaattaggtatagaaccctggattttgatatgatattggcagtgatatatgtgactaagatggaaaaatttggttcagtaaataaaactatttcaaacatggagtctgtggtgaaatagagattcttggcattggaaaaagtaagaaaaccactttgataggttatcaataagtgtttgtatacaaaggacacatttatttaacaaagaatagtaagaacaaaggttaacacaaatggagcttttaactatgtgcctggcactgcacaaaatactgtactggtataatctcattttatcttcataacatatctgtgcagtggtcactattattactcccattttatcaccaaggcagttgaggcacagagaggctgccgaaggtcacacagttagtaaaaaccaggatatgtgagaactgaacctgtgctattatgaattcagccagccaatggcttcaaaagaagtcaattatttccctacttctaagaaaattaaaagaacactggtatcagacttgaacttcagcacaggcctctcagctattatatttaacatgttttaaatgaagaatcatggaacttgagaaggggaagggccttgggaagttattgtagtctaagtcattcatttcacagataagggaactgaaagcttgggttacgtgacttgctcttagtcacacactgaggttttaccagttttgggaccaggattcagcgcttctggattctagtcctgtggtctttctgctctaccatgaggctttgatatacaaacattcattccacatgttatagtacaaaatgagctacacataatgtgatccaagaaagctgaaataaatttagctcctgccttttaagtttgcatttcattacgatagtaccttttagtgtatatcctgaaagtatagaaaaaactaataccactagttttatcttgaaagtggtagaaaaaactaatgccatgtgatattggcagtaatgtatgtgactaagatggaaaaatttggttcagtagataacaactactactactactactactatatactactttcatgatatacactaaatggtattttttaaaactttctttattgcttcctggactttaagtgatattatttgtacaagtaggagcacatgggtcaatgagtcggtagctacctctgggcaacccctccgttgctggcctcactcagctgcacaggtgtgctgtagcttttggtgtggtaggaggcttgctacctcacaaaaagtgctctcttagacatgagaagcaaaggtgacattaattccatgacttcctttggaatgctctcagccctttgacttggctgttaggtaccaaacggtgcttaataaattaactgttgaagagctacatgagattggcactttttctattcgatgggcttttttgttttttagattaagacttgatttcctatatacttcaggtaataagcagcctcatttgaatttaaatgcttgggaaggaagtttgctattgctgtttcttttcagcatgggaatactgggtaaacacagtttcctgataaacatttgcccgtttgagtaatcagctgggaagcacctcccacacagagattaggtgtaaaacgcccataccatgaaaagtgatctttccaaagctaacagtttaaacctcaacatcaatgatttaaaaaaaaagaaaaaaagttgaaaattgaggccaaacagaaactatacaatattttttttaattttttagtaaatgagattttttgatatatgcaaatgagatctttacctgatcaatattagcttaagaaaatatcagacttaaatttaaaagcaaagattcttccatgttcagaaagctaacttctcagcaccaccttgtggtaacttttacttaagccaggatgtttgtttattgtaagatttatattaatattacattgtacaatggagaaattaaaaatgtaattggaaatagctatctaacttctttatcatcaaaggggaaaattaacagtttagtataaacattttacttcatgttatcatcaaacctatattttgtggtagcctaagtaccttaatttagggatagcatggtagagaaaattttttttttttttgagacacagagtcttgctctgttgcccaggatggagtgcagtggcacaatcgtggctcactgcaacgtctgtctccctggttcaagcaattctcctgcctcagcctccctagtagctgggattacaggcgtgtgccaccgtgcccagataatttttgtatttttagtagagatggggtttcaccatgttgaccaggctggtctcgaactcctgacctcaaatgatcgcctgccttggcctcccaaagtgctgggattacagacgtgagccactgtgcccagccgagaaaaatatttttatataggagctgttccataaatagtaattaaatgaatgaatggataaacagagcataatgtgaaaacagttgcatcaagatcattgagcacagctgtcttatcccctttccaaaactaacatgaaattaactacagtaataacttttaaaaaatacatttgcgataaaaatgccatctactaaccagaaatttgaacaacccctaacatgaagtaaacagacagaattcgattgactgagaaacaaactgggagaagatcacagcccacaaaacgctgggggttgcagcagaggtaggagctgtcgtgaggtttgctccaagcaaaggggacagcaaggaaaagaagagcctcaaagtgagcaatcgtcagcctaggaccagcagaactatatggcccttccctaaagcagcaagtgtagatgctgatagcgggatagcatgccggtacccaagacagctaatgacctcaagaaggaacagagagtccccagtctgagaaggaaagacactggttcccttctggcgtccgttccattgctctctacagcttcttaatgctggctcctgacatgcggatctgcagtgaatgaccaacaaacagcaagtctcaaacactaagatgagtcccagatcagaagatgtcagacatttgaaggaaactgccactgaaggaagcattagattcaccaaacagaaccaagacccaaggaacaaatgaaaatattaaaatatgtgcaattgatgattcattcaatttatgttcaacaaatatttattgagcacttacatttatacacagaagaaccaaagataaaactctaagaaggaaaatttggtatagataaaatcagaaaaacagttaataaaatttgtagatatctaaattattggtggatataattaaaaaagcatgaatctaaaattctaaattatctcaatattccacaggtgggaaagttagaggtggaagcatctaaggataatagataccaattagtttaggctttgatagaaaaatgtaaaagtatattaaaacttcagcaggatattagtataggtaatatatattaaagatgcagcacattaagtacttgaaataagtataaaatttgttgcttgaagacattttatggatgtctgcttacattttactgtataacattttctaaatttcactttttttatagttttctttgtaaattaggtatatttttgaatttgtaaaaagaggaggaaagtgcaaatcaggtagtatgaaagaaattgaagtgatacaattatacatttttgattatttgttcatctattctcatttctttttttctttttttctttttttttttgaggtggactttcactcttgctgcccaggctggaatgcaatggtgcaaattcagctcaccacaaacctccacctcctgggttcaagcgattctcctgcctcagcctcccgagtagttggggttacaggcatgtgccaccatgcccagctaattttgtatttttagtagagacagggtttctccatgttggtcaggctggtcttgagctctcaacctcaggtgatttgcctgcctcggcctcccaaagtgctaggattacagtcgtgagccaccgcccccagctatgtattctcatttcttaaatgatggcttgatctccattcaccccccaaattcttttgcagtttatcttgcctgttaaattctgtttaattttgtcgttcccattactagaaaggagcaagtgaagaggttgacatttcattgttccaagtaatatgagcacccttttaactggaattttttccctatgtaataatgagttgagaattggttcataaaatattatggttttgaaaatgtcagcatggtatcttaatgatctagctttaattataatgacttgttggcatgaacctttggtagtaaagtcttcagaggctgtgtaaagtaaacagttttatatccatgataatgtctaaagacctagaactttaactaaggaatgtatcctctcttgctagtttgggattatgaatacataatggctatttcactttgaagaatgttcaaagtctaatataaaactttttcctctgtggataagatataaatatcacattgaaatttagtattaaaactaatgttacacatatggtaaaaaaaaaaaaaatgttctttgtcctttgctatggttttaaaggaaaagcaggaaaataagaggcaaattcttcccctaaaaattctttaaaattcgaacattcattaataggcatttcgtggaagacatatgaatggccaatgcatgtatgaaaaaatatttaccctcccaaccaccataaggaaatacaaatttaaataacatcttgttgctatcagttgctagtcccttgaaagactttattgataatatcctgtggtgataaggggacaaagaaaatggcattcagatgtattcgtggtctagtgggccatgcccatcggggttcttaggtttagctaaatattcagattgacccacctgtcataagccacatctggcacctgttgctcagaagagaggtagctgggatagccagcatgctggcaggtgttgctcttcagtgggagcctgcgtgacactccacttagttgtccatacaaccatctggaagccaccattcttggtaccccaagatacaactttgctgctaagaagtgggtttgagccttcctggcttgtaagcctcgtgcccccaggagccaatatctatagtaacagctgtactgcatagcttcccagttctctgcaaagaacataccagttataaaagtcattgaacccaggaaggcccaaagatatggtacctattaggtatttatggttttttctctcaagatacaatttatcaattgggttattttttcctaagcaatgatgcttataacactgttgacagtataggttcctaagagaacagagctagaaagttaaccaaaggtcaaattctcatataaaaggaaaaagggtgttttttaaccctttactcataaagaataaatgagcataatctctttttaagatcacatttggacagtaaacattgaaaacttttattgtgtgtgtaccctttcaagctggcaattttgttttcatggctttattgtaacaaatacgaaatatgcacaaagatgtgtctgtgtctatatgtaagtaggtttattaagcattatttgccatagttattaattaataacaatctaaatgctcagcacttgcttaagaaaattatagtacattcatattctagaataatatatacgtttataaaataggtatgtccagaaacaactttaaaagaacatatataccaaaatatttagtgtgtaactgagtggtgattttctgtgtaattttttaaaccataagccactaattttttactttgatcatgtattacttttctaaataattgctcttcataaaaattaccagaaaattggccagacacgatggctcatgcctataattccagcactttgggtggcagaggtgggtggtcaggagttcgagaccagcctagccaacatggtgaaaccccgtctctactaaaaaaaaatacaaaaagtagacgggctctgtggcatgcacctgtaatcccagctagttgggaagctgaggcaggagaatcgcttgaacccagaaggtggaggttgcagtgggtcgagatcacgccattgcactccagcctgggcgacagagcaagactctgtctcaaccaaaaaaaaaaaaaaaaaatcagaaaattattgtcagttttaatgcaagctacttacattaaatgactaatcatacattttaagagtttgttttaataccattaaaaaagcttgatcttgaactttcttaatgcatttaatgaaattctatgttctataaactatggagcttcatctcacatcaacatctgaagtgataattttgaagtatttcaagccataaaaatcattcagttcactttctcatatatactattacttgaaactatgactcagtgataaaagtggggaaagcacatatattttttatagaatttagatgccagctctcaagttcttttctcaggttatgggtaggttaatggatgccatcattactaccttatggatttgtttttaaatacatccaatttattctccatcttccacttgggtaatatacacacatcatagtttaacattacctcacccactgatagtcttgccactctatttattggtttagaaaatgtaaaacaaatatttcctcaaggggtatgtggtacttggaggaatattaaaaagcaaaatataattcatgctgtaccttcaataaaataagaattatgtgaggaatattcaaagaaatgtttattgcatttgttacctgctgttttgtattagctgtgtttcttgttctccatacaaatggatgatgcagagttagctggctctgtagaagtgctgtagaagtggattacagtagaagaccagtctttgggacacagattggaattctgatcctggcctcaccaagtactctgttacccagagactcagtttcctcatttacaaaatgaatagactagatatctcttaggtcttttcaactgaaaaaactattaagaattatgtaatttataacattaagacttatgatgataaaatttctgataattttgtgtttttttctttcagtttgtatctgttcaaactaggaatagcaccccagatccaggatttgttgggcaaagtagacttcacaggtactactctttatctttgtaattttttacaatctagttataaaaagtaccaatacctggccgggcgtggtggctcatgcctgtaatcccagcactttgggaggccgaggcgggcggatcacaaggtcaggagatcgagaccatcctgactaacacagtgaaaccccgtctctactaaaaaatacaaaaaattagccgggcgtggtggggggctcctgtagtcccagctacttgggaggctgaggcaggagaatggcgtgaacctgggaggcggagcttgcagtgagctgagattgtgccactgcactccagcctggacgacagagcgagactctgcctcaaaaaaaaaaaaaaaaaaaattaccaataccttttttccccattttgatattattgatttcccttattcctgtatattgatgagaagagaaaacagacctatcttgtttgttcttgactgagttctccttctccatgtttgtgaaatgagaaacttgggctaggttcttcctaaggctcttgtttacaaacaaccccacttcctgatgaagacatttcttgatatgattgtactcattcctgcatccatctctgtctgtagctttctctgataatgattatgattattttgttctttgttagaggaggaaatcagtaatatgagaaaagaacttgagaaatatggaatacagatgccatctttcagcaaaataggtggtattctggccaatgaactgtccgtggatgaagctgcatgtaagtccattcaaaatccaaacttgccatggatgtgagacttacctgtactttacctattgattttgattactcgaaatagaatatttagaagatactttaagcaccctaaaagtttttattatttgttttatagatgattaatttgaggatgtcagaatataaccaagtaattgattttggtctttagacttctacttgtacaacatgaattgaggttctagaaataccttcattgtccatagttctctactttctgtgtctgtagattttagtggtagagttcattgttacaggtcttttagtattgcaagctaaattgcaagtatttcttggaaccaacatgttactttaaaattacccatgtcgccctgaccagagggcaaggattgacttaccttctaactcctgtggttgacatagggcttgcttcattttagccattcagtgatgtataaatgagtcagaattacttaacagatgctgagatcaggaccaaagacagccatgtggagaggttgtcaggtgctccataatatgtctcagttctctttttgacatatttactggaagccaagaaagaaagtaaaactgcttgagtttacacagggtcaatgcaactgtccatgttgtcttttgctgataaaaacctttttctctctctctctttactttttagtacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaaggtgcttagattctgagtaataaaaacagtaatgaatgtgcttatgagttactagtttgaaaagccttaatgttgaaagcaatacttttaaatcaattggctattttctctatagccgtagacaattgatttgaatgaaatgtagcatacaagaggaccatacactaggtaaggcaattagattatatccctatataaggcataaaaaggaattttatagtccaggcatggtggctcatgcctataatcccagcactttgggaggctgcagcgggagggtcctttgagtccaggagttcaaaacgagcctgcgcgctatagtgagaccctgtctctaagaaaataaaaataaaaataaaaaattagctgggcttggtggtgcaagcctgtagtcccaactactcgggaggctgaggtaggagaatcacttgagcctgggaggttgaggctgcagtgagctgtgaccctgccactgcactccagcctgggcaacagactgagaccctctctcaatttttagaaagggaattttgtgatggatgttatatattgacagaattaaaagtcatgttgcaaacttactaatgtccccaggaagtgtagaagtagcaactcatgatcatcccttgttagacatcaacagaccttacattagccaagttacttttacatttggtagtagaggttaataattcagtgtggtgaagttcagagaggatgtttttgaatctacagtcttcatattttcccaatagtcaatcctttatatttgaggatgtccctcctgtacaagacagcctgctcctaatcgtaactccatttgtaaccacctttctgtgtagtccattattgaaaaatttgtctacgctgagagcttctacttcctcaccagcttgtctctcattaagctcttgccatgtcagtttcagctccatgactgaaagtaaccactttaggttttggcattttctcaactggtggcttccaccagcatctggcagggttggcctcctaccttgagattctctgcttcactagcttatgtgcgtccttgctgccacagttctcctctgtgcctctttctcctcttccttctccctctcagtatggggattcttcaaggtctgacatggaatcccttctctgttcttcttccattgagctcatccacttgttgaagaaatcagccatcagctttatgccagcccatcccaaattggcctctctcctccttctccagataactttgtctgtgtccctctggctttgtaccccattatatcagaagagttccccttgctgacttccctggttcagaatgatggccgggtttgtctcagaactctttttatgccccctgtgtcccatgcattgctagattctgctgcctactcttgttggagttgaatctgtcgccaaccttctagtctcaccagtcttgcctcagtcctgccccttctgacctcattgcatgactcttctatcaagcaccttccttgtgggtctctctgcctcctgttactctctaagccaatccctcttaaagctagaggttacaaaactgatctttaactacaaatcttgtgttaacccaccagagacatgccccgattctctattacctactgaattaaataccaaatcttagcttagccttcagctgaccccctcatctttttggctcaccatggacacactccaagctgtagcctaatgtgctaagctttccatctgtgtaaccaaatcctgctgtctgtttcctattcttgacattattctgttgctcgaagccctcattgattatgatctctttgcaaaattttcttcccaactaagtatgaatactttcttaaaaaatgcttatagtacttctcttatagaacctattctgttcttctaggtatatttattacttgtgttcttgattttattagatcaaatcaaatgaaattggcactattcaactgtttttgatctaaaaaaagggcaataccaagtggtccaaactaatgttttccacatttgaaaattagcccttttcaaagagtcaccgggtctgtcattcatctttgtagtctttgccagcattctcccctagtcccctgcacagagcaggcactccacaaatgcttgcaatgaatttaaataattagggaatggtttttgtcactcttcacatttttccatttgaatttcgagttttggaaatattttatttaacctcagaaatcagtgaagactttgttttgcagaatagctgtatttcagaagaagaaagagatgcttatgaagaactgctgacacaagcagaaatccaaggcaatattaataaagtcaacagtaagtaatggatcgtatgaaggaaattgatatttccgtaagatacagactttccttgccagaatcccaacacaactctcaatttgtatacttggaaaactgccttatacaatgaaaaatctactcagtgtcagtgttgctcttaattatggtgcagcatttggcagtttcccactgggctttttttggtgatctcagtccacacaaagtatcctgaagctagtttgattctaccttcctgtttcattacattccacattttaattctgtcacttttggggctaatactgaaggtcatttagtaaaagattataatttacagattgtagttgcttgcccatgattatgcgatgatgttctattggaattgtaaaaggtactattgacaccactgctctctgtgacttcccagccattagtctgttgtttgtaagatttttcttacacttgtgtaactttggtgccagtgaatgggactatggacaggccagatgaaatctcatgatggcagctttgagtcccacacccctgagcctctgtggagtcaagcagatgagttcctcttagtacctggctcaagtgtctgattgtaaagaacagcagactcaggtaattaaaataagcgtatgcaggttgagatacatcaatttttttattagtcttttctcccctctggcaaaacctatttttacttgagcatcagaagagtcagtaagaaatttcatttgatgtttatttttccctggtcaatctagataatccatatatacccaaaaaactaatacatgaaaggccatttagcctgcttaataaagcatgtgaactccctgcgaaattaaaatttggagtatccactaattacaacagtcctaaaccttgccttccttttaacatcctcgttgagttttgaatattcttttttgcttgtaactcttgcaaagaagtgtacacccacggtgttactaagaagtctgctcctaaattgctggagagaaatatcctaaggggctcaaacagtaattaaggaaagccccagagggttaatgtaaatgtctaggagttaacaactgaatgtgtttgagaatatgcctcacatacacataactgggctgaaaactctcaattgcctttatttttttaaggtaacaccttaacattttagggtgcatgtgcctgttgttttattcttgtgaaatcttgaacatgttactgatgatacatgaagtacaatttaaagtttgtctttttgctctatgcgaaagctgagaacttcgtgatgcttgacagaaatgaattacaggaggaaattaatgttgccagtgagacatctgaggtccataagcctagagaggaaatggctccatagcctttaaccatcctttatttttgaaatatttataaccatgaaaacagttttctttttcatgttaaataaaatgctttatataaatgttttagttctttactcagtgccataatttcctgaccgcaaatttaatgccaaattggctatactttttttttccatttttaagtaaaaggcattggatgttttgcactaatggtaaaaccggctgaaaatatgaaagcaaggtttgatggctttaaatgtgtagaacatgattattctgaagtctttttatctctccccatcttaaaatttatagtccagtagaactgaaagtaaccttaggaaaaaaaccctcattttgatgacatgacaatgagacaattgtacactttaaaatacgtaagaatcagctgggtgcagtggctcacacctgtaatcccagcactttgggaggctgaaatgggtggatcacgaggtcaagcgttcaagaccaccctagctaatatagtgaaaccctgtctctactaaaaatacaaaaagtcagccaggcgtggtggcgggcatctgtaatcccagctacttgggaggctgagacaggagaatcacttgaatgtgggaggtggaggatgcagtgagctgagattgcgccactacactccagcctggatgatagtgtgagactccatctcaaaaaaaatttaaaaaaaaaaagtaagaatcattactttgacaagattttcctcaaccatgtaggttattatattaaaatgttaaggcatccacattcatagcaaccatagtaatagcatcagtgacaatgttggtggtaatgtcaacagatctgttgttagaggcctcagctttgttcacattataaccctttacctttcaggttcagcaaatgcattccattcattgcatgatattttctgttaagatcagagctggacattttgcatttctttgcttttttttttttttttttttttttttttccggacagggtcttattctattgcccagtctggtgttaaactcttgggctcaagtgatcctccttcctcagcctcccaaaatgctaggattacagacaaaagctaccacaccctgcctggacatttcgttaaatgcagagtgtaaaagagtggttgatcttaccttatttttttagaagaaattgtttatttaatagtgtttttcaggctaggtgcagtgactcatgcctgtaatctagcactttgggaggctgaggtgggaggatgacttcaggccaggagttcaagaccagcctgggcaacaaagagagactcagtctttacaaaaaaaatttaaaaattagccgggtgtggtggcacacaactgtagccccagatactgtagagactgaggtcggaggatctccagagcccaggaggtcgagactgcagtaagccaagattgcaccactgcactccagccttggcaacagagcaagactgtctcaaaaaaagaaagagagagagagagagagagagagagagagaaaacagtgttttaaagacatgattttctgatgtttgaaatatagctgtacaaacccatataataaatttatcaaaggtaaagcaagatcctacctagagtaatccgagatacagctgaaaggccttggagtaactttagcagaacagcaaataccacaaacaaccactagccttcctttctgaaattttttggtttgtcacattaattttaaagatagaaatgctaaggttctcagggtcctttaggttaagtgtgagttttctgggggatgacttgaaggattccattaatcataagtatttcctgttattgaattatatctcttagtaaaaatattgagggaagatcctcgtgaatgtatttagagaagataaattgtcatcttgtcaaaaagggttagaagaatcttagctgcaatctagtcacgaattaggcagacaggctaacccttgaaaggctctaaaaatgtatgggtatgtgttacttctgctacccagatgccttctctataaggcaaaactctgcaatctctgtctgatttgctctttcctggtggcagagttcatcattcattctcccatttactcagcaatttcatttttgttctctgaaaactatgctgaatctactgttccaagcatctcagtttggtaaccaaaattcatttctttataatctgcaccttacaactggttgagagatcacagagtgtattagtccattctcacactgctataaagaactgcttgagactgggtaatttatgaagaaaagaggcttaattgactcagagttctgcatgtctgaaggaggcctcaggaaacttacgatcatggcagaaggtgatggggaagccaggcacatcttcacatgcccaaagcaggaggaatagagagaagggggaagcgttacacacttaaccgtatctcgtgagaactcactatcatccagggggaaatccgcccccatgttacaatcatcttccaccagatccctcctccaacattggggattataattcaacataagatttgggtggggacacagagccaaaccatatcacagagtttatggttgtctcagatgttgcagcaatatgtccgagtgcttgctgtaggcttaccgcagtgcttatgtgttaggaagatataacagtagggcaaggcttgcttctggtcttcttgtcacttgaagtctccttggggagacagtactaatgcacaaggagcacagggaacatgcctgctggaactacatggcccagctttaaataactatggtgttcacatgatgagaaatccttaaggactggagcaatctgaaggcttcagggaagaaatgagaccagagctggtcctataaggaaggattttggaaggaagtcatgctactcaggaatgatctcataccctaagctccatcaatgctaaggttcttgtaggcactaattccaaagattggattagtttgaattactgagataacattttcaaagccttacctaccctctgcctgcagcttttcagagttcatgaaaagtaactgcttaggttcaaatccttgggaagaagggctggttgggtgagactgcagtggaaagagcaaccattctgacaaaacatgaacccccatcctcagggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatggtaagtcagaggagaccccagctgtggggacggtaaccctgcgtgccatggcgcactagggaagcctagttaggaaaggggaatagggatcggggatctctaatttgtaccagtcctggtctcactggcccacctgtaccaattccaaggccttcttccttgttaattcttgcttttagtctacataaagaatctaagagcatagttaggaaattccagcagtggtctatacatatacctgtgaaaataggttgttcttattttctgtgtgatatttgaagacaccttggataaattttagctataccgatgtggtattttttttacaatatataatgtttttatgtagaaaataagctcaatctgcaattttagaaactgcaaataagaccattagcaccatggctttgatttttgtgaacttgtgcaccttaatatgacaacagcattcaacaataatttcatacaaggttacagtaattaagaacatgtttactaacactcttgtaagccaaacaatgaaacaaaatgaaaactactgaaagcagaaccaagaattcagcatataacaaggctcgtatttcaagaaggtggggaaacaactatttaataaatgatatccttgcaagtgtttaagctttgttaagaaaacattaactcactacacatatatcaaaataaattttcaacataaaatgttaaatataaaaaataatttaacaaattaaagttctaaggaaaaacacaggacagtcattggatctttaaagtcacaatcagcacttatccacacacaataaagagaggccaaaaacatgagcaggcaattcataaaacaagaactatacaaatgacaaacaaaaaaaaagtttaaactcaatcagaagtaaaaaatatataaattaaaacacagtacacttatgatttaaaattagattggtaaagattagaaagatttaacccagcgtagggatagatatggggcccaaacatctcctacacagctgctgggagtatgaattatacagattttctgcagggtggtcttagtaatacagatcaaaagcccatgatgctgacagttacgttctagaaaataagcctgaaggatatgaaccaaatagctttggccacagagatgtttcacagcattgtttagaatactgaaaaccaggaaacaaatgtttaattaataacagattgcctataaattaataacatttatggtgcttgtacatgtgagaaatatgtgcaaccagtaaaaatgataatgtaaagaatgactggaaaagatatccatactaatattaagtgggaaaaataagattaagatatatagcattatcttgttttttgcaaaaagaaagtgaagtcagttataaagacaaaacctctgcaaatgtatatatgaatttaaaatacataaaaggatatacacaaaagagcttgagtggtagcatttgttttcttattcttgcttactaagacttctgtattggctgagtgtggtagttcctgtctgtaatcttagcactttgggaggctgagacaggaggatcacttgaggccaggagttcaagaccaacctgggcaacataggcctcatctttacaaaaataataataataattaaaaagactccctatgtttcctaaatagaaatatagtatttgtaataaaagaaaaatagcttattttcttaatttcattcaggttctctcattaatattttcttccacttctctggctctgaagctcaaggctacttatgcttgaggacactcattcatcctcaactggccatagttaacctgtggctgtccaacctcatttcttcttcctctctccttatcctttttgctgtaaaccaatttaggtatccacggacaggtcactgaaagagatagaggaggtgaattataaacgattccattctgctcttataatttgatactttgtatgttaaacttgtatttaatgtaatatatttaaataaaatttacttacatgctctcgatggtaaccccttcttcccatttgctttgaaagattaaactatccctttttattctgaaatcagtttgctgcgagacttctgtggagatccagaaagatataataatgcattttaagatgaacattatgttatatattaaatacctgtaatatcctaaatgtaaaatatgtatcagcttttccttagtggttctttttcatgctcctgctccttatgtcccttcaatatgatgaaaaaaatattccttttgaagttgggccaagataatataaaatggttaaatggaagaagatattaaaggggaagggtgttctgaaatctaagacgtatttttttggataagctaaatccagattttaaatcatataaacctggagatctggccaggtgtggtgattcatgcctgtaatcccagcactttgggaggctgaggcagaagaatcgcttgaacctgggaggcggaggctgcagtgagcctagatcgtgccattgcaccccagcctgggcaacaagagccaaactccatctcaaaaaataataataataaaaataaagcaaaccaaaccaaacaaaaaaacctggagagctttacttgctttaccaaaagatcacctcagatttcttcaaatatcttgacctggtagtgtattttaaaatttctattttaaaatttatgaaaatgtcactttaactttttttgaattaaatcagtagtcttggtttgaagaccttgctttgtgcttcagattataacttttcagtgaaattctcccaaccttcccttaacccttaattcaaactggaaatcgttagctgtgctaaaatgttacctggcactctcagtcagtgacaatgttatctagtccttggcttaattatatggctggactgagcctttaagcaaccagtatagctaggagtagggatcagcaatgggaatgcagatatttgtggaatcgtaacttttcattgtaatcaacccagtcccaaaaaatgatcatctaatgaaagcccaggagccatatacctgttcttaaagccagtggaaagcaggtggccacgactcctctttctgctgagctatcaagttctttgactttttgttgtttgttgaaatgtgcattgtaaacctccatcatgcacatgaggtgtgttgtgtggggagcttatgttgccatatgttttccaacagaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacggtaaggaacattttccaaaccttctttcaatgcagaaatgcatgtttggcagatcttaaaagtgaggaatttgcctgttggtggagaaatccatataccatgctcatgtttcttgaaaactagtctgttttaagagtccttctaattagtatccttgtttacagtattccttctggggaacaagaagaatcagaaagtgatcatcctgtggcaattaataaatgactttgtcgttggcaaagattatttgataggctgaaaataaaggaactattggaaacatacctttccttgggcgtcttttggaaaccgcagaatgtagaagagttggaagcaactttaataatcatccagtccaattcttttatgtcactgatgcagaaacagaatccgggttatggacctaaaattgggcagttgggccccaaactccactcttctgattattaagccaaagaaatcctgagaccacagtgggtcatggcagtgggtaacaacatccatttatctttcatttcatgtttctgaagtgtgctaccagatagtacaactgatagcattgttataaaacactatagcggatcttgagagaaaatcaaatggccagaattgggagccagatgagagagtcgctgagataaaagccccagttaaaatgagtgaatcttggattcttgtaaccaccagggggagatgtctgcacagatcttgacaaaagctcttttcagctactgattttggaacggctctaataggcaggttggctaattctcttgggtcatgtacagttgccaaggaaaaaccagagatttcttaggttaaacaaatggtatttgaccacttgtctatgtagtgaatggccaaaaggtaatggaaggatggtgggttttccttgtttttagtctttttggagaaactaattctcttgttctacttaaatttggccatctggttcatatgactccttagagtgtgtttccaaggtaatttatatctaccaccactgtttctgttacttgttaatggcaccattctctcctgtaagcttagaaacctgaagcccaatttgagtttccctctgccctcagccgggcaccctcgtgctctaaagagcctgctgtcagtagccagtctatgtgccttatacctctgcaagatgtttccatttccctgcaaccaccctcacttagacttctcacttttgcttctgtagtaacccctaaattggtcatcctacttcttttctctccccattcattaatcattcctacctaaccaggctttgccatactttctcagtgctagagtagaagacagacccggtcaatcccttatgaagcttacaggctaatggggcatcttggtgagataactgtcaagactattccacatatttagcatccctggcaactgtcctccacatgacattagcccctgactcacccattctgattatcaaaaatgcctgcttcttcatttacaaatacccttaaagaagtggtcccattctatttgaaaaccatattcatacctgtagtttccagctgggacctacagatggagcctcacagttcgagtgttctgtgtgaagaacttttaaaatgttttgattttttttttttaatttaaatacattctggatctggaagacccagtactgacatgggatttaagggcccacttgggttcttgtattgacacttgtattggccccaaatgatcttctacagccttggcattttacttccaaagtcagcatcttaacttgggatcttggaatcccagttttgcagattatcaagtttgagaaacacggctctgtccagggcctctccccatagagtgcaggttcttcatagcacaagtgtgctgtgcatggccaccttgacaaattcatgcaaagtctctccctgttcaccgtggcttctactcttggggctgtgtttgcccagagagattcttttgtctaattctcacaaaagtattgtatgggttaacattagccttgggcatacactgttcccagattaactgttctaaaatgtaaccctattcataattctgtttgattgttccttgttcacatccgaattaagaacagacttctcattctaagcatgttgctctgaccttacctccagctccatccctactcgtattttgtgctttagccaagtccaagtgtactttctggtctctgtgttcctatgcgtggtcctctcaccatcaggaacttggtgcctttacccagctcagctaaacacagtattggagcttctgagccctgcctaccatacattatgttctgtgaggtatatccgtgcttctccccaccctagcatctgatgttatctctcctgggaggtagcatgatgtggttaaaggagcatatgccttggaaccaaaaatatctgagattgaccctccctaactaagcctttttccttcatctataaagcacaaaaacaaaagaaacaaaagccccactctgcatttgcagaactgttttgaggatttagtgtttggttcagtgcctgtcccagggagggtgctccaccaataagggtttccttccacttcttgctttgaaccccattatatctactcttatggactctttaatggtccttcctgtgctctgcttttatacctttttggaatttttgtcgtcttacccactggtctgaaagcataaaggctgcacctttttcctcctaatattcctgtagtgcctgccatgttttacatgtagtaagtgctcacaaacatctgctgaactaaattggattactgatcttctcagagcttcccagggctcttagattagtagactccttactagtctgtccatagatgaggtgaagagaactgagaggagtgagaggagaggacattgacctgtttggggaaactacggaatatttcccaaagttggtaacttcagtactggagagaaatactcaattggaaaagcctgtggagttctcttgtgttactttaaaaaaaatttttttttattattatactttaagttctgggatacatgtgcagaacatgcaggtttgttacataggtatacaagtgccatggtggtttgctgcacccatcaacccaccatctagattaggtatttctcctaatgctattcctcccctagttccccaccccctgacatgcctcggtgtatgttgttgttcccctccctgtgaccacatgttctcattgttcaactcctacttatgagtgggaacatgtgttgtttggtttttgttcctgttagtttgctgagaatgatggtttccagcttcatccatgtccctgcaaaggacatgaactcatcctttttttttatggctgcatagtattccatggtgtatatgtgccacattttctttatccagtctatcattgatggacatttgggttggttccaagtctttgctattgtgaacagtgccgcataaacatacaggtacatgtgcctttatagtagaatgatttataatcatataatgggattactgggtcaaatggtgttacttttaaaatcttttcctttatagcttgtttttgttcatttctaaagaaatgatgggtagttgtatttctttctgtgtttattttttactttctcatttcactcctgttgggtcagcatttagacgttaagtgtatgggatgcccataaggactttgcgcttttggaatggtctccatctgtgagggacactaaccagtgcaagttaccgataatccaaatcgttattgtggtcagtattatttattatacattactagtgtatttcacatctgcacttggcgaggcctcattcagctacagaaaataaattgttaccaccatttcctatttttgaatgtttttctctcaagctactctctatggaagacaccgcatgtcaccttgaagcatgcagaattttgaaaaagtttgtcacaaccaagaaaacagttttagacttcatataatgtttcttcttttaacctctgccattactagatccctagagactattcagaattcaaactgcagagtgactcattatgtacacagaagattgttcttcattgccctggtgcaaagacataaaagcacactaaactatctagttttattaattttcgctggaatagttcatgttagcctatggttgtaacattggttctgtgaaaattggaaagtgggaaaattgataattgagaagtaaaagtttcttaatatatcagtatgagtaagtttttccctgaaatttccccaggcagaaaaaaagtaattggagtggttgactaaactgtatcttccagagggctatgcacagtgagaagggtcattggtcataaacaatgggtgagagggccatttttaattttaattttatttttttatggagacagagtctccctgtgttgcccaagctggtctttaactcctgggctcaaacgatcctctcactcagcctcccaaattgctgggattacaggtgtgagccaccacgccaggcctaagagagatttttgagtattggctaggagcctttggagaaatgggcaggtgaaaaggaatttcagtatatcctggtttaactcatgtgccacctcttcaggacaacatacggtaaagattgtgctactcagcaaggtttctggaactgcatttgcatgttatctgattcctcagtgtcatattaggcctcaaagtggctctatattagggttgtagtagaaaaggtcttttaaaacttagattttggaaggaacaagagaaataatgaaaaggacacttgatgatagaaagattgagacccatagtaactctgaattttgccctgtaacaatcatctgaagactgagaagaaccaagacatacaaaggggaggaaaattagtaactagggaaaagtaatttcacagacttgaaagtttccagttttgcttgagttaggtatgagtttcgattttgaagagctttcattaacagaatttgttcataaaaatactttaagaaaacaccattagtacaagtaagcctggtatatgttgacagagctacacaagacaattttatttgcctttctactctttgtctaacttcataacaactatgtttgaccatgtgtcatagttgagaaacaacaggaacgaagaatgaatgtctctaattaacatcaagattattttctcttccacagttatgcaaacacactactctctgttaaactagaagttttatcccaagggcaagataacttaagctggaatgaaattcagaattgtattgatatggttaatgctcaaattcaagaagaaaatgaccgtaagtataagacactttccttctctagcatagtgggagaagaaggtatctggacaacttagttttctagattagggctttaagtttttgctcaaggaactttgtgagagcaaactccgctaatatgcatacctttatttataggtagattttatgcctataccactgtaccaatatgttataaacgttacaaagcctacacaagaattcataatataataaaatacacaagtaaaaggcctgatttttctggttatttgtacttcagagacagctaaatacagagacagctaaataactcatatttttaagcacccaattttattttgaccttttatttgggcatctttttttctgaaatatgacacgatttttctgccccacaaatggaggaattggaacacgatctaactgttgcttaatgatcacaaatcatggtgatttgctgtgtttctagaaattatgagctgccagcatgaaagcataccaacctcaggaagatatgccctgaaacatgctttcttgaatgtcagcttgctgctttatcatttgcatcttgcttatgaaaatagagtgaagaatgaggagctatgtagcttctgcagtccatacattcactgcttttctgtagtatgcattaccaaattcaagcttcgagctgtgttttccaccatgaaaacaaagcaacaccatcttctgtggcttatgagcttttgacttgtcagcaacagtgggtgagtgttgctaaaatcattgatctctcctccaccttccagctttgacttttctaactcatttgctccaagctcgcggatagagtgggcagatacttctctcacagtttattatgttttattttagtgtgtttgggtaaggtcttaggtctggtcttctaatgctgtatttaacttaggaatactaagatcactcttgaaataaaacatatgactttgttaattaattgcatttgcaaagttttcttctttttctttgctgtttcctgtgagtgctgggccaaaagtcaaggccagttttggttcttgttttttaaacatattctcactttaagcccctactataaaacaggatccaggtgtgctaccctatatacggtaccatggatgtaccactgttacactgatccctggacactttcattttgtccttttcaagttgtgcacaaatctaaatttctttcgagacggcacagcttccctgttgcctctgcatttcctttcagtgaagcatttaaagtctctgcggtgagacggcttgctcacaccccacttagctcttttctgatacttggcttgggagtttatggttcttgccagacgttagtcaagacgcaagctctaatttgagcagatgttcaacatcatcaggtgggggttgggggaccaccactgctcctagtgtcccgctacagagctcagtcccccaggcttctgcccttctccacaacctccgtcttaatgctctgaatctcctttagcagtggtttggttgctacagcaactgccacccaagaagtaggactcctttcttttggtaggcaaaacaaagactcacgtcccatctttgctttctaactttttccccaattcttggcaatacccatgcttcagttctgctttggttatttctgtatgtgctgcttacacaaatgaaggtatgttagttctcagtgctgaaagattgtagggttgacattgattaacagggggaaaatgccagttttgttcttggctatcaagtacagcctttgctttagttggttactggggggaaaaaaagcaagtaacatttgcataacttagaaaatagtcttttgtaagtagatattatttttaagcaaaaatctcatttgattgctgtggcttttatctatcaaggtaacagcactactaagttattctccctaggacatttcacacagccactataacacttctgttaagtatcttgtcataaaggacatataccataaccagaaaaggtatttcagacactaatatttcctttctggaatttgggaactttaatacagagtatttaatttatctgtgtcttggttttatttttttcttttgtcagaatgagttcctgaagtattgagtttgatatcatgtttaggcaattcttcaaaatctaaaatttctaaaatacaccattgtaaccaggcaggaattgctcagtatagtaattaagtcatctgaggagctgagaatttttcatggacgttttgaaggtgcattactcttgcctccccaccttattcttgccacatgctctgagatctaattccatatctgagttgtgatgtgggtgaggtaagcagctaatggaaaatgagaaatatagaaggtgaatttaatggagaagctagctgctgaatgcatttcctcaggctctgttgatttcttactgaaaagtttacttttcccagtagaaccataaaggagcattattttaaccttatagcctacatcaggaagttttcttctttgagtttttgctctttaaatttggtaggtacaattctgtgtaggttacctcatctgctgcctcaaatacatgaactctaaaagaacgcccactctcttgtggactagaatgttatagtaacatgtgttgatgtaaagaagtggaccgtgggctgagtgaagctcagcaatctttcttcaaataggatttcccttttatttataaacagaggaagtgatgcatatgttcccagagggcttctgggtaatctttcagctcctatgatgtcattcactatgacctcagcagcttgtattcttagaaacgcagcagacagcaactttagcaggtgatttcaatcaagtcagctgaaatgcactcacttccaggtgatcggccttggttctgttaagaccatttttggatggggtgttttaaaggtatttagaacagcttacccaaggggggtgaccagagaatggcactaaatattccatgcactccagtttataaatcctatagggtaaaacgacagtaccttgtatatagataatacttagactttccagagttctgtcaatgtttacagataatataacctgcacattagagaaatacttctgctttttcttcaaacatatttaagtattatagtctggaatgatttctaggagttttagatggtttcattcttcttacaggtaaatcttttcattcttaacgaagtggtggttatgggctcatctattcaagaaatatttagctaaatattttatctttacttgaatgtcaagctggagatactttttttaaaaatgagaagtactcattctatttcatggcatatcacagttgtgaagtgacgggtgatcattttagattaaatctaatggaaaaaatgagaaatatgaagtttgaccttaaaaatgcttatattctaagcttattgttcattaatatctagtttctttaacagttcttatccatcagtactaacctaggaagcaaaagctccttggcagtgtgtgtatatgtgtgttttatataatatatgtgtgtgtgtgtgtgtgtgtgtgtctgtgtgtgcatgtctatctaaatgcatttttttatgaatggatgatagtttattttttaataataaggtattgagaagtaacctccagatagatccgtttcattagaattgtaaaagcaggtttcatagtttgacttctgtgcttttcatttgtgaaccctatagtcagtcttgttctctctttctctctctctctctctctctctctctatatatatatatatatatatatatatatatatatatatttttttttttttttttttttttttttttggtggggggaacagagtcttactctgtcacccaggctagagtgcagtggtgcaatcttggctcactgcaacctctgcctcctggattcaagtgattctcctacctcagcctcccaagtagctgggacttgaatagacacttcatttctttaaagatgatgtacaaagggaaaataaacacatgaaaagatgctcaaaatcattagtcactagaaaaatacaaatccaaaccacagtatgataccacttcacacccactaggatggctgtaatgaaaaagacaataacaagtgttggtcagaatgtagagagctactcaggaggctgaggcacaagaatcacttgaacacaggaggcggaggtggcagtgagccaagatcatgccacagcactccagcctgggggacagagcaagaatctctcaaaaaaaaaaaataaaaataaaaaccagcagctgggaccttgatagaagttgcattgaatctgtaggtcaatttaagaagtatttccatcttaacaatactaaatcttccaattcatgaacattggctcttttcatttatttgtctttaagttttttcccatggtgttgtatagttttcagtgtacatgtcttatgtttctttcattaaattatgtctaaatatttatttataattataatgtatttgtagttgcagtcttatgaattgaatgtgttcttaattttattttcagattgcttattatgagcgtatagacacataattggttttgtgcttgcatcttgcatcctatagccttgctgtactagttaattagccttttgcaatcggtgatactaaagaagttataatgtactgtgacttaaaaggaaaactacttcttcattttctaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagtaagttttagtatatctgtttcttttaaattttacaggctgggtggcagagggagagaaggaggaggatttgacccatttacgttaaatctcatgagcttcttgtcccaacaattacccatgaatcagaatggaaataatagagctgttattttcctggtaacaaacattggggggaaaccagctccagagctatttattgctttaattctttgactaaaaactcagttgtaggtgagttcttgttcagagttcaattcattgactatttccttagtagatactatgtgcacacttcagtccatagcttctggtagagaagatggggatacagagggacacataataccatttgaatgttctctgaccttatcttcaaaatgcttagaaactgattgaggcagtggacattgtcacatggaacagtcaagtaatagtaaagataagggtgtgcaaagtgtcaaaatgagagatacacagattgattcacggatgtttgagattgtcggggactagaatcctaagagaagttggtgtggaggtagagcagaagctgtcctctcgaagactagtggctttttctgagtacagagcttgtaccgctattataaggagccccacaaagactggcctctgtgataaggccaatgggctgagtggtgaggctgatatgatctgtcacctaagagtgggagtgatgccacctgggacctagctacttatggctgccatgtcttcaggtgcaaacccaactgaaagggcggtcatctcctctgtctaggtctttagaacctaggaactgcctcattcgaaacaggaaaaacatccttggttaatgcaaacatttattgagaacctactatttgtcaggcatgatattagatactcatgtgtatcatctcatttaatcatcacaacaattcataacagccttctgaaccattttgccatcattattgccatcttacacataatgaaaccaagattaagtaacttgttgaaagctatctaaaatgtgaccgggcacagtagctcacacctgtaatcccagcatttcgggaggccaaggcaggtggatcacttgaggccaggagttcgagaccagcctggcaaacatggtgaaaccccatctctgctaaaagataaaaataaaaaataaaaaattagccaggtgtggtggctcacacctataatcccagctacttgggaggttgagggacaagaatctcttgaaccgagaggtagaggttgcagcgagctgagatcgcaccattgcacccccacctgggtgacagagcaaggctctgtctcgaaaataaatacataaaataaaataaaacaaaatcaagctatctaaaagataattagtcctgagactacatgcagctcaggtctgtctgattcggaaacattataattatgtattaaggcagatgggaaaagatgtttattgcagctttgtttgcaatcacaaaacatgaaaaacaacctaaatgttgttaagcaaaaaaaaaatcatgctgtgatgtgcacatagatggaatatagataggcttgtgtatgtgttgggggaggggcgcacacactcttacatgtgtctaaaatatttctggagggaggataccttctggaaggtgaactagaaggctagtatggatgggagatttattcttcactccgtttttgtactgcttggatttttaaattttttaaggagtgtgtgtattaaataattactgtttctaaacttttaaaaaccaatgtaaatcctatcctcactactccactgcctcattgaaggtggagaaatgtatcccccatggtggcgccctctgcactgccagccttccaacaggaacggcagtggcattgcctgaccctcctcactttgccaagcgcccccactcacatcagtctttctcatttaagcctcataccacctgtggaatgggtgctgtctcatctgatgtgaatgagcctgaggctcagggcgaatgcctggccaaggtacagccagtgagtgggagagtgagggctcatacacaagcctggagtccatacatcccaggggcaggagagtgggccttcaccttgatgtttccactgaggtggctgtggccatggcacatggtaaacttacaagcattggaagacaaagttatttgctttgaaggtagacatcatttaaatcctggctttgccacaaattagttatgtgatcttggtcaaatcatcaaatctctatatgcttatttttgcatgtataaaattggaataatagtacctgtcttataggattatggtgagggttcaatgagaatatacaataagtaaatatatatcaatatataactataggtactattaatgaagaatatgtgcacgtgtttgtgtagctatagcatttagcatggagcctggcaccaaaaaaagggcttaaataatgtagctagtattattgtgggcacctatggttgcctcccaagtaaggggtgagtgatgtcagtatcttaaggttcttttttttgtgagatggagtctcgctcagttacccaggctggagtgccgtggcgccatatcagctcactgaaacctccacctcccaggttcaaccgattctcctgcctcagcctcccgagtagcagggactacaggcacctgccatcaagcccggctaatttttgtattttgtagagacgaggtttcaccatgttttccaggctggtcttgaactcctgacctcaggttatccacctgcctcggcctcccaaagtgctgggattacaggcatgagccaccgcacccggcttcaaggttcttactagacgtagagtctgctgaatttacacaccaaagtcaggatcttctgaggacaaatagagacagacctgggtccctgtctgcccacagccacatgggggtttgtctttgaggtgagcctgactccacaaacccaaggcctttcataggcaggcagtataggtcccttctagactgagcattccaatctagattgagatggaactccacaggcgtcctttgaaagaagcccctgagtgcccacaccatgccagctctgtgtcaggcatcctttctaggtgtggaaacagtagctttcatggtgtgattagagcattgatatggagcctagggatctgggttctagttcaggcgttaaaccactgttagactatagttagaggtttgaaatatactggcaattactaacagatttaaacagatttaaaatactgcaggtccaagcgatgaatcatatttggttaaattcctgtttttaagcagttttctttctctgttcattgactttgaaactttcttttctcagcctgttcttttttcttggaaaaatcctaattctgttgtttggcaatgtctttaatgtctttgtttttcccctctgctttttttttttttttttttttttttttggagacaggatcttgctgtgttgcccaggctggtctcaaactcctgggctcaagtgatcctcccacctcagcctctcaagtagctgggattgtaggcacaagccaccacattcagcatcctctactattttgattcctagaagtttccagttgtgtgtttatgatggtatttctgtgccttgtcttcccaaggtctggccttggaaaataatattagaaaattatattgctggtattatcagtataaagtaaaactgtgccaaaggctacagccattaaaggtcacaatgggtaacatcttcatagaatggctgcccagttttgtcaaaggtggaggacagtaatggaagttggtgaagattctgggtcctctttagcagtatgtcaagtataaccttgtgtagctacaaaattccttttgcctcttggaaagagacttgagtaatggtcatgttgactttaacactttttctatgtctgttcactgggtggtgtgtgctattttacaattgaaggttttgcttgtgaacatatgagttatactccaccaaaaagttctgttttgctccttgtatataccataaaaactgtgtgcttttaacgaatattgctgtattttttccttaggtaaaactgtgttgtaattgatgacttagttttcagaagtcagctccttccatttaagtttctatcttcttgaaacttactttaggtttgtttttcattctcactttagtgtttacctgagttttgctctttgcataaccacacacatattataaagggtcttcatgtggaagctttttacttaagtctgatgaaatagaaaactgtgtacatttaaaaatatgcatttaaaattgttttttattgttttgttgggcagtatgaaatatacagtcaaggcagattcgtacagacttgtaaagtcatctcaggaatcttttatgcttaaagtttcctcagccccatttatattcactactatcattcactctttaccactaatatcttccctgctgtctaatcactaatatcttccctcctgtctaatcactaatgtcttccttcctgtctaatcactgagttaagggaaaaatagtcatttacttacaggaatataatgggtattaataacaaaattccatttccccattaaaagctatgtctaagaaaaaaaatagtggaggcattatttaaaacttctaaatggcctggtgagtatagtcttagtttagcttccttacttttttgtatgcccaacctgaaatgatgtcatcccgtatcatcacagtatgttgctttttcagtacgaagttaatgggctttcctgctgtttaactgctttgagattttaaaaattcattcagccacatagtattcaaagcatggagctgggtgccacaaagacttgggcctggcatcacccagaagctcaaggaaggcagaggatgagcaccttctccattatacttggtacttgattgttcatggaattaaaatttaaatataaatgaactatatataaatgccataataaaaatatacgaaagtgctttggaagtacagataagaaaagtgacacttctagcctgagaatcagggaagaatggtccttcaaggacttgaaaaaatgaacagaattaaggcaaagacgttaggactagcttttcagtctgaggcagagtggagatatagcagagcaagaggtttggttggtgcctatatcataagcaaggtttaatgggaagtgtgattagcaagttagccttgaatgccaggctaaagatttatgatttattatagaaacagtggagttagtggaaatgttttagtgatgtatcctaactgatatctaaggaagattaatctggcaggacttgtgaagtggtggagggtaggctggcagtggagagaatggttagaaggtagaggtggcctgggcgtagtggctcatgcctgtagtcccagcactttgggaggctgagataggaagatcactcgagaccaggagttcaagaccagcctgggcaacagtgagactccatctctgcaaaaaataaaaaataaaattagttgggtatggtggtgcatgcctgtagtcttagttacttgggaggctgagacagcaggattgcttgagcccaggagttggaggctgaagtgagctatgatcaggctactgcacttcagccaggtgacgaagcgagacactgtctctattaaaaaaaggaaaaaagaaggcaaaggtgaaactagataaaagaccctggtgagggaccctacaaagatagaatcagttgatgaggcagccaccagcatgagagtcaaaagagaccaaagaataaaaaatgatgtcaaatgtcaaggatggcaataccactcacagaaatagggaagatggtgatttaaagagcttgaagtagcaataaggcaaatggaaatgtcattttccatagagttgtgatatcttttctcctgcattaacatttttaaaatactgataaagtgtttttaaaaattactaatgctggctggctcagtggctcacgcctgtaatccagcactttgggaggctgaggccggaagatcacttgaggtcaggagttcaagaccagcctggtcaacatggtgaaaccccgtctctactaaaaatacaagtatttttagtagctgggcatggtggtgtaatcccagctacttgggaggctgacctgggaggcagaggttgcaatgagccaagatagtgccactgcacgccagtctgggtgataaagtgagactcagtctcaaaaacaaacaaacaaactactaatgcttttgtaatgtttgacctttgaagcatatttcttaggagctcggaaatggagctccttgcactatgcttatgttgttcttgaaaacagacgttctctgtgatggctgtccttgttctctaagatcatttcactattttgtaaggtaagcagtggagtgatttctggtttttgacatgagaaaataaaggaatggatctaagcaactattaagactacccaggcacaaagctatgagatatataaaatataagccatcagtgttgttgtagtagtagttagcatggtgaataataagaataatattgcttggagcaaagcaaatggtaaaaatcacaaggatgaggagactcgccttaacataccacaaccatctatgatcgtatgcattaagtgtccggatgatggctgcatagcagtagatgataagcacaaatggaattaagaatccaaagaatgccaaggagatgaagtaatagagttggaagggagatgaggactcgcaagtgttgtgaacatcatggcaggtggtgatgtctggctgaacaagataatattcctgcttcagtatgaaaaatggcagcatatataagaaaactgttgcccacaccagtccacatgttaccaaggcataggtgtgcttgggcaggccccggtaggtgaaaggatggacgatggccaggtagcggttgatgctgatgcaggcaaggagcagaatggagcagtacatgttgccatagaagatgactgtggtggcccggcacaggacctctccaaatacccagttgttcccattgagatgataagctatcttaaagggcaatgtaacacaaaaaagaaaatctgcaatggccaggttggtgtagaatacagtggtacagatggatctggtcctgaagaaaagcatccacagggtcacagcattggccgggacaccaactacaaacaccaggaggtagatggcaggtatcagtttagtacttaaggagctggtcaggtaccccatggtagcatttttcacatggagatgtgaagcactttcttcagggcacttaatttttacagtaatcgtggctcctgtccagccttccaaggcagaaaaggggaactcttcaaaagaatttgggggagctccacgaaaggtcttaatgggtaaggttggctttgccaagttgtttgtatcattttccatgcctgtaattgaaagaaagtattaacataaatgtatagttcaagagaaaagaaagtgtgtttaattatttgtaaataatttctgtgattgtagaatttaagatcatttttattttaaaaagttattgtagattaggcagtcaacaagcatatatttaatacatatcatatgccccagaacaacactatcttgtgcggaaacaaaaactaaatgatcagtccttgtatgtaaagtgtttataatactattagaagaaacaaaaacagcccatcagaacattataggcatgttgactacaaactatacaggcattcagacaatacttaatagattcagatgtttgagcaaaatgtcaaggaaaagatgaacttgagcaaagactagcaaggttcctaaaaagatggaatttaatgagtaagattctgctggtgatgaatggacagaagcatagtgtgggctatcatgggatctgggaatgccagataagttgatttagcaaatttttattgtacattgatgtgtcagtggtgtaaagttttaaataaaatccatttctatctgtaagtaatgctactcgtggagaagatgcataaaaatgcattgtcttatgcgaataaagtgcagctgagaaaggaaattgaaagagtgggtgacagctaaattcctgaagggcctctaaactgtcctaagaaatcatatgtctattcacagatgatgggattgcacacacaattttgaacagaggaatgaccattgtgttaggcagaatagtagccccccgcaaagattctacctgctaattcctggaacctacaagtatattcctttacctagcaaaagggattttgcagatctaacttagttaaggatcttcctttttttttttttttttttttgagacagtctcactctgtcgcccaggctggagtgcagtggcacgatctcagctcactgcaacctccgcctcccgggttcacgccattctcctgcctcagcctccccagtagctgggactacaagcgcccgccaccaggcctggctaattttttgtatttttttagtagagacagggtttcgccatgttagccaggatggtctcgatctcctgacctcgtgatctgcccgcctcggccacccaaagtgctgggattacaggcgtgagccaccgcgcccggccagttaaggatcttaaaatgagattttcctggattgcctgggtgggtcaaatataatcataacagtccatataaggggaaggtaagagggttgtcaaagtcagagatttgaagatgctatgctgctggctttgaagatggaagaaagggtcataacccaaggaatgcaggcagattctagaagctgaaaaaagcaagatagccgattctctcctagagcctccagaatgaacacaaccccaccaacagccttgattttaagacgtctgatctccagaaatataatctgttattttaagccactcagtttgtaatgatttgatatagcagcagtaggaaacgaatatagccgttattttgacttgtttttaagatgacttaggtaatagtgtagagaacagattggaaaggtaagaaattacaggcaaggggacctgatttggaggctactgtcatcattcatagctcagtgagttactgagctagaacagtggttatggaaaggcagaggcgaacacgtgagactctgatggcggcttaaagggacttggttctgattggctttggggtgcagtgagggagaggcaggaagcaataatgactcaggtttctactctagatgacttggagggagaggatgccattaactgagttggagggagacaaggagacaggatcggggagaagctacaatctgtttttagtctgactgaggatgagttgctggtggaatattagtgtgtaaaatgtccagcaactggttagaagactggatgtgggtccaaaattccaggagcccaaattagaggcatgatttattgtagtctgcatggaggctctcgtttaatttaatgggagtggttgagatggcctagggggagttatgagaagaaagaatccaaaggtggactttaggggtaatgacagattttaagggaagaggaaacaaaggaggaaaaatcggaagatgaaatcggtatgaggacctaagaagttggaaatgaattctttaaaagatagaaacacatcaactatatgctatcaatatttggtgttacttggcatgttgatgttaataatcctaattcctgcaatttcaaaaacaaaatcttaaagctcaaacctgaacatttattattatataactttttgtaaccctttcacatgtatagaaaatagattctcccagatttctaatgttacctttaagatagacttctatgccaaatataaacctcattcttatcgatttaaaatgccagtactgcgccattatgtcttgtcccatggcctcaaaattcctccatattgaatacttgaagttagtgtttagtaacctatgtttcattcagagccagtttctcttcctgctttaatctctagcagttagctcccgggtgaaatggaaaccctccacgtaaacctgagattgcacaagctgaattcacggtgtaaaatagaggaggtgtgtcctagtaactgaggggtatggaggtgatcaggtatcatttaagaaaaggtagattaaagaaaaggaaagaaaaatttgggaggcagcattcttctatgcctgtatttagaggtgatcttagaagctgtgttgtgtgacacacaaacccttctgctcacttttgcattttggaaaagttcttgcatctgacttcacccaaagagaagtgcctttaaagataggcacaaagttagagaatggtgcctgaagagcatgccgtacaagttattagcctgattttaaaaagctgttaaaaccaagtgtttgtccgttttcagaaagtttctgggatttagcaagacatcatgcctccagacatgccaaacagtgcctgtgttttgtggaaaagttgatttgattccattttccgtgagaatgccagatctgggtccacttaaataaggcttttattcctcagagcctggttttccttatgaattgtactcattgttaaatttttttattgtattttaattctttatagaggcttccattgggcataatatttcggaaatgtttttctatccgggaaaaggccttgaagaactaatccaaagagaatgaactccggcctctcaggggtgtccaagggagagaatacagtcatggattcatagtttctgtttctagttgagccagtaaagccccttcctcatccctcttttccatttacctctagagacagaaactaaaaaccatggcttcaggctgctaaaagcctaaaacaaaacaaaaccacaacgaaataaggcaggttggacaagcttgcttcattcttccttcacatttctcccccaccccatggaagaaagcaaattcactgcctctttgtttccttcagaggcccccgttttcacctccatcaaaccctattagcgtcttgaaggaaccacccccgaaaaccttgcttcttttgcaattctgcttctcaacatattggcccatctactcccagaaagagcgtgcacttattatattcataaatcccacatgtgcttactgctaatcaccacagattctcttagagctctctgcaaccgctcagggattccaaatgtgaatttaagcaatgttcctttagaaagcattgatttctgtttttgtttcccttgctatgtccagtctttgcctctcccactcctaacaatgttgactggagtgtgtgacctaacaaagagtaacaggtacagacctatcccaaatttgttatttttggaaaaagcaggaggtttcaggctaacattgtgatgggtaaagtggaaagtacattcaaagttgaataatagtatttgggagaccttatttttaaaattaaaaaatcatatatgagggtagggagaactccccacttaaagtcaaaaaaggtcattcatttcggaaatactgacttattagcattgccagctattgaaagcagatgactttctctttctggcagtattcttgtttctcccatttatgtctcaccaagaggtttaaacacaggatatatattttaatccctagaaaaagtgccatctttgcttaaccagaagagaaattcttacaaacacaaaaacgactttcaaaattgctccctgacttaattgtagacatctaaaatcttgaatatgccacacatttttaaacatcaggagggaacacttagtctatgaccaggtttgaatagagtgaatgaactatagatgttcatttccatgattctaccttttaataataaagatcaaactgcctttggggtttacagtttgtgtgagatgcaaagaaacctaggttcagttgactcttaatttgtaacagaaacccacatccccatcctaccccctgagaaaattgcttaccactctgacaaaaagtgggcaacagaagcaggaggccagcagctgcaaagatgagggctttcattttgatgacctgagtcccgtctcttaaacgttatgaaatctgtaaaatcatggagcacaatttcacctcagttccatgtgtcagcagcaaatggaagccttggtctgtctgtagaagtttgctctcctgtgccgtgcaggcaggaaacttgccctggtcctccgcagggaaaggatgtaatccactcgatgcttcagtaagcatgactcaggccaagcctctgaacgtgttacgttatccctggagaaaggcatttaactcttacccacccccaacaatctattctgaataggtgctgtaattctcccctagtagatttgcttttaaagaatggcagaaattacacaggcctttacagaactaagccaaaaacagatgttgaacagcagtaagttttgaatctgtcccacatttcatttcttatccgttttaaaaatgcagttccagagtgtaatttctacttaataaattatcctttcctttatcttcccagctatttcaaatcttaatccttaaacactttacataattataaattaatcatggaaaacaaacttttaagaaattcaaattgagcagtgaatcactttgaaaattttctatcagtgtaatattgatttcagtttgtcgtcagtgcctggccagaacctggcttttgagtggtggtggtttttcttcgccgggtgaggatggcgtttgttcaggctttttttttttttttttgccttatcttgatgtgttttgagccattcaataacccttagggtcagataactggaggaacctcccaaacaacgctgttcagttaaactaaaatcatagcacatcatgaaaatgaggactccctttattccatgagtgttggtgaataagtctacaataagatatttttaatagtggtaaaatatacgtaacataaaatttactatcttaaccagtattaagtgtacagttcagtaatgttaaatacattcacattgttgtacaacatataagcttttatgaattgttatattctgtagagtatgacttaatatacagtaaaaaaatgcattataacacatttttctgtagttaataaaacttaaacttgaagcctgaccatcccacagcctgctctttacaaaatgcagcaagaatcagaaaatacaaatttcacatgagacttaaaggctagggatatgctaggaagaaattgatctgcggaaacctttcacatcttgattaaattacattagaccaagatttttacaaaggtcagtgtttaatacttcaactacataatatatggttatacaaactgagatagaatgttattatattgcagaaatataaaacctaaaatattgacaaaggttttttttgtttcattagaacttttctgggagttatctaaattcaggaatttatgacttgatttgcacatggcctagtttctggtcatttaattcatttgtaactcttatgttgaacctggctgtttaactgaagtggaggtgtggccgtcccataaatatactattattttcagtcttctggtgaacaactgaaaaagcagacttggctgggcacagtggctcatgcctgtaatcccagcactttgtaaggctgaggtggggggatcacttgaggtcaggagtttgagaccagcctgaccaacatggtgaaaccccatctctactaaaaatgcaaaaattagctgagcgtggtggcgggcgcctgttatcccagctacttgggaggctgaggcaggagaatagcttgaccctgagaggcggaggttgcagtgagcaagcctgggtgacagagcaacactccatctcaaaaataaaataaataagaaaaagcagactttacattgataagattcagcttttacttttggttttacatttaactctagtaatcgttagttcaatgtttcataatttaaaccgttgacttaaattcatctgatttgtaatttctctcttcagtttggcctataagactaatactttaagctttgaagtaagattgttactgccttctcatctgggtagaaatctgtgtggtgtatcttctacagtgataagttatgaaggaaggcaaatacccttcaaaagaactgagacacataaatgaactcatagagcttagtttttaggttatagctggggagtgttgggttctcttagatcttgtaaacagagaaaaattagctcctgcttccctgtctctttttttcctcctctagtcttcccctttccacccggcttcctgtttgagcctcccccatccattcttgaaagaaatggaaaatcttgctgatgcttcccttgtagtctgccgcatagctagaggtgattgtggaagcaggcaccaacatttccccagaggtctcctttagcccagatgttgcacgatgaaataacagatagtttatctcattttcagagccctttccacatgcattatctcacgttaacctctgaggaaaatagtgttagaagcctgccagaggaaccagtgactatttcctctccttcctgcccccatccatcttaagttttaaatgacggagtcggtgccagatccattacctttcattcatcacagtcttgacttaggatttagaacacgacacttattcctacacataggtaaaatgttcccatttgttaaatgtcacatgtttcctgaaaatatctctgctgataattatttacttgccatctcagaaaagattttataaaacacaattgctacctggaagttccacttaatatctgtcagggctgcttttgtagcaggaccatcagaatcaacccaaagttaaataggaatatttacctataataggaataatgcaatacattttcattgctgctgttgcttcctttctaaagctatctttaactacttagtctttgctccccctgcaacttgacacctttaccataggttaaccctttctcacctatgtctggatcatgtgtctgcagtatatattgccctgatcacattgtattataattgtttttctttttttttttcttttcttttttttttttttttttttttgtgagacagagtctcactctgtcccaaggctggagttcagtggcctgaccttggcttactgcaacctccacccaccaggttcaagcaatcctcccgccttcctcccaagtagctgggactacaggcatgcaccaccactcctggctaatttttgtatttttagtagagatgaggtttcaccatgttggccaggctggtctcgaactcctgacctcaagtggtccaccaccctcagcctctcaaagtgctgggattacaggtgtaagccaccatgcccagctatatgtcttgacacatctgtctcttacactacattgttaggtccttgaggacaatcaccatgttgttgtttgtttttaatttttgtctctgtgtctgataaatatcgatgatccctgtgtttctctcaaattaaaaatatcccatggtaccctgggacaccttgacacttagtttgggaaccacaataattgattgagggagagagtgtttgactagggtagcccgggaagactttttggagtaggtagcatttgagttgagacctgaatggtgagaaaaagccaacagccacacagtgagggtagagtattgtggtctgaaagagactcgtgtgaaggtctagaacaggaagggggaagtaaacgggtgtgaggtgcagccagagaggcagtaggcagggccatgccgttggagccccgccatccctgagaaggcaccctgtgtttccttctaactgccggggggaagcctttggggaagctttaagtagaggagtggtgcactgagctatctattttgaagggatcctctgggccctctgtagagggccactgtggtgagggcaagcttagatgcagcagaagctgctagggggctgatgcagctgtccagttgggagatgatggggggctggactaaagagtggtggggaagaaggaggaagtggtcgggtttggggtctgcttcattaggagtgtgtacagtatatggcagagctggatagttgctgattaagaatttgtgggaattatgattaaatggctcctcaaaagcagttattaattctgtttcctcatcattcactcttctttctttttattctgtgacattgtccccaggactctgagagtgtttccaaagtgctttggctggatgagatacagcaagccgtcgatgaggccaacgtggacgaggacagagcaaaacaatgtaagccctcacctcctttgctcttgaaacttgcctttttggatttggttatgtgcctgaagtcatgtgatttttaatttctgaaagatttggattcttaccaagttttagttcttggacacataattataccgaaattagttggttgccctattgtcagtgatttgactctatctccaacaaaatgtaacaatgttgctgaacaaaatccagaaggtaaaaaatagtttttaagctctcaaattgtataattgaataaaattctttttttctcttgatttttagagaactagaccatttctacttaataaatgcctttttctcctttccatggcctttatagttaccagggttttccgcagaaacagaaccaataggagacctatggagttggctagctgatcatggtgcaactagaagtgaaatagactggcagtctactcaattcttacttaatctgtacaactggatgagttttgggtcaagcaaacagaagtctaccttgaatcataaaaacagtcatggaccctcaatcaaatcccagaatggggccagtttacaaacccagaacccctcaaatgaagggaaggccaggccccttgaggaaaaactcagctactctaccaaaaatttatactgttagtctttcttccacccctcccccaaagggaccaatggccttttaccagggtgactgtacttaggagaaagtacataatcagacttttgggaattagtggacacttgctctgaactgacactaattccaagaggcccaaaacataactgtggtccaccagtcaatgtaggggtttgtggaggtcaggtgatgaatagaatattagctcagatccatctcacagtgggtccctaaactctttctgtggttacttccccacttctggagtgcataatcggaataggcataatcagcaactggcagaatccccacattggttcaaatgataaaattgtttaaccctctgtttttaaggaagaataacatgaaaattcacatgatagtctgaaatagcttctaaattgctatactaacattctccatatataaattaagattcctaaaaatatatttcactaacctgccaactgatggcataattagaatctattctgttgtatcaggtcagagaaggttcttaagatgactttgtcttactccacagatgggcttttcaacctcggaagcatctgtgagaaacatctgggctttatctccttagcttagaaaaatgtgtgtatttctctaacctgaacttttattccctaaggaactttgaagtctttcctttctagcacgccttaagaaaaaaataatgaagtggaggtgtgtatataagaaatttcaacttaaatataaaactgaaggaagccatggtctgaagagacagttttgagaaagtagattgtaatttagacattcaaatagcctaagatggttatgatttgtctcttagaaatcaaaccaatttagaaggtttttaaaatgttcttatattcattgttcttacatttggcctgcaaatgtcaagttgattctgtttttcacattgagactcatggttctattgactataaaagtaagaggatttctcaaatgtataattttgtactctgtattgcacatctataatcctatcttttcactctgtcctgtcccttaaagagctgatatactttcttttactatatcttaaacagcaaaaaagattttccaaagttaatgctacctatgagaattttctgactttcaacaagaatttgattaaaaacattcttcattatttgcatgaagacttgaaatagattctggtcacacactataagcatcacacacactctcagataatatgataaaagaaaatgtgttggcccaaatatgttaccaccagcaaaatttgaaagggcagagtaactcaagtccctttcattttggcccagtgttcacattcactggagtatcttgcttgcttaaagtagatttgcctctacttttgattccttagagcagtctttctctacctttttctcattatggcaccctaaggaatctttttagacagttttttctctaatcactccttaccatgaaattttaatgccacagatattttgtatacctgtttatgtgccatatgtagacctgtactttatacataaagagatttttttcactccctccctgcaggaactaatttttgccccgttaggggttctatcacctccactgtgaatgtgtgccttaagagagcctgctggtatatggcttaagatgtaaagcaaacattttttggatctcttaggagatttatggaggtttcttaatttgttccttggcagaaacatacctgactttctggagtgaaagtcatctatctgatatcttcaactatctggaacttagctacaactcacagattaagaaaaaaagcaatcaaaatagatatctcaaagcaagcgcattgaagttaatctactttattcactgagcacccctcagatagacactttgagcctgttgattcttttcttaggcaaaactctattatcttggtagtttcttttcctggttggttgtgacttagagcacatcagaagccacaagtcacaaggcagtaaagtgcttaagctgccataggcaggcacaccaatgtcagtaaaaagtgacagctgacagtgaaggaagaaggaaaaactaagaagcataggagttattaaggctatttcgtgcaggagccagtaagcccaaacacctccacagtccttgaaaataacactcaccggattatagcacagcacaattttaatgacaaggactcttctggcagctctcagcagacattaagcacctactttataccatagactttgggtaaaataaggagcaatagcagctgtcctgttaggattttctctaaggcatgttttagagtttcatcgaaaatggttctattaagatgagagttgatccataaaggaattagcttcagttatctggaaattgacctgtgaaccagctcatcgatactcaatgatgatatatccaagaaatgtgtgtcttttgtaatatcttttaaggaaaattgcattttattgggttagatgacactgtcacatgtagttcatgtgataatttttgtcattttcttgttcctattacttttcttggaccacaaacttctcaattgccagtactctattttctctatcctacaaagctttcctggagaagaggaaagggctatgtctacccatgttctattaacctctgttagcataagaacatgctgccataccttttgttcaacaaccactggagtttgcctgagaagttctcccttcatctatatgtgcccctccagatttgcatgactttgactccaggttgttgaaagtcaatctctgtttttctttctcctttaaccctcatagtgctatgcacatgtgaacataatttgatgacaacgaattgtaatttaatatttgtagagtttgatgtacgtgtaagaaaaaaagagaaagcatccgtgtctcccttctcttttcctcaagatgtttttcatgtaggaagtattttaacttggcctctttcatttttctggttctacttttctaactcagtgcatttactggttgtgaaaactctagtcctatcgattggacattcttacctggaattaaagtgggaaataattcactaagttaactttccttaggcaaccaagagtttaatgtgttttgttaatgaggaggggtagaaatttgcaatgggataaaatgcttgttaggtctaaaatggttccagaattaagttttaggactccgttgcacatatccaccagctctgcctttctagaacacttgtttaggttgtttttgacaatcttgctaaatatattagcactatacaagagaataccaggatttctgtaacttaaaaaggattttgcttatcctaaagtaaacaaatgtctttgtaaaactagttctcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttatggactaaactggtctgtgaatttgtgattgtcttgggcatatgtggtaaatattctcaaagggtaaaaatgtttgatactaatgcattcctaaaacgttgaattatatatttgcatgccttgaagtaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaactaagtattttaaatatcatttctgtggtattatattttcttaattttaagacaagtattgctttcaaattaacatttctgtaattttttgtcatctatggctaaggaaattaggaaaagttttagatgtttctttttagttttagaaagctatgatgagctcagtggcaatatatggatggcattaagaaaatgtcatatttgaggagtctgtgccttatacaggtcatgcttattgattcatttattcgtgtgagtagaccagtgatataaacagatgtttacactaatattttctctcacctaatcctttgtgattgcacagtattaagtaggggtaaagagtaattctgaatatatgaaataaagtacaatgagccagcctgcaagggatcagttggcaaagctaggcaactagttatgcctactcaatccaatggcagagcctacattgttagctctggaaagaatctttgagactacacagtttgatactcatttttcagatttggaagttcacattggtaagatttcagacagagggaaagaatggtagacccaaggacaattaatttttattccagaattcctttagtagatttttattaagcacctactatttcctagtgtcaaggatcaaggtggctgtcaacttctaggctagtatttatttgtaccacattgtaggtcatctacaggatactattcatctttaagaaactagtgtgacagtgtgtggccttagaagtagagcttaaggaaaaaaaaaaacttttttagtccaacttgatgtttgtctagtagtaccctatgtacttgttttcaagtttcatatatttccaacttggagattccaccttaaaattcagttaattttctgttaatgaaatgaccactctcttacttggcatctggtcacccttgagtccctctctgttccattcagatctcttcatcaagaattactgtaatgtcccctgtctcatccttcattgggaaagaattgcataattgtataaatgagctatcctaatttcaaattcatcctggaaaaaacttagttcatcttctgtctcctaaacttgctatgtcgtttcccacatgtcatatttgggtgactatagtcaaatccctgtgtatccaattcagaaacctaggaagtgctttagattcattcttctgggaagaaaaaaatggcagcaagacttttgtcagctgagatcatattgaatctgtaggtaaatttgagaagtcttgccatcttaacaatattctgatccatgtacatgggtatctttccttttaatcaagtttaaaactctttcaacaattttttgtagttttctgcatataaggcttgcatttgtttcattaaatttattcctaagtattttatcatttttattttattgtaaatattgttttttaattatattttgggattgtttattgctagtttatagatatacaattgactttttattgagaaataatttatatgccataaaattgtccttttaaggtatgtaattaagaggtttttagtatattcacaaggttgtacatccaacacctctagttaattccagaacattttcatcacaccaaaacaaaacccaatacttattagcagtaaatccccatcacccactccccagctccaggcaactactaatctactttctgtctttggcctattttggacatttcatgtaaacagaattatacaatacatagccttttgtgcctggcttcttttacctagcataatattttcagagttcattcatgtagcattagtcagttcgtccttttttgtggctaatattccattgtatgaatatgccacattttgtttacccagccatcaactgatggaacctgtattctgcgccaccccctccccccaacttttggctattctaaatgagactgctatgaatattcatgtccaggttttttcatggatatatcttttcgtacaactgatttttgtatattgatcttgtatcctacaaccttgctgaactcattctaatcatttttagtaaatttcttgtgctgccatccgccttaataaataaagtttcactgaaatccagccacacattaatttatatatggtctatggctgctttcctgctgcagtggtagtgctgagtggttgtttcagagacccatagcctgcaaaactgaaaatatttgcctttttttttttcttttcgagatgaagtctcactctgtcacccaggctggagtgcagcagggcaatcttggctcactgcaacctcagcctcctgggttcaagcaattctgcctcagcctcccgagtagctggcattacagttacctgccaacatgcctggctcatttttgtattttttagtagagacggggtttcaccatgttgaccaggttggtctcgaactcctgacctcaagtgattcacctgcctcggcctcccaaagtgctgagattacaggcatgagccactgcacccagcccctactctctgactctacggaaaacgtttgccaacccctgttctagaaagaagagcatcccaagcaattaaagactgattctcacctccagatagagctatgagcattgttttcaggcacgcacaggatgatttattcttatctctttcacctctggttctaggatgtcttatcttttcccaaactgaaacatctaccatttggtggatggattactcagccttgtaactcagtttaacgcttctatatgttcgcgtataattttgtctgcaaggcatctaaaaagtatgcctccttgtggaatgttcatcacctcttaactaacggtaatcagtcttttttctaagtaacaaaccaactgtatttcttaggaaaactatttggagcccatgctggaaagtagctctcctcagcctctgatctaactacattcaaactagatgtgaaaaatgtaggaattctactttcctattacctactgacatcctaacccaagtaaagccttctaatgccattcagatctcttcatcaggaattactgtaatgtcccctgtctcatccttcattgggaaagaattacataattgtattaatgagctatcctaatttcatattcatcctggaaaaaacttagtttatcttctctctcctaaacttgcctgcttcttttcccacgtgtcatatttggatgagagctaaaaacacagaaaaatataagaagttctaacttagactaagctaagtcagctgctatcaagtgagctttagactcattgcctttccatgtaaatcaaagttcaagtgaattgaccattggtgattgtcttttaaccaactaacaaattttttacttctcagttcaagtgacgggagaaacattttcaccagctttgcttgctttctttccttcccactgagacagttgccttaagaagggtgattattcttctgaaaacatttatgaatctgacaactattggtaattgaaaatatcataattggctggttgtggtggttcatgcctataatcccagcactttgggcggctgaggtgagcggattgcttgaccccaggagtttgaaaacagcctggacaacatggcaaaacccatctctacaaaaaaatacaaaaaattagccaggtgttgcatgatcctgtggtcccagctactctggaggctcatctgagcctggggaggttgaggctgcagtgagccttggtcacaccactgttctccagcctgggtgacagagtgagaccctgtctcaaaagcaagaaagaaaggaaggaagggaggggagaggagggtagggggagggaaaggaaggaagaaagaataataattacttgtaaacatcctaacttgactgtacaatgtattttctagtagaccaatgtttctaaacagatgaaccagctgtctggctgcccattgaaaagagatacatctctcttcctgggcattgacaaacagaaagaacaggtgaggggcatttaaagccaaatgaagcatcaacacatattaaagagccttaaagttacccctgcttagttatttacatgcatttcaatattctgtgaaaaaattcacttgaactttgatttacctggaaaggtaatgagtctaatgctcacttgatacagttgacttagcttagtctaagttagaacttcttatgtttttctgttgtttttagctctcaggtctggggaccagaattgtaaccattcaacaaaataaacagatttctaaatatgaagtttagcccatggattcatgaggaggagagattcttgaccaatctaagtcatgactaccataggattttctaacaccccttccccaaaattaagtttcaaaaaaatttttttctcatttcttgtggttgcacagcacaaaatgagtcagaggaaccaggaattttctttttccccactttagttgacctttgtgttgtgcatatgccattttgtactttgagtaacgttgtctccaaaggttctgctttggtttaatgccgaacattggccgtccttaaataagggccacagtccttgtgggtatctccttattggagaaattgcaggtaaactttgtaagcaaagaggatcttgccgattggtctcctttgtctacatgtgttgtttgcatctacctgggacttataattattgtttgcttttccttctctttggctgcttttggccaaacatgtttttatcatcctcatgaaagatttaagttccagagctagccttagatatttgtgtctcttccttttctttgggttagcaggcatctgccattaaatacatcgaattcattccatgttagtgggtcacttctgatgcctttggctgtctgaaggtttggtgaaaaacatattcaattattttacatattaaagaaactacactaatgtttaagggttcactgtgtctgtgtagaatttaacaaacttttttctttagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggtaggaggttggtgtttgatggataactctactgtataaagttaaatttgactggttttctatttctgaatcatggaagtgatgagaggaactaactgatttatctgaagtctggatatgtaataaagtcttcatgaactgcagttgaatgtggctgcattgttactaatgtacagaattttttccatattggcttaacaaaaccaaatagagcagggggaagaaatatttcactatttatttgggatggtagattatcctaagaaatcaatcttaagattttccttgacttaattaagctcaattaatgataattcctgggttgtcaatatttaaaaggtatttctttccccccatctcagcctgcaacttaacattgtacctttcaaaccaaaatgtcatttttttctacaaagtgctggagagggcatctctgccacacatggccccagccatctccaggacagcttcggaagcaaagaacagagttgggcaaagagcaggatgggtaaacattaaatgtttgcttcttccgagatggtcatcttagcatgttttcattgcttaacatttctagagctctggatgtacccatgtccaaatgtaagtgcaaacatcacaattgagtgtatcttatactttgctttcaattaactgacataaaaattagccatgtgtccatgtattgtactaaccaagagttaaacaagatacattgaactggaatttctatttaactactaaaggtcccttttaactaatctgtgacccatatttgaaagctttcttctaccagattttacttattgaaagcaatttatccctcctctcatctctttttaaccaaactatataaatagtacctgtttgagcttcttgttaggagtaaagaaatagtgcattagtgaacatagtgtcattattgactattaggacgtttgttagtttttgtttctctttttgggggaacatttgttattttaaataaaagaagaaactcatttagaaaagtctgcattaggtgaaaccccatctttactaaaaatacaaaaattagctgggcatggtggcgggcacctgtaatcccagctacttggaaggctgcatcaggagaattgcttgaacccaggagatggaggttgcagtgagccaagatcgcaccattgcactccagcctgggcgacaagagctacactctgtccctgggagggaaaaaagcccagaaaagtctgcgttagaatctcaggttcagatgctttttctcgttataaacaagactggctggagtctcaggggtcctcctgattcccccatgtgccttgtccattgtagtcctaattccctcccaaatattcagcaatttttatatatataggagcccagggctgaagtatttacaaaaaaagataacaagagcaaagctaggagaaaaagtacagccaaaagagctattttcagtttcagttctaggtcactgaatttcattcattttttagttgcccctccctacatagaggaatgagaggagcactttgacaatagattatttgcataatcatggctttgttagatctgaatattttcttgcaacatgggaatagggaactaaatgcttggtgaggctttcctgaaacaaaagacttagctataaacaggtagtgaggtagatcttgccgaatggccttgtttgtgaggtggttctttgctttgtctgaagttggtgggcagccatgaagaaacaggagggggtaaagtcagaggaatgtgaaattggaatcaacccttgtagcaagatgtctgaaacaagttatggccaaaagtaacctttccaactggtgtctctacaaatacccaaagaatgtgtagaactgcgaatgaggtctcctgaaaccataaacatagccaagtacccctcattgtatggagtttcactttccaatgtactttcacatcactttgatccctaaattatcctctaagtagagatagagcaaatattctcatcttctatttttctaagtgaggaaattggggcacagagtaggtgaagcagtttgtactaattctgcaatttgtgtagattttgtcaataaacagatttatttccagtgcttccaacttctagtctagtatgttttccactttttgcattgtttttgacacagtcaccggtatctctgagtggttatatcatgtgcccattgctctggaattaataacataagttggtggcttaagaaatacataggtactttaaaaagtgagtaatgcttcctaggaggaatactcttgaaggaatattcaccaacattgctttggatttaaaaacaaaaacaaaagttggacccaaaggatgtgaaacctgctgataatggatccacgcgtcataatatgtttaaagaggaaatactgatgataattaagttctattttgggaaaaaacaagaacacatatcttatagaatcgttaaaagtcagcatcaaagatatcgcagtgtggcagtattgcagacagaatcaccaatgcagtatttactaaaacttagaggaaaaaaacatgatctgagtctgaccaatgctaccaaaaatacttaatgacaagaagatagtgaagaacacagtttattgactcatttcagttgttcagaggtcgtacaacttttaggaaaacgacattgtagcaatggattattagtgctaattttgaagaaaaaaatgaaattatagacatactaaaaatttatatgccatggttgaaaagatgtatcaaactataaagcagcagcatcgaagatttaaaatttagaataaaaattgatcatgtggcatcccaagatataccccaggtataactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctctttaagttaaccaaccattaattccagttgtactagataagagtcatcagctgtagaagtgacagtccagtctttctttgcatctctcatcgggcataaaagtaaaccctgttcataccccacatgaaactttcttataacccccttcttccttttttctcattcttctagatttctgctctctatccttaatagcacttatcttgcctctcccacccctttgtcttttgccccagagcatcattctgagtttggccacagctcgttacaggggtctgcctactctggcctggggaagaaatgggaaagaagtctgaggaccttatggccattgcagtcttttccttggcagtccgagggaagcgggaggtgatgcatgtttttacagcaagcatccttgtccctttacattctgtggagctcaggcctcatgcctggtccttgccagcatcatccatacatctctgcctccaaatcctgagatcattgagctgcattctcttgccacctcagcaccaagctcagagattccaaaatcatattgctagaaagaagttaagccagtttcatccctcagctctgcttaaatttgtttttaaaccaagccaaaaggagacatccatattattttctaaaagataaaatatcagaagctattctatgtgtgcctttcagctgatgtgtgaagtgtaaccataagaaatatctcttgccaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggtatgtggatcacctaccactgtttacacaaaactgtcatatcacctgaaaatgttttatttgataatagaatagtcaactaccagcattcctataaacaaatctgactgcatatttttacataatcagtgcccctagtctacttcactaaggctttaaaataggaagcattttgatgatgaatgacttaacctatggtcttctagagagcatttaggagcaccgcagatttgcacagatccacctgctgccaacctagttggacccaaagggatataccttggatcagagttgaaatcatacctgacttggggactttacaatttggcttttttgtggttagtagatgttgagtggcgtcttagtttctgtgctgttctagcctgaaagaacaggagaactaatgaaataaacagatttagcctctctaagaatgtcttctaccttctgtaatctgtcactcttcatttaggccttcaggagaaaccttcattcccaatttttttgctataaattgttcttaagtttgcatgacttgtctaaactttctgattggcaggagaatttgccaggtttagatgtttctcttctgtattcctatagcgccccctaccagtcaccacactggtttgtgaaaggctgtgagtttgttctttttattgtgagttcaaaggggtattattaacaactggtaaagtctgatgctgatgggtttttactttgaagtttcctaaattgaacatttttctgttgaagaccttcttttttgtgtggtcactggtgaactcatctgcttttcccacctaactgtaatgtccaaggcagaaaatgaattttacaaacatttgtcttcttgtatcttgcacatgataggtgcttacatatttaaatttgcttggagcttaagatattattagcaaagcagaaataattaattttataaaagaaatttctactataaatctgacactcaaaggatttttctaggtgggccaatgagtttacaatgtattcctttaaacaaatagtaggcaaaacacacaggaagtgaacaaaagcctaaaaatagtcatctacactgatgagactctaattttgcacaaatttcacgtgtcagccaatataaaattgggaccccacactctccagtctcaggtcacacagcagtgttgcagttggaagatataccacagagcccaccagtacagaatccctctatattagaaaccagggctgaaggatgagagaaatggggtaaggacaggaacgatcatttggagcctttttcctccacctcagcagaggcaaaagaattgacgaagcagccatcaaaccatgaagtcacctcaccacgcctttttttcagtcttctgacaattttccaaaacagagggcatgaggcctaaaggtaagcctactttacagatgtggaccagaagtgaataatacagttaataggaacctgctgacccataaaaccaagagactgtgaaccaaaaggtgtcatgctaatctcatttctcaccaaagtggctggttcaccttcaagtaggaaaatgttctgatatctgagaaggtcccctacgtaaaacactgtgagcttcctagctggctgaactgccccccagacacagtagtcttaacacatttggagagaaatacaaaggcaaaactcctaggccgaggccagctatactccggctacaccaccctccctgccatcagtggtctgccaaggaaatgagtagtggtacagagaatgtgcagcatgatcaacatccagcattctgtctcaagtgcttatggagttaactgggaggtgcccaggtcaatatagaggaagtcaaggagaatctacatagccatattatttttgagcagttagaagtccccgataaaattgcctgagtgagccagaaaaaaaaatctgttcataaacaaaaaagattttatatcagaaatagaaaaaggaatgtaacttgtaaaatataaatggagtagatatctagagttactcttccagaagacaggagaaaattttatactgaagctgctttatactgtcaaggaatttgataagacatggacttaatgaaataagaagacaatagaataataaaatgaaaagacagctgacagctaaggagaggaagagaaataatgatgttatagaatgtaaatgaatttataactgcagaatgcaaattagacactgaacataattggagcagacacaaaaaacttcagaaaaatccacaaaagatgagagaaagaatagatgactaaaaacacactttctcatctgaaaaatataatgcccattttattgcagggtggtgaagactgactggaataattcacataacagatgtttcctagtatttgcttctcaagtgcttgataaactttagaaatggtaagatgatagagataatgactcagaaggcagataatggggatccaatattgatattgttggtgtggcacaggaaaacatcagaaaaaaatgaaataggattagagtaggtaactacaggaggaagtttttttcatgaactgaagaaagctagtatactactttttaggaaaggacataatagtggcaaacaccaaaacttagccctgagaattaatgaattattgaacttcagctcagggagtgccacaagcatcctggtgaagaaaaacaagctactctgaaggaacttcacttcgccaggagcagtggcagagtctgtgggccaagaggaaggggatggcctgggagagtcggtcctcagttgttttaatgtaaccgactgctcttatagatggctggattttttttacctttgaggagagggagaagaggtaaatgtttagggctttcttggctaaccgagatcacgcaagtattctgtgcatcagaagttggcattggtaatttgaatatctctatactgagtgtccagttatcaagcatagcagccagtgtatcaagccagatttcccagagagtaatagttaaagtctataaaatagagcaatgacctctgaggtctaagcgttttgacagacttcttttatacagatactctgcacagaaaatatatttatggtactagaaaacaaaacaaataagatggctattataaattttcccacaagttcccataccaggcaggagaatgagactgccattttttttttttttttgagacagagtcttgctctgtcgcccaggctggagtgcagtggcaccatcccagctcactgcaacctccacctcctgggttcaagtgattctcatgcctcagcttcccaagtagctgggattactggcatgcgccaccacacccagctcattttggtattttttatagagacagaatttcaccatgttggccaggctggtcttgaactcttggcctcgagtgatctgcctgcctcggctttccaaagtgctgggattataggcataagccaccacacctggcctgtaaatcccatctgtctgtaattttcaaagtttctttatatcaactgtatacccatatttgcttataataaacagcctctaattagagaagagattacaatgtcatggctatgcacaagagttctgttgttaggacataataggaaaagctcatctcaaaggaactaaaacttacagactaaaaaaagaaaaacagaattttggcaaatgaaatatgaggcatgtagtattctgcttctatggaacaaaaaaattcttttattattatgctttaagttcgggatacatgtgcagaatgtgcaggtttgttacataggtatacacgtgccatggtggtttgctgcacccatcaacccaccatctagattaggtatttctcctaatgctatccctcccctagttccccaccccctgacaagccccagtgtgtgatgttcccctccctgtgtccatatgttctcattgttcaactcctacttatgagtgagaacatgcggtgtttggttttctgttcctgtgttagtttgctgagaatgatggtttccagcttcatccatgtccctgcaaaggatgtgaactcatccttttttatggctgcatagtattccatggtgtatgtgtgccacattttctttatccagtctgtcattgatgggcatttgagttggttccaatcctttgctattgtgaacagcactgcagtaaacatacttgtgcatgtgtctttatagtagaatgatttatatcctttgggtacatacccagtaatgggattgctgagtcaaatggtatttctggttctagatccttgaggaattgccacactgtcttccacaatggttgaactaagttacactcccaccagtagtgtaaaaagcattcctatttctccacatcctctccagcatctattgtttcctgacgttttaatgattgccattccaactggcgtgagatggtatctcattgtgattttgatttgtatttctctgatgaccagtgatgatgagctttttttcatgtttgttgactgcataaatgtcttcttttgagaagtgtctcttcatatccaggagcaaaaaaattatattcccagccaagctgcctttgtttggaaacgtaaaaaaactcataaatatagaagaataccagaaaattttacataaatagttatgagatgaaacataataatgagctctcaaggtaaatagttaatccttagtatattaaaaaaaaaaaacagaatggacgaatggggtaattttgccaatgcaggaatgattcaatattaaataatctgttactatgacaggtcacttattcagaatgtttgcgaatctcagataattgaaattaagtgtttttggagtttaggtaattccagaagagcagaataggaacttgagctaattccaattatcttgtttagcctttcagtatggactaaggaaggagtggaatttataatatacattcaaacaattgcacttctctgctttaaaccagtgttaaccaccaaaatataggaactgttaagatccatcacaacacatgttttactggttggactgccatggaatcccagtgacccacgattagggtccacttcccctagtttctgttgtgctgttgggccacttttatgaacaactgttggtgacatcagagaattttgcccatctcagaattgtcacactgtgacaaatcccatggggtagcattttctaaacggataattaatttaaaattttttattttggttatttacatttttatcatttaatgtgtgaacacatacccaatgctctctttgcctggaagattggtaaaagtacaaaatctcaagccttccccgaggcctactgaatcctaacctgcattctgacaagatcctcggatgattttatattcacattaaagtttgagaagcaccgttaagatcactccagtttcaaaactccagataataattcatcttcctgtataattctttatcaccataagagcttaagggagaaaaacccatgtgctcttttcaatagttactgcaaaagcatttgatagaattctagactcattcctgtgtttttaaatgattgcattgaagtttaaggtttttttttgagggcaattggcatctttataataataaactttacagttcaggcattaatctttttccatttattaatctgttccaaactgtaccattataattttattcctttatatttaagtttactcatgtatatttttctgctattgtgaataacatctttattctattgtgttgtttattcttgacatgtagaaaacttatcaattttatattcattttataactagtcaccaggatgaactcttagttctaataaatttttagttgatcctcttgagtcataactaccattgacacttctgatttttttttaaatctttaattttgtcaaggaatagattcacatagccttaataatatagtaagctttaaggacttaaaaattatttgggcttgcctctgcttctggggaaatggaatgcatgttcttttccctattcttccgtaaatacaactaaaagcctccaatattatatataaacaaacataacactcttaaaagtgaagagaaaaaagtcagactaagtagtgaaccttgggacccaaggaatgacatagtggtgagttctttgagttttctttttgtttatatttttctgacctggagctggagaggctggccacccagaaatgccaatgggtacaggctctgatatggtttggctctgtgtccccacccgaatctcatcttgaattgaacttccataattcttgcatgttgtgggagggacccagtgggagataatttgaatcatgggggcggtttcccccatactgttcttgtggtagtgaataagtctcatgagacctgatggttttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctagtgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagaggagccatggcagagaggcaggaccttcacaccatccagttgtaatgaggtctttcccctcagttggtcaattgaggccacatggggagtaataagaaggcacccctactctcccagccagagtgatatcaagagaggtccagtaggtagctggaccccctcccagcaataatgaggaggccttccccaccttagtagtaaggttccttgggtcccaagattcactagcctcctttttttctcttcacctttaagagagttatgtttgtttatatagacagaaaccaaatggagaacctagccttctcctcccacctcctagtaatgaggcagtgcccccactttttccttgccaaaacaatgtcaggaaaagccacctaaaacagtaggattaaataagatccaggaccccaaactaccgacattacctaaggttcaatcacttgactgtttggatattgcaatcacaacaatcacttatgtcaagaaccaagaaaatcacaacttaagtttaaaataacaattcctaggtgcccacacagaaatgacggatgttagaattatctgacaaggatttttaaagcagctatcataaaaatgttaaaataagcaattagcaattactaacatttgaagcaaaagaaagaacatctcaggaaaaaaactaaagcctcagcaaagaattaaaaggtttataaaccacacagtaacttttagaactgaaaaatacagtaacagatgtggaaacccaatgaatagtctttgcagcagaatggaaggacagaggaatgaatcagtgcactagagactataacaacagaaattcccagatctgaacaacaaagaaaaagcagactgaaagaaataaagaacagagcctcagggatcagtgggattataacagaagatttgacatttgtgtcatcggattcccagaggagaggagaaagaggcagtactgacaaagtacttgaaataaaagtggaaatgttccaaaaacacagattcaagaagctgaggaaacctcagacaggataaagtgaaagaaattcacacaaagacatatcatagtcaaacttctgaaaacaaaagacaaagaaaatatttggaaaagcagtgagatagaaacaacttacctgtaagagggagacagttctaatgacagaggatttttcataacctaaggaggccagaaggaagtacaacatttttcgggggaatcaaaggctgaatgaggagtctagacttccaccctcctgtaacaaggcacccagacacttgtagaacctggagagaaaataactgtcaacatagaattttatatccagcaaaaataacctttaggaatgaaggagaaactaagagcacttgttaccagcaaacttccctcaaagaatgactacagatagctctctaaaccaaaaggaaatgaagaaagaagaaatttcggaacatcagaagggaagaaaggatagctagaagaataaaaatatgaataaatacatttttctactcttgagtttttaaagttgacagttgaagtgctgttgtggctctgaatgaagcctgcttcattctctgtggtttctctcaagggatggcgttcagtgtctgtggcttttccaggcacgtggtacaagctgtcgatggatctaccattctggggtctggaggacagtggccatctgctcacagctccactaggcaatgccccagtggggactctgtgtaggagctccaaccccacacttctcctccatactgccctagcagagattcttcatgacagttctgctcctgcagcaggcttctgcctggacacccaggcttttccaaacattctttgaaatctaggcagaggctcccaaacctcgacttttgcattctatgcacccacaggcttaacatgacatggaaggcactaaggcttacagcttgcaccctctgaagcagcagccttagctgtacctgagccccttttagccatggttagatctggagcggctgggatgcagggattactgtcccaaggctgtgcagtgcatcaaggccctgggcccacaaaaccattctgccctcctaggcttcccagcctgtgatggcaggggctgctgtgaaggtctaaagcattggggatttcagttcaacatgagatttgggtggggatgcaaatccaaaccatattaaggcatgagccatcatgtccagttcacatctttatataagtttgtatttgtatttgtgtgtacaatgatggggtatgtgtgtttacacatgtgcgtatttcagaagatacataataaaatgttaaatagtagttgcctttataaagtagctaggtggaagtagagataggtacacaggtatgtataccctttctctttgttcactgtgtattttaatagatattctagatattgaggtacagattgtttgcatagaaatatatagaattattctgtgggttttttgttaacatgtggtatcataatatgtgtggtaagctaaaatttccttttcatattagcaatatatcttagaggtcttcctgttctccaaaatacagagcattgccatagtcagtatatatgaccttactttactctttttttatatatatactttaagttctagggtacatgtgcacaacgtgcaggtttgttacatatgtatacatgtgccatgttggtttgctgcgcccactaactcgtcatttacattaggtatttctcctaatgctatccctccccgctcccttactttactcttaactgatgtgtaacatccctcagtgggactgcaattgcagtgtctctagctgttccccctattagtgaacattttactggatgcacaattttggtattacaaacaatgctgtgacaaaaatacttatatatggggcttttctacacaggtgctttaattttcctgggctagatatattgaaaattagaaatactaggtgaaaggctaaataattttaaatttgatactgctaaattccctccccaaaactatacccttttgtagtttcctcgagctcacacttcaccatctatgctttctttgtccaccgattgacatatggataaggcaagaattttcccaaaattactctgactacctcaagcttaaagccataaaaaaaagttttgacattttttatggaaatttgctctgcctcttcctctttcagttcagttctagttgctttctgttttctaggaaccctcataatttttatctctatgccttcttattttctagcactattatggattgctttaaaagtatgtttgggccaggcatggctaacacctgtaatcccaacactttgggaggccaaggtagggtggattgcttgagtccaggaattcaagaccagcctgggcaacatagtgaaacttagtctctctgaaaaatagaaaaatcagtcaggcatggtggtgcacacctgtagtcccagctattcaggagtctgaggcaggaggatcagttgagcccaggaggtggaggctgcagtgagccatgattgagccactgcactgtagcctgggacaaaatgagaccctgtctcaaaaaataataagaaaataaaagtatatttgtatgatgttaccattgggggaagctgtgtaaaggggtacacggaactcattgtataatcttttgtccttcctgtgagtcgatgattctttccaaattaaaaggtttttttttttaaacatatttatgccttctagggacttggactgaggggaagtctggagcaagtgcccagttcgtcattttgattccatcctgactaaattgttttgactcattacaaaaatattatttttttgaaataacaaaatttcatttaccctttttaaaaagaatgaggtaaatatatacagacatgaaaagaagtttataaaaaaatttgattttttatatttgccctttttaacaaggaacttttacttcctaatttgaaaaacggtatcagaattggggtgagttacaaagatgtttcaataaaaagatgctcataaatgaattggaataaactgtaacagttatgaatttacttcttctaaagatactagtttgtgtccagtttttgtaaagagtttcctgtaaaaattattcttaatggtgataatcaggtaaagctatgttgatgaagcgttgtttaactttatgtggggatatatgaaatgatggtcagttgcagcaccagtgttttcagggatccaagggattcagggccacaagttggtagagcatcctcctttccagtcggggccacagtgggccacgtgttgtggtaaagatacttaatattaggcattattttcaagcattttttgttgttatcaaataccactagcacctagttaatactgtttatgggttttggagaaattccattttattactcctttttgccacccagggccttggtaaagttaagctttccagcaggaactgtgcttctccatgtaatttatcacccttactctgctgtcctaagcttagaactagtctcagctgtgagctgatgtgctctgctgtgtttaactggctacccccagagagggtgtccagatgagatctgaagggagggtgcctgacagtgccccagctccatgcggcctgagatgtgctctgctcttgcacttcctagataaattgggaaacttgctggtaaataattctataacccactcttttccttaggctttttggaaaggatataaacaacggaaggagtatatgcacaggcggcaaacgttcattgataatactgattctattgtgaaggtaaataccctttcctaccataccaagtgcttggcttaaacgtttcccctcatttcatgtttaatctgaaagacagctatagaaagggagggtacatgtgagccttgaagtcagaaggcagtactggatttgaatcccagctctgctgctcatttacctaatcatttttcaagcaggttggttaaaccgctataaaacctcaagtcctttatgagtggttatgagaatcacaagtgaaagtgttctataaccaataaatgttctttgtctagaaagttcaagttgattatttagactttaggtagaacccagctttttttcatgtttctctttccacatttgcttaagcatatttagaatgctcagacataacagaacaaaaccaatgataagaggaagtagagctaatttagggcctatatttgggagctgaattagtcgaacccaggtgaatagctctgggtgagaaagaaagggtactgtgatgtccactctcatggatctgaaagccagaggactggacaaaaatcaacttggaaatctacaacttggagatctacaagtctccagcttggaaatccagatgagagtggaagcaatggaactggaaagtagaatcagattagtttaaagatctttcaggccaggcttagtggctcaaacctgtaatctcagcactttgggaggccaaggtgggaggatagcttgagcccaggagttcaagaccagcctgggtaacatagggggacctcatttgtattttaaaaaataataataaataaaaacaaatttaaaaaacgttttaaactgtgaagacagagaataatgtgacccagatccattgtgcagtagctccttgatgaaatagcatcctatggaacatatgcctattctgtcaaaaaccattggtagcaattggtccctcatgagacctcttcgatgttttcctgtaaaaacttaaaggatattggatgcatttaaagggatgttagaagaaaccctagacttagtttacttgatttcctgactcattgcaactctcagcaaaacgcttcacccttctggcttttatttactgagtttaaggtaaaatagtacaaagttaaattattttccccacttctctcttattaaggtggtgaaatttagagtaacatgtaaagcgttttgaaccccttaagaaacctcagtgaaagatgaagagtaggctttagagattgattattcagtgggctgctttttttctttatcaagtatcattgtttttagaaaaactacacaaaaccgtattacgggttgtttggtgattactttgacttttctctttattttttgttgtacttttctattttttaaaacctttcagattcagtcctggttccgaatggcaactgcaagaaagagctatctttcaagactacagtatttcagagatcatgtaagaaaaatgcctgtgggattttatccaggttgataatgacctaaatgaatgctttattgaaagttagcattgaatgatttttattgaatggtgaacatgaacacttaagaaataatggatcttagaacttcatatgataatatttggaggcttactgttttcattcagaaatcatgttgagagttagacttcaccagtcaggactcgatagaaaatgggtgaggggaaaactgtgggctagtaacaccaaagagaagactctagagaaatattttacagcattgcatatgtagttttttcaactgttaactgcttactttaaatagaagcccctgggagggatttcttcctgaatctttaaagaagagatatgggaacatagattggatcatctaagttgtgtgctaaaattattttccctttttagatctctttgtctaggcagttcccctacagtcttgtttgtacttttagctgacttatctgacctcttcttcaaagaaaatggaaaaataaatgttgaatacaccacattgaaatactgtcagttctaagtagtgtcagttcttaaatactgacagttcttaaatgttctaaattcaaaaataatggagtaggtgggactctgggagatcaagacttgtcttaatcttttgcagaataatgaaattgtgaaaatacagtcactgttgagagcgaacaaagctagagatgactacaaaacattgggtaagtgagagctttctgaaacaaagcaaggattttttataaaccaggcaaggacatattggtccatattggtcacttcagaggctgctctaagaacagaggatacccattgtttccagtagattttgatcatctcaggccccaggttctaaaccagtacacagaggaacacatggtgaaaggaaatgggccttcctattaaatggaagggatcagccacatggtataatttcttcttcaaagagagtggagttggcataaatgctgatttttttttttcaatctaagcgagagtcaaaaatctaatgcaaaagagttagccagaaaataaccttatatttaaattgtttaatttgttagacatagtctcatctcccaaaaatgacaactgcaaatatcttcctacaatttcattttgaacttttcacagaataatttttaatttttgtttgtttttgttttgagacagagtctcacactgtcgcccaggctggaatgcagtggcgcaatcttggctcactgcaacctccacctccccagttcaagcaattctcctgcctcagccttccgagtagctggggttacaggcaccagccaccacacccagctaatattttgtattttcagtacagccggggtttcaccatgtgtgccaggctggtcttgaacccctgacctcatgattcacctgccttggcctcccaaagtgctgggattacagattaaattttttaataaaaatttgtagaaagtttgaaaatagcaaaataaaattcacccaaaaataacaatcacattttgtgctatctccttacagtcccaactttgcctatgtttgttattttggttttttacagatcataagttgattctttatatactaaatttttaacattctaattatcacgggaacatgcacagtcaaggagagcttgatgataaatttactagtacttacagtgcctagtaagtttagccagcaccttttattgtctaaagtttgtctgaattaagggatgaagtatatggctcaagaaagatcttccctggtacttgttaaggaaaatctagggacgcttgaagtcctcactctgcctccagcctgcagaatctactgaataatgtctcattccactagattccagctcacctctcagctggtagatatgttgttgtttttggggttttttgttggttttttttgtttgttttttgttttttgttttttttttttcttgagacagagtctcgctctttcgcccaggcaggactgcagtggcgctatctcctgcctcagccttccaagtagctgggactacaggcgcccaccaccgcacccagctaattttttgtatttttagtagagatggggtttcaccgtgttagccaggatggtcttaatctcctgaccttgtggtccgcccgcctcggcctcccaaaatgctgggattacaggcatgagccactgcgcccagccgtttttggtttttttttaaagaaggctaaagaggatttttttttctgagccctaacactaaaatatgtttgctgttgcttttatatatgaaagatgacttcaaaataaattttccaaatgaacacaggctagttttcattttattcaaggtaaagtgtttttttttaagcagttatagtgatgttttttgtttgtttacttttttattacaaagacaaattccaattttaaaatctaggcaactttatattggggcataaaaggtaaatagagaaaccatctcggtgagtgagttagatctaagcttctctgggcttcagcaaattgggtgcttttatggtaaccaaaacataaattttcatttctttcttagttcagcatctttagaaaactaaggctttgggattttctaatttaaaaaaaaataacttttctaagtttgttatcatctgttctcacccttttattctggaatgtcactgaacgcattccagcttgaaagatgctgaaactaagatgtggtcagttgtaggagcagactataaagtggtctgatttcctgaaattaaaatacctgtaccacaaagtcattctcagatgaagatggcaaaaagcctagtattgatagaggaaatattaaattcgagccataacaattagtaaagctaaaatactaatttagttttttccgatgggactgttaatacatatgaagagacacaacccttagtgggtgggagaggcagccatcaactctggccacagtgggagggctcatgttcccctaacttggctgcatggatgagcggtggtgcattgctaaggccttccctgaagtggtcatgtcagtggcagcatctttgctggaaatagaaggaaaataaattgatgtgcttcagtggtcaggaaataaagggtcccatgatccaaggaaaattctccaataaaggccatttatgcagttgtttgtggtttatgcagttgttttggtgttagttttcttactcctttagtgtcaaaacaccacagaactaaggtggaagtaaaaggaagactgtcaagggcctaggtgtaaaggagggcaactaatgagatggccatggctggactagctcttccaagtcatctttctattactgggtctaatcattcgtcctcaatggaccagacaatttattcttacagtttacccagatctgatctccctaagcatgttaaaaatatttttccaagagtcagagtgccaggaaattaaagcctaaagttccaggtactaaggggaaaacccttttagaatttatgtgagaatgtccctctcaataacaggggctgacccctagattctgagcaccctcccttggccggtgctcaaaggacaagggccaagtttcaatttctaaaatctttttatttcagctaagtagaacattcgttttacttatcattctgttggttcctgtttggcttttacagtcctcccttcctggcccttttctaattcagctttcacctacttccggctccttcccaaagatcctttgggctgggagaaaccactttctgcttcctgcagcaagaatgtaagtcacttatctagctcaagcacaaggtctcagggtcgaggtaacttatgttaactttctttcccaggttcctgaggaatgaggcacagataggactatcttcttagcgcatgagtccagggaacagtgtgagagagagctgataaaagggataaaaggggagttgataactagaaaagagtggggccagatatctgttttgtgcgtttatttattgatcagtttccttgtccagattttaaattgtgtgggggtgggtagaatgattctcaccctagaccaagtactttcattggtatatttttctagtaattatttaagaccttgtttctttcctgttgataatcattccaagctttcctaattaaagtatacctgttcctgtcactgcagttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggtcagtggggtttttgggactgtcagctcccagaagagggaagacgcctacatacagtcaagagtcacttaatgacagggatacattctcagaaatgtagcattaggtgatttcatcctgatgcaaacatcatagagcacttacctaaacatagatggtggagtctactacacatctaggctatatggtaaaaaagcctactgctcctaggctacacacctgtacagcttgtgactgtactgaatactgcaggcaattgtaacacaattgtaagtatttgtgtatctaaacatagctcaacatagaaaaaatacagtaaaaatatagtactataatcttataggacttatgtcttatatgaggtccactgttgactgaaacattatgttgtttgtggttatatatgttcatgacactttggtctagctaagttcatttggaatctaagataagtttttatcgtttttattataaattagtggttcttcgtctgtaaaattttaagcccgcccatttataacattttgtaaggcttctttatcattctgaaatgaaatctatatgataaaatgtactgatgtatataccttcagaataagactagggcctttatatgaatacaaaagagatatttaaagagtaattaataataaaagcacacattttattgagaaaatgtatatgcctgatgacactggaagacatgatacagttaccagaggtgtagacctcttcacagaacagctacagattatgagggcttcagtggcaaatgaggcaggaactcattttccaaaatggagaacaactatttgtaaagttcaacattagccaagtgtagtctccacccaatttacatagcagttgcaattctagaaaatcctagcttttgtgtggggaaaatgtattatgcatctacataaaacaattagattctaggctcagataattacaaacagaatcttgacccacgtaaatgaccagtaagacattcaaaagttctgtcatgcaaggtgagggcaattatttacacaagaccatcccacaaattgccagatcacagagcacctctcatccccaatccctgctcactagaaaccaagagtgcccttcaattgttaagatattaaaaaacacccctacgtatttccaaaatgtgactccctacaaagacacactgcccccgttatgcccccattgataacttctaaataaattacggtgtggtttcacatctgtgtgaaacctgccaacatcagggctcaaaaaaaaaaaagtataaaaagtgtcatttttacccaagaacagatgcctaagaccactctccctgtccctgttcccttcctatgtgccacatcagttttcagaaaactgataggtcaaagagggaaactgatcttctggaagctctgagaaggctacagtggctcatagagcgccagcggccagcaaccaagcgaacgttctggacaacggggagatgagcagccacaggaggctgccagttacatgggcatgtgaatgccccaggctggtcctccagacctcataaagacaccagggcaattgtggaggagaaaataagaaaaacagcattttataaacagaaataatcatctcttctaaatattcaggaataaaactacagtttaaatgttctacatttaactctacttttattattttatccagaaaaacaacagtactttttaaaaaacaatgttatttgtattgtttgacatccatgagaacttttaaagtgtaatatattccagaaggattttcagagaatgctttttatagccttaaactgctgtttcacgctatccccataaaatcataaacaggaaatgtcttgccttttaaaataaaggcttagttgcaaatcagtacatagtttaaataatatgtatcttttggaaacacaatcatggcaagttatcagatttttatgaatgcttgaggttttgtgggggttttttaaagccacttatcactaatagataacattgtgaagtttttcaacatatttgcaaacaccagatatgtatccagcattttttagcggttaaattaatgattattaaatatgtagctgttagccttgtcattgacagaatattagtagtgatacaagaacagagcaattgaagctttatttatagtagtgaaaaagtgggaaacgacctgaagcccaaagcaatatgcagagggcgatagaattagtttaatatggatgttgtatagccactaaaaatgatggtttttagactattttaaagcaggaggaaaggtttgcgatatagtagaggagaaaatagtgcctaaggtagtatgatttcttttattatcaaaaaataataatccagaagaagaaagaagttaagtgatttttctttgggtgatagttaagtttatcttctccccctcctccccacacctttttatttttaacaatgagtgtgtgtttagtgaggaaaagagagattgtaaagggaaatggctttgttcttatagaacaatgctagctcttgctagtaaccttaacattttttatagttcttttaaatcagcattcctcctaaaatcctcaaaatctgtaggtcagtgaagtggctaacattggttttaggcaaaaagaatggtttggagaaagaagacagagcaactgaaataagaggtttcctggaggcacaggagccaaaaaataaaaaataaaaaagtataggtcagcctagctggaaggaaagcctaaattaagagactgaagctaatctaaaactagtgctaaaattcccattcatgagtatgatgtatcatctaggagcccagatttgcaggccagtactacctgaaactcaggactgagatttttaactattaatacttaattatactacttcactgcttatattaacatgtggccttgagcatgtttcttaacctctctctgagtgtgttttcttccctggaaaatgttctaggtgatttacatatatttttaatcttcacagcaactcagtaaaattgctgttattacactcactctacagatgaggaaactgaagcttaggttaacctgtgtaggtttaccaagctaattatactctgcagatacccatatcttttatgactccaaagcccaagcccaagcccttcatactagcccacactttctacaaaaacgtttatatcatagcatactacctgcatgcagatatccctttatcagagcaaggggaaaggtggtggcaaaagggcaatactgagatgggggactatcatgaacaagccaaatacggttgctctttcaaaccatggtattcctccaatgttcaatatttattaagaatcaggaaaagtgagttttgatgaataaaaagtatctgcccctgtttgttatccttgtctgggttggctcttgtgtccatcttcaagcttcccaaagcaaacctccattcacacaagcacattctggagcaagtcagaacctcacagggagaaggaagaggggctatccccattgctgtgccgggctctgtccttggagctccagcagacaggtgctgttccatcagcacagccaccggcccgtcctctctcttcccctttctgggttcagcattgcctccgttgcttccctccctccattcctctcattatcctgccttcaccaactctctctgtttctaatgcagaggaatttagatctgccccagatcttgctcaccacccctaccctctcatctgtatatggcaaaaaccattaaccagaagatgaagtctgcaacaaaacaaaaagcccccagtttctagagtgacctccactgaaaacacttgggagggaaaaggggggaattataggtaacaagactttcctgtcgtatatttaaaatcaaggtgatagatttattctgtgtatttgagggagttgaacgatttacatacatgtcgccagctatctgaagaggaaaaatgtggattaactggcactgtaagccacatttattctagtgatgtcttaggacttcttatagataaggattatcagacagccgcctgcctagattcccccttgacctctatctggtggtaactgcacttcctttctttgtactgaagacattttatatattggtaaaacaagggggaaatgttgcttttttaaaaatgttatcggaatgtaaatcaactcccctccctccttctctataaaagcaattggggtgacagaagtaagtgggtaagtcaaggctgcctctctctgaattgagaatgagaaagaataaaatcatggacctggaaggcaacagatgtagccacatggaactgtcttactccagagcttcctagagctctggaccccagctgctcaatgggctgaccccagctatgggagaatggggtgccaggaagtaaacagatttagagcttgccatttaggcaagacctgacggtggttctcatccccaggggcaactggaaatgggggcgggcccatgtccgcttgtgaaaatgactaggggcccctgctgatagccggtggtgggaaggggccagggtgatagacgctggtagtgcatgcagagcaaaacactgttgtccacactgcccatagtgcccctctaaggacactgggccagcattcctgatgtgcaaatagagtcctcacgtggaggtccagctaagagctcagtcaaaaatctgaaaaaagttttaggaaaagcaactttcttgccacttactctgggacagtgaactaatgttaagtggcaggggaggtgttctagaacagcgactttcaaatatgaaagtcgcatgccattagggtcatgaaatcaatttagtgtgtcacaatgagcaacctttaaaagtggaatagaataaaagcaaatagaaaatatcagcatgtaccattagtgagagagagggtgtatgtgtgttcactaataaaagatggaaaatgtatttcttactgcgggtcccagacttctgagttgccagtaccacaggcatgagccaccacacctggcttatttttaaaatttgtttgtagagatggggtcttgctctgttgcccaggttgatctcaaactcctggcctcaagccatcctcccatgttggcctcccaaagtgctgagatcacaggcatgagccaccacacttggcccgcttccaacttttcttccgaagtttcctggcttctcttaaggcctcatagaattgaagaaagttagggccttgctttggattaggcttaggcttaaaggaatattgtgctggtttaatcttctatccattccactcaaactttctccatatcagcaataaggccattttgtctttttaatcattcatgtgttcactgaagtagcatttttaatttctctcaagaaatttttctttgcattcatgacttggctgtttggtgcaagaggcctagcattacgcctgtcctagcttttgatatgccttcttcactaagcttaataatttctagcttttgatttaaagtgaaagatgtgtaactttcacttgaatactttgaggctatcatatggttattaattaacctaatttcaatatcattgtgtctcaggaaatagggggcccaagaagagaagagaaaaagggaagttggtgaagcagtcagaacagacacatttattggttaagttctatgggcgtggtttgtggcaccccaaaacaattacaatagtaacatcgaagatcactgataggctgggcacggtggcttacgcctgtaatcccagcactttggaaggccaaagcgggtggatcaagagggcaggagatcgagaccagcctggccaacatggtgaaaccccgtctctactaaaaatacaaaaattagccaggtgtggaggcgcgtgcctgtagttccagctactcaggaggctgaggcagtggaatcgcttgaacctggcaggcagaggttgcagtgtgctgaggttgcaccactgcactccagcctgggtgacaaagcgagactccatttcaaaaaaaaaaaaagatcactgataacagcgccccgtaatagatagtataataatgaaaaagttctacatattgcaagaattatcaaaatgtgacacagagacacaaagtaagcacatgctattggaaaaaaatggtgacaataggcatgttcaatgtaggattgcacaaaccttcaatttgcaaagaaaaaaaatgcggtatctgtgaagcacagtaaagcaatgcacaatacaatgaggtatgcctgtatttccaattacgtgtgtttcaatcctatatgtgaagggaggagataaagagtatgagaattaaaaaagcagtaatctcatcaaattttttacaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacaggtgagaacaatttatcgttcactctgagtttgggagtaatactatgttacatgtttgtggcttacagggagtattttgtcatgcttcagctataatagcatacatgttttgagcatctactaagtaccaagtgctgttgttggtgctttacatacattatctcatttaattcttaccataaccctgggagccgtgagagaatgagtactgttgttattcctgcattacagatgagaaaactgagacacagccagtaaatgataaagcaggggttttgaaacgcaggcagtttgacttcagagaccatgctctttacagtattatactacggttaccttcagaaacaatataaatctgataataacaaaacaaaaacaggtgctgtcatccatgaaaaaattaaaataactgtatgtgaaaaacagatatttaccagaaccagtctccccttctatgggggaagagccagagggtttgggatttcaaaataatatttcttttttcttgtattattttcatggcattactatgatctaaatgaatagtaattttccattgcttcctgagtgttggtgagaactgataagtttgactggttatggttggactttgatggatcacttattgttttgtttgaccattgattcagcccgtcagccctactagcacatacagctagtcacagaggaaactgcatgatagcaatagaaattaacaagcatcctcttcagcaggaaaagtttccccaaagaggtggatccatagttctcccttgtaagagtcagatgtctctcagagtggggccactgctgggattccttcaaagcctggagatgcttagatctttgtttgaggatgtcactggcagtagatgtatagagagcacattacacaaaccataaataagaggcgtggctaacctcatggagaaacacgatgttaattttggtaggtttgaaaattctctacttggaataagagattggagaacatcttcaaacatacgaacatcttcacacaagtggccaccacatggcggcacagaaggaaaaggttaacagtacttagaattgtctgtggaacccactgtttcacgccagcaaacctagaaagaaagggggctcactttaaacaggaaaggactttggtctgcctaatttagtagtcaaccaccagtttgaaatttaatcttaggcacttatcattttttacacccatgaaatttcaagcatattgaagattctttagaatttagttttctcaatttgacagaatttgtcataagttaaaatctagtcattgtttattatataggtggaggcacatttatgggaagaagaaaaagtgcaggagcatgtttagaataattccaccaaacttgatccgcaaacaatccaaaatgtacaaccaaagggtgcaaccattcagttgtatcaagtgaactctctcttgaaatcatatatttttcttctccttctcttcttttgaggcgttagcccaatatcactaaagaaattatagaaaagcaaatggcctggattccttcgacccgttggttacactttagcaagacttctttttttgtagagacaagatgtcactctcccacccaggcaggagtgcagtggcgcaaccacagctcactgcagccttcatctcctgggctcaagcaatcctcccaccttggcctcctgagtagctgggactacagacacctgccacaatgcctggctaattttttcatggtttttgtagagacagggtttttccatgttgcccaggctgatctcaaacacctgagctcaagtgatccacccatctcagcctcctcctaaagcactaggattgcaggcatgagacaccacacctgacctagcaaaaattcttaaccaaagccgcagtcagctagtataggtttttggggggtttgtctcttcagtatgaacctaaatttaaaatttttaggtaaccttaggaggaatggtgagtaggcatctttctttagttatagagtaagtttcctttctcctaattcctatatacttcacattgaaaaacagtcactacagagctatcaagaaaaagtactgagctgcttatttataaaatttcaaccaatcattatgaacttaaaagtaaacctaagtgataaagtaaaccagaatttaaggcttcttaaaagctgcccaaactgcttgagtatattagatgaataccagttttcaagtatggaaaaattttcttctcttgtcagaaagaagatgaagattaggagtattaaatttctctttgtacatacttcctctataacctgaacattattgttctctttgaacttctacctggtaggtgtagctgctggagaaaagccacatcaccatgaaggctggttctgtatccaatgggtccatcctcatcagagcccacagggttccacgtccattttaagttctttgttgttttttgctcatggtcttctggcacttcccttatcaactgtcctgaccttcacccctctcttcagcctccctacctcactcccccttctcactctgtgtagaacattgtggccattttgctgtttccacattgtaaatgtattcttttctttttctttccagtctgacaagatagtatgcatttctactcatctatcaatccttctaggccagtctatgtagccgggcccttagtccactttcttttttttttttttgatacagagtctgtgttgtctaggctggaatacagtggtatgatcacagctcacggcagccttgaaatactgggctcaagtgatcctcccaacctcagcctcttgagtagcagggactgcatgcgcacaccaccacacccggctaatttatttttacttttttctagagacagggtctgtccatgttgcccaggcttgtctcgaactcctgggctcaagctatccttctgcctctgtctcccaaagcgctggaattataagtgtgagccaccatgcccaagctttgccagtgtctttggacaccagattctactggctacccgccctgttttctgcgtctctacaataaatattaatatgtggttcaaaaaggtcaacagtgaaaagtagatataatatgttaagtgtatcatatagtgtgtatcatttaaatcctatcataattttctactatagcttcctatagtatgatatgaataatattaagtaattaatatttgatattaatattttaaaatattaatatatgataggaagctaaagtagaaagttatataatatcagtctataggaaactgtagtagaaagttacactatatactaatagcatagagatgagtacctggcatataaaaattattttatatactcatctatatgcttttagtgacattaagtcattgaagagcagggaatcagatactgctttgtgctttaataatatattaacttattgttttgtgggatttttttgttttctttttccttctttccttctagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaagtatgtatacaaatatgtatgtaaaaataccagtgaatcaatccttttgttagtggtggctgtctttgatttactaaaattatttttaaattcttataagttattcccacatattaaaatatatcaagtttcttgagaatacttctatattattagagctatattcaagtaccattttctcccaccagtgatactttctctagtgttaaattaacttttgattttgtatgcctgtaacaactgaaaatcaatagcatattgaaagtcagtgaaaacatttaacttaattaaaattctgagtagtaaagccattaacaggtgggaatgcagagtgcaatctctgcctaaatagtcttcccttctttctagaacttaaactacttttgctaatttattttctgactcagttaatgtaaaaattgtataggtagctataatgagtgggctgagaaacaagcatgagaaatgtccttagctcaggtggcctccctaacttgtggaaaccttaagttataccagttcctattggttttgggagcacgggagccaggcacctctgccctccaggtgtctgtaagcccacgagacatgtgattcgtgagaaataggaatgctatgcagtggaatgtggtaagtactaaatgaaggacgcgtctaaatgaaggacatgtacaatgtatcaggttagaggacaggaggaaagattccaactaggttgactagtaaagattttatagaagaggaggtgcttgacctaaaaccttgaggaacagctacaatttttataagaagagatagaagagggaaataaggcacaatggtggtggaaacagcatgggcataggtcccaggaggaaagtagattagtctagccagaaagtgacttaattactaactaccaggagatgaatcctgaatgatagggtagggccaggtagtgggagactctgagtaaaggcccagctgttaaggctctatttgctttttggggatctgtgaaatcttttttcttcttcttcctaggccggagtgcaatggcatgatctcagctcactgaaacctctgcctcctgagttcaagcaattcttctgcctcagcctcctgagtagctgggactacaggtacccgccaccacgcctggctaatttttgtatttttagtagagaagaggtttcaccatgttggccaggctggtctcgaactcctgacttcagggggataggtcccagagagatggcgggtgaagctgtgcatgcacgtgaggtctgaggggagaacatgggttttggttgggctctggtagaccagttattcttttgtttgggcattgattcaccctcattcgccttacaagcacctacaattagtcaaaaaataaacaaaaaggccgggcacggtggctcacgcctgtagtcccagcactttgggaggccaagacaggcggatcacgaggtcaggagatcaagacatactggctaacatggtgaaaccccatttctactaaaaatacaaaaacaaaattagccagacatggtggcgggcgcctgtagtcccagctactcaggaggctgagacgggagaatggtgtgaacccaggaggcagagcttgcagtgagctgagatcgcgccactgcactccagcctgggcgacagagccagactccgtctcaaaaaataaaataaacaaaactagcatttaaaggtgggaagaggagcacagcaaagaaaataaaaaggaatgactgggtaagataagaaccaggcattgtcaagctctaaaggggaaggatgtggaagagggagagaaagtggtcaaaagagaaaggggaggaagagaggagagaggccctaagaatcagcaaccataaatcaagaaaagctctctcagccatctgacgtggctagaagctgtattgcagctttgagtgggatttgaaaaagtgaaaacagttcattcaatcaagaaagttgtttttgaaatttgataactacaggggcatggtacttgtaccgtgtcacccagtattgctagtcctggtccattttcagctcatacctgccttctagattgaaattgaggctgtgactttattttcagatcctcaaattgctcatctaagaaacatacacgttataaactgggaacagtggctcacgcctgtaatcccagcactttgggaggccaaggcgggtagatcatttgaggtcagaagttgggaccagcctggccaacatggtgaaactctatctctctgaaaatacaaaaattagctgggcatggtggcatgtgcctgtaatccgagctactcaggaggctgagataggagaatcgcttgaaccctggaggaggaggttgcagtgagccaagatggcgctactactctccaacctgggcagtagagtgagactctgtctcaaaaagaaaaaaagaaatatacaccttataaatgattgcttgtttttaaagcacaccaacttagattttcatagagaaaagtataattccatgaagtccttgccttccagagggagaatacattgtttaaaactgtatccaggcccagaaccatggctcaggactgtatttccagcactttgggaggccaaggcaggtggatcacctgagatcaggagttcgagaccagcctggccaacatggtgaaaccccgtctctactaaaaatacaaaaagtagccccgggcatgtggtggtgcacacctgtagtcccagctactcaggaagctgaggcaggagaatcgcttgaacctgggaggtggaggttgcagtgaaccaagatcacaccactgcactccagcctgggtgacagagcaagactgtctcggggaaaaaaaaaaaaaaaaaaaatctgtatccatggaagcaaaccattttgttttgtcttgggcttttttagatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccaggtaatagaatcaggaaggtgttggtcttctgttatgttttatgatatttttacatgtgtatttattgatactcttaaactttgttaggcgaactgtacaaagtcagttatcaatccaaaatgttacctccctttaacatatccatgcaaattacatcttgatactaaatggtattttcacatttcagagccaggtgatccccaatgccacaacttccataattctctcccttgtttattttctttgtgtatttctaaacctagacctagagatggtgtagactctctcttcacctgataatacgtacttttctttacagttaccaggcaagtaactttaaggtgtaaggtttaacaatccaggttggattggcttattctgggtgggtggttgtagatttaagcaaccctagcttcttgtttcctgtaaaaggatgtctgtgaaataaagtgtacacagagaattatgtaattatgtgggtggttgttacagtactgtttgtaataataaaaagtcaggaaaagtcaaaatatttagctttgagggatttgttaaataaatgtttgtatagcacataatggaataagtatttggaatcgtggtatagatatacatttgttggcacagaaaaaaatgttcagggtatatattccagttggagttaggtgcaataacccatttttctgggaaaagaatgctcattacatacgccacacaggatctgtatagaatgtcgattacacaaattgcattacacccatcaatatgcgaggcccacagacatacatgcacagaggagattggacagttatgcactaaggtatgaaaattggttgtcccaaacaccgcatattctcactcataggtgggaattgaacacatggacacaggaaggggaacatcacactctggggactgttgtgggattgggggaggggggagggatagctttaggagatatacctaatgctaaatgacgagttaatgggtgcagtacaccagcatggcacatgtatacatatgtaactaacctgcacattgtgcacatgtaccctaaaacttaaagtataataataataaaataaaaaataattaatttaaaaaaaagaaaagaaaattggttgtcctctctggtattgttttagattatatgtgattttatttttctgtaatgaacatttgctttttataattaaaagaaatttagctgagtctaaattacctgggtctgcctcttatcttgccagaagagaccagagggaaggcctcaagtccttcctgttccaagttgcagaaggtaccctctgtgaaggtggagcctcccctcatttagtaaacattttgttactggagtcagtggcaaagtccaattcactatacaaagcttgactatagaaccaacttggcagcaaaattaatgcttgtacctaagcctccagttaatttaaagcctttgtgttttcagcaagttgccttatgatgtgaccacagaacaagctctaacatacccagaagtgaaaaataaactggaggcttccattgagaacctgagaagggtcaccgacaaagtcctgaattctatcatttcttcccttgatctactgccgtaagttgtacttgcagcaagtttaacattctttcctggaacgttcttggaatacgatgtaaaataagcccctgtagtgaagacagcagttttcccttatattgtgtttactattttaaaagattgcctacatttaccttttaaattcctgactgttctctaaagaaggggcaatacttcagtagcaaacacagctcagttattatcatcagtggaagtcctgtgattccattaccatctcatcttatgtttaatttttagaaaaactactcagctgaagttgactggaacaattgctgtgtgttttttcctcactccgccttttttccattattttcttttgtcatctgttttatatgtagttatggattgaggtatatagccaaagtactgaagaattcgatccatgagaaattccccgatgcaacagaagatgagctattaaaggtagattttcaagggtaatctcaccatagcttctcctgggggtatgaatcaaaattaccaacatataactttgtaagattattccccatgtatgattatttataataagctgcaggtcttctgtttctaatgactctcaagataattgattaagctgaggttaatttggagatcctagacattattgaaattctttgcattagagcattttgggggcaatgagcattttttcatcaaaaataactttgcaaattatgctattaataatgtgtgattatattcattgcctttattaaactccttgttaggatttacatcagaaaatgatctgctttctcttgggaaatgtaggagaatatatatctttaaaaaaaaaaagaaaactaaaactcttgagttttctctcttaaaaatggtcatgcacttctgcgtcactccagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggtgagaggggcccttagttttggagaaacgtgcaagaatggtaggcaagaataatatgtgctctgtgcccagagctagagtgggcatggaggacaggaaccccaggtggttacaagcatttcttctaccagccactggggaaagaggagagagggaagtgcaggcaagattgcctctgtctggcgatcctatcgcacccccaccacagcactcctattacactgagtcttttctgtgtgtattatttctgctgctgacaaaatggcatacttgttcttccttgtatgctacaggcttccagtacctagaatttaaaaatcaaaatagcagatttctgcttctttcaacttaagaagagaggaatcatttttaaaaagttttccggtgaggaagaacttgcttatctacgtcagatacatttgacccttgattaacacaggtttgaactgctcgggtctatttatatatggattttttcaaccaaagacagagagaaaatacagtattcatgggatgcagaacccacatatacaaacagatgacttttcacatacatgggttccacaaggccaatttcaaacttgagtatgcacaaattttggtgtgtatgggggtcctggaaccaatcccccaaacataccaaggaacgactgtagtaggaaatggaatacttgattttgaaaggttaggaaaacccagattttatatttgttgatgattgtgtatgtgaatatgttctgttctattctcaagcctttcttaatgacacatgtaagaagatttaattctattgattttgtgtttccaaattatatcactaatcattaacaagaaaggcatgagtctggtagtcagattcactcctcctggagctctgaggaaacactttcctcttgtcatgtttgttctcatgtctgccatttaatcaacaggccatagaagtgtaacatcagtttggcctcttttaatcctcacttggaaactcatttctcattcctcggtctcccttggagtgagtgacttactagaaaacaaaggtagttcatgattattcatttctatttagaatttgtggtcttttgtgagaaaattgccccaaatcctcctactacagaaagtgttgatttttcaagctaatttttcattctcctcactgactaacaaagtaatatccaggctgggcaacatagggagacctcatctctacaaaaaatttaaaaaattatctgggcatagtggtaagcacctgtagtcccagctactcaggaggctgagatgggaggatcacttgagccttggaggtcaaggctgcagtgagccgtgtttgtgccactgtactccagcccaggtgacagggtaagactctgtcacacacacacacacacacacacacacacacacacacacacacacaaagtaatatccatttcccacatttctcatgaacttttaactgctgttattcctatcagtcatttatgttcccacctattctttatttaaaaagaaacaagaccaaagaagtgagcctcttctaaacttgtcctttcttccactcatatttatcctttgtgtttctcagaaatctacaaaaaattataaccaaagcagcataggaaagccgactgttacatgggaacatgctccccacaacagggctctgctgtttaacctcccccagcctctggctgggaaagcagaggtcatttctggtacataagacccaggtgcctgtaggagagatgccgacaatgatttcaggcatatgaaacatttacaactttatagaataaaatgtatattcgacctgcacaagaattgtttaggcaaaaaatacatagaactattcaactgtgatcacagcatgcctcacttctcttgatctctgtcaaaacttgctttagcttaaaatagactttttagggtctgagtcctgggacatgttatgtatttgggtgtctagccttaacaatctttccatcggccagcaaatatttgcagcaacgaagaagagtagacttaatctcatttttgtcaaactggtaacagaagctctgaagggtgattagggtgatgtaggcccaggagcctgtgctgtttaaagcagcaaatttgactaattgcttttttttctattgtattcctcacacagacttgattcttagatcaagaattatcatttttgactttttaagtttcagggaccatttttaaaataacatttttaagatgacctacgcataggtcactatatcactaagtcacaaacagggcctgaggcccttgccactctctccaatcctgtttgaggagctgggtccaatatccagaaacatggatgcagctccgacagccaggagccagcctggaagaagctgtaacacgtcctctcaaggtttgagatgggaacaaagtacatgtcatcattcaaaatttcctagctattttgatgaaactgtttaatgcacatgtttgagtctgtcttaagacttttcccccctttattaggaaatatttcaaagaagcatgtaatgtccctgagccagaagagaagtttaatatggacaaatacacagacctggtgacagtcagcaaaccagtcatttatatttcaattgaagaaatcatcagcacacactcagtaagtggggatggggagccatcttagcaatggacccatgatttaggcatctgttatcttgaaaatgcttaatctctacaggacttattgtacacatgtgctaatactcatattcttaaccctaaaaatctcgcaattatttattccatgactcttatacattaataaaactccttctcccaaacaacaaaattctatttttacataattattccctgactcctagacattaataaaacttctccccaaaaaagaaagtgtacttttggcataatccatttacaaagccagattgtgactggaatggtggcatatgcctgtaatcccaacactttgggagactgaggcaggaggatcactcaagcccacaagtttgagactagcccgggcaacatagtgagacccctatctctactaaaaattttttaaaaactagccgggtttggtggtacatgcctgtagtcacagctacttaagaggctgaggtgggagatcacttgagctcaggagtctgaggctgcagtgatctatgatcgtgccactgcactccagccggggcaacagagcgagaccctacctcaaaaaataaataaataaataataaaaataaagccagattgtaaatatgcagtttaagccctgagccaggacaggctatggtgttctcatccgccaaagctatgctatgtagacctacaccctgtctctcccctcttccaggaaccctctcagcttttccagtaattttctgggggaaatgagaatattctttttattctaatgttttaacataaagtggtaataaacaggctacgcaacgaaaacaagaaactaccacccaatagtagccttctgcaaagaatcacttccattgttctggaaacccccatttctcggaagcaggcagtttttcacatcatgtgctgtgttatgacatctacatctggtttgcatgcagacatcactgccgtcagccattagcatgtattaagtatctgttgggtgcagggcactgtgctcagtggcatggggaaggaattgggaggctttagatgacttttcaaacattaaaattaaaaaaaaaaaagctaagcattgaggggtttgcattgttttctttttaagatcaattggaacttatttcatgaaaaaatcttggtttttaaaaggtaaccatttcaagaatagtttcagaccttgtgagttgaagcaaggtcctggggatatgttagcaatgcaccctggacctcccaaattagaacctgcattgtaacaagatcccagaggattcagatgcacattcaagttctagatgcttcagttaaggatgcacccaactttggattatacagagaaccaaagggaaagcataacaaatacacattctcaaaggttgtgctctagcccccatcaaaccagacatactgacaagtggcaggttagctgcttaaaatttcagtctattattaagctcttctaagaaactaaagcttgaatgtaggtttgaaggaaagattgaatctagtattgattttcttctttcagggttgaaacagggaacttccctgacatttacatcaagctctcaatacatactgattaaatgaataggctatccttcttttctctatatatgaacaccctagattacaaggaaaactgtccagcaatctagcaatgcattacttacagaaataattatctactggacagactcatttatatttgagcaatgacccatttgtctgtttttgtggtacattatctgtcttcaaagaatatgtacatcttgggtgcacatttgctgaatgcaatatccacatgcgaaaaaaatggtggggagtacttgtttagagtgagagattctttcccaagggtagcagagagaaaatgttactgtattaatttagaagtcttagaagtctttaaggagaaatagtctgttcttttgttaacaaaaattgaaaacagaattcaatcctgggaaagagagcttgtgactgatttggaattccttcctgtgttaggttagaagcagatgtaatgtggggaaattgtgtaatttcataggaagactgtcctgtttactgtctgccttctgtgtggaggcgtccgtgtgcagacacaagcacagcagtagcaggatttgccaagcctgtggccatgtgcttacccctttctctaaggaagatgcaagaacttccaaataagctctttaagaagacattatcaggaaatttttccgaataaagggtagaaggtggccacctaaataatcatttccaaagaaaacagccaaatcagttgccctggctcatcagagaagaagaacataaatttatccatcttgcatattttgttcttgtctcttaattttccctccaaaacatcatatgtaccgcctttccagattttgcccggtctttgtatcacctctattatttatttaatgcctttctttgaatcaactcacctttttaaaaacaacacgtaatttctttgctttaaaacaaagtacctctactatagtgaaaaactagcctgctttgccatacacagaaactttagaagaaaataagtgtaatgaaaacaaaatagttggatacagtcacttccttaccttgaagttatgtatctgaggtgtgttctctctttgttaacaactctccatgtgtcagggaaatgttaagaaaaatttagcatcaaacagatactctctccttcactgatcttaaagattagaagagaacggaaaaggcagtaatcaagacagtgctatgctggcataaggttagacataaagactaatgggatagaatcgagagtctagaaataagccatcacatttatggttaattcattctgacaggggactaagttcaatgggaaaatagtgtctccaaatggtactgggacaactggaaattcccatgccaaagaatgtagttgtgccccttccttccactctatacaaaaagtgaactcaaaatgggtggtagacatagatgtaagagctaaaactatagatctcttcaaaataagatataggagtaaatctttgtgaccttggattaggcagtagtttcttagatatgacaccaaacacataagcagcaaaggaaggaaataaactagacttcatcaaaattgaaaacttttgagctataaagagtaatatcaagaaattgaggctagacgtggtggctgacgcttgtaatcctagtactttgggaggccaaagtgggaggatgcttgaggccaggagttcgtcgacaaaataggaaaaaaaaattagctgggtgtagtggtgcatgcctgtagtcctagctactcgagagaatgagacaggaggatcccttaaagccaggagttcgaggctgcagtgagccatgatcatgccattgtaccctaacctgggtgacagagtcagaccttgtctcatttaaaaaaaaaaaaaaaaaaaaaaaatttcatccaggtgcagtggctcacacctgtaatcccagcatgttgggaggctgaagcaggtggatcacttgaggccaggagttcaagaccagcctggccaacatggagaaaccctatctttatttaaaaatacaaaaattaaccaggtgcggtgacacatgcctgtaatcccagctactcggaaggctgaggcacgagagtcacttgagcctgggaggtggagcttgcagtgaaccactccagcctgggcagcagagcgagactttgtctcaaaaaaaaaaaaaaaaaaaaaaaaaacttgagaaaaccaacagaatgaaagaaaataattgtaaataatgtgtttgattggggacttgtatccagaatatataaagaaatcctacaactcaatgatagaaacataatccaatttaaatattggacaattacacatcaaaggacataatcaactgagtgaaaagataatgtatggaatgggagaaaatatttgcaaatcacatgtctggtaaagggttaatatctagaatatataaagaattcctacgaatcgacaacaaaacaacccaattataatataaacaaaggactttaacagatgtttttccagagaagtatacagatggtcagcatcactaataattagagaaatcaaaactgaaactgcaaggagataccactcacacccagtaggatgattaatatcaaaatttaaaaaaaaaaaaacagaaaataagtgttgagaaggatgtgaagaaaatgcaacccttgcaccccgttggtgggaatgtaaaatggtgcagctgctatggaaacaggatggtctttcctcaaaaatttaaacagagaggctggagtatggcggcacgatcaattaaaaaaaattaaacatagaattacctcataatctaacagttccacttctggaagtatacccataaaaaattgaaagcagagtcaaagagttatttgttcactcatgttcatagcagcattgttcacaacagccaagcgtctatcactagatgaatggataaaatgtgttatattcatacaatacaatattattcagctctaaaaagaaggaaattctgatacatgctacaacatggaggaaccttgaagacattatgctaattgaaatgagccagtcacaaaaagacaaataccacttatctaaggtacctagagtagtcaaatacatacaggtatatttgtggtttctaggggatagaaagaagagataatggagagtgactgccaatgggtacccggtatcttttagggcagtgaaactgttctacagtcagagagtggtaatggctgcacagctctgtgaatacactagaagccattgcatcgtacattttaagtgagtggatttgatgtatctgaattctattttggtaaagctgttggaaaaaagattgaaaatggaaaaggaactagctttatcattatgatgcagagttttataaaatagttgctgagaacaacaaattttatctcctgtctccaagattactagttccgtactttggaaatgttgtttcaatctaattagaaatgcaagcaaaaacagatgtgtcgctgttcatgtgtaaggttgtaacaattaaaccaactccattaaaatttgtttaaattaaaaaaaaaaaaaaagtgttgtctttcatggtttcccccgagtgctgctacccctcaggagttaacactgtttcctgtaagacctggcaagacaccccagcagatgttactcatctttgggccttcttaggataaggaaaggggaaaccactcaggacatctaggtctcttacatccttacccatgagagatcttcaatgcaagacagattgaaacagctcatagtagtgattaagaagaagataactgtagtatttgattactgcatagagatgtaaatgcccttccagtttgctaccaatgttaactgaaagatctgcctcattctggactctttcccccaactttgactttttctatggaggaagagtgaagcacagagatcaggtggtagaaggcttccctttggcagaccttgctgaaaaagggtttatgaacacgtttcttgcaacaatttcttgatgtagagtaggtgcttccctctgagatacaataaaaactgtatctatgtctctaatttttataaatgtcatactcatatttaagatttaaatggtatgaggaggaaattatgaaaaatttcatataaatatggtacagttgagaatttacttttttctttgtgtgtgtgttgctttctacataaagctcctgttggaacaccaggatgcaattgcccctgagaaaaatgacttactgagtgaattgctggggtcgctgggagaggtgccaaccgtggaatcttttcttggtaagagcttgttccttctacttatcccttggtttttgtttaattgggtgggttggttggttggttcgttggttttcctatcctagataaaacaattattttggaatttaatgcttaagcatatttaaagaataacaactacacttgccccttcctacagtaagagttctgtaattaatggagtccgggattataaaataattcagtattcttgaaggtaagctccagatatgtcaaaaaggaattgtcaacctgtattatacagaaagaagccatcaataaagaaccaaatttattacaaaatgaaaaatacttttattaacagttatcctttttagtaatttgtatttgaaatacctatgtcccatgtcattttcatttttcaatcagatattttaaaagccactttagctatagtagaatgtgggttttgtaaagaccatgatctcccatttaattaccaagcctatctttcccacagaacctttatcttacattgttggtgccatcatcacaaagagtgaattggaaaaataacactaggttttttccctacaggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagtaagtttgggggttaaagggcacatgtctccaaatacacatcttaaatgatgcaaattcaaatgaggctaaatcccaactaatttatttaaaagtatgtgaacattgaaatctattatgtatatccatcaaacatctaaccaaaggataatagactctttagaatttaggaaggcattaaatattataatagtttacaacaccttccttggtttttagttttccatgtagtaatttgatttttttcctttgagaaatgattaactcagcttatgcaagtccttaggtaactgaagagaaatatctattacagagtggccagaagattagtgaggaaattcagttaaccaacgtttatttccggtataaaatcataatataaaaacacgtacctacaataagacattatgatagcatctgatttattggccttccttcctgttaaactgatcctggatatatttaccagctttgacttttatttgtaccctgcttcctgccgctaaagatttcaagtgaagcattcacactttaaataatactatcttttctccatcaaagaatcaaggatattccacatccatcctttacacacagagtaagaaagagaatgagattcatgatacaacaccataaatcaaaagcacccgctgaccaagcagtgcagttttcaagaacttatacaaacccaagaatgcatatcagtacattagaacagttatgtattggggtgagatggagactggaagtggaaaaatgaggacaaagggaacaagtatgtgttgaaacaatacgaaacatattacttccaagctacctgtcctgagttctgaggttttaatttgtggcaagagctttctctcctgccactgatgtgctgaagtgtgcttgaagtgtgaatgaagacagcattcatctccacttgatttttttttttaaacattcaatcatctgtgaaaacaacaggaagagcttcttcactgtgctgtgttgatatgttcctctcttaggcttgttgattttgtcctcagatcatctgaggctccattcggtcatgcagcaaatgcttgactacctactctgtgttcatgcgctgggcttgaggctgggatacaacagtgggtaagctggaaacagcccctgtcttacaggggtggagagcacagttcgacagtaggaccgcaaccaagttgcaggactaggactcacccttggcctcacaagagttgagggcggttctttttgactacagattaccaaggcagatgaaaatttcagggagacaattcagggcagggcaggagagaaagggggagaaagtctacaccctgggttcctctgaacaagtgccaattataaagataactggaaatacagattgtgtggttttgccatgtaaatgaaattaggccaagtatcccatgatctcataagctttgtcctttagaagtaatgggaagaaattttttcttaattagttttgtctgctatttgaacatcattttctaaatccagtcaactccaatgtctgcatgatatctgagaatcaccatttgagtagttcaaagtatcagataatctgaatatcatatatatttatacttattcctgaacatgagtctgcatgattctgcaaattctaggaaatcacatttaaagataaaaccataaaagtcaggcctgtctggaagcaatgtgtcttagcctgggaaacctgggacattgtcctgtttgccttacccattacccagcctctgcccttgtgtggctctcccccgtcccccccagtgtgttggaaacaaacactatccacttctttaatcaccacactatgtagagccagcagtgggtttattttttattgtggtaaaatacacataaaacttaccatttcagccattttaaagtgtacatgcatttagtacattcgcagtgtgcaaccatcactgttgtctagttccagaacatttttatcagatgtgaaccctgtacccattaagtagtcattccccattccccgctgctgcccagcccctagcaactactagtctgcactctatgtctttgaacttttgcctgaagatatgaagtcgtatctcactgtggttttggtttgtacttttccaatgaccagtaatgttgaggatccttccatatgtttgtcatccacttgtgtatttatgtattctttttggagaaatgtctatttaactcctttgtccattttaaaattaggttgtttgtggttttgttcctcagttgtaagagttgtttatatattctggacactggaccattatcagatatatgatttgcaaatatttttgccccttgtgtgggctttttactctcttgataatgtccttttccgcacaaatgtttttttttttttattttgatgaagtccagtttatctgtttttttttttgttgttgttgttgttgttgttgttacttgtgagatttaccccaatgttttgttctaaaggttctatagttttagcttttacagttaggtctattaaccctttttgagttcatttttgtgtgtggtgtgagacaggtgtccaccttcattctttcttgttgttattgttgttgttttttgtttgagacagcgtctcgctctgtcgcccaggctggagtgcagtggcatgatctcgggtcactgcaagctctgcctcctgggttcatgccattctcctgcctcagcctcccaagtagctgggactacaggtgtctgccaccatgcccagctaattttttgtgtttttagtagagacggagtttcatcatgtcagccaggatggtctccatctcctgacctcatgatccgcccacctcagcctcccaaagtgctgggattacaggcgtgagccaccactcctggccccaccttcattcttttgcatgtggatgtccagttgttctagcactattagttaaacagactattctttcttcatagaatggtctaggcacccttgtcaaaaactaattgacaatacatgtatggctttatttctggattttcaattctactccattcacttatatgtctatccttgtactagtgccacaccatattgatcactgtagctttgtaatgagttttgaaatacggaagtcctccaacttctttcttctttttcaagattgttttagtcttgcagttgaataggtctcttgcagttatatgtgaattttaggatcaacttttccatttatgtaaaaaaggcttgaggccagtgttttaatagaggccctaagtcttttatgctcaaaggccttcctcttggcatactgtgagatcttactgttggccgaccactttactaagcagcccagtgatcaatgtaggtaacaatttgaaatcaacactgactggttagccatccctgaaagtgaaatttggatattgcccaaaaggttcaatagaattagttctatgattttagccaagccctgcttctaaatatacttcctttaaagtacatatttgaaaaaatcttgatactaacagataattacaaagtgcagcattgacagggaacctgaaaactgagtctttttcttgcaggcaaggaaactaaagtctaaaagtaccagtatcagtccatggcctgttaggaaccaggcgacacagcaggaggggagcaagtgaagcttcatcctgtatttacagctgctccccattgctggcattaacacctgagctccacctcctgtcagatcagtggcagcagtagattctcataggagtatgaaccctattgtgagctccacatgcaagggatctaggttgcacactccttatgagaatctaatgcctgatgatcactgtctcccatcacccacagatgggactgtctagttgtaggaaaacaagctcagggcatccactcattctgtattatggtgagttgtataattatttcattatatattacaatgcaataataatagaaacaaagtgcacaataaatgtaacgcacttgaatcatcttcccgaaaccatcccccaccctgtccatggaaaaattgtcttccacaaaacctgtccctggtgccaaaagggttggggaccactcctttaaaatattgatttgaactctcatgaggatgacttttttgatttgaacactctcatcaggatgacttttttccaagctaataaaccgaatttgtaactcaagcataagatatagttcttgagattcattagagaaccaaatttaactaaaatcggacaatgacttttataagttatgaagtggacagacatgaaatgcagagcaattgggatgtgaaaatacctagcttttctctatcaaaaaactattctgcttttttgtgaaacagattgtgttcttaactttcagaaatgcccttatgtttaattacaatgtcactagttttccagtcatgagtaactcatcttcatggaggcccccacagtagcagaatttgaggcattgttaatcattatgtttgtaaatttaattccatgctagtctcataattcttactcatcagatgaagatgaagatgatgataatagcaaacacctatgtagtgcttaccatggccagggacagtttttatatactgtgcaaatgcaaagtgttccagaattccaaaccttttgagagctgacagtggtcaaaggaaatgctctttggagcgttttgaattttcggatttaggatgctgaagcagtaagtatataatgcaaatgttccaaaatctgaaaagataaaaaatctgaaacacttttgggcccaagcattttgaaaaagggacccacaatctgtaaagagagaaagagaataacatgtgcatatatatatattaaaataaacatgtataaaatatgtatgtaatattctcagcaaccccaagagagtggaggttattatcagtattttacagatgaggaaactaggcacagaacaggtataaaccttttcctgggtaacacagttactaagtggagcagagattcaaacccacatgatttgaaatcctccagggcccacactcttgatcataaagttttacaacttgtcgagggcaaggtcattgttctttgcattcttaggaatcttagaataaataatgagaattattagctgagcagttactgagtaacggaggctggagcatctttccaggccaaagaggagggacaaagggcacatatcggagtaggaagaaacatttatttctttttcccttgtgtatgtttatagaatagagaacctcagtttgggctattgctatttttctaatactaccaagcacagggatatttaaaaaaaaaaaaaaaaaaaaaaaaaaacctggtcgaggaatcctaaaaacctagtcgaggggtcttagggatgacatagggttatagcctcaatctatcacttattaaccatggaactcagcaagttgcctcgccatcagttttctcctccataatatagaggagaggggaaaggaagggctatgatgatcacatgaaattataattaataccacataaattatataaaactatgcagttgtcaacctttcattataacttatgattcaacttaaaatatgtgatccttatggccttaattaagcttagtttcccacaaaagtatgtgtgtttaagtagaaggcaatatttgtggtttttaatcatacttagctgcttgagtgcttaaattgtcatctcttaagaatttcctgtcacatgattaagtttaggttccatgatcccagctgaaagatttccttgttttttggtccaaactagcaggagcactaaatggctaaggtgatatttgaggtctggagctaataatgtaaattatcttgttaggatgttaaatactgaaaatattccttagtttccacaaacactgattgcttttcaaccttgggcacagtataagcagatgacagagggggagcttcaggaatgctactggtaataatagataccatatgaatggagtggccaaacccaaggggccacaccagcttacaagcgccgtatgggctcatttatctacagtggggtttgagcacagctatgatgaataaactccctggtgtatttctttctctttttttcttaattctttttcaaaattagatacctcctcattcagggagagcaagacccgtggtttggatcaacctatcttacatatttgaagagccctggcgccagtactctaagcagttgatttatgctggtcagaccatatccagaatgttatatttggactggggtgggaagggggatgcatattaaggtcattggtaactggaatgtgagcaggactgtgagctctctgcagatgccattgtgaggagctttaagggactgagtggtttcacttggaaaaaggaaagatggtggaagaggggatagaggaacacagtcttggcatttctctataggtttttcaggagctgctgatttggaaagggaattggacttgtttcctgcagctctagtctcttaggtcttagttgccacatttgtacaatcagggattggattgtttttcaaaggtctctctccgggccacagtcctaagactaaccaggtttcatgactgggtggccctggaaggcaggcctctcagagtgagctcctgtttgagaatggaatgtgccaatattgtactctccaaaagaaatttaatatgagccacatgtaattttaacttttctagaagccttattttaaaaagaaatagatgaaattaattctaataatatattttatttaacccaatatatccaaaaatatttaaatatgtaataaatgtaaaaaattgatgaaatattttacattctttgtttcatacaacatcttcaaaatccagtgtgtgtttcacacagcacatctcagtttgtactagccatgtctcaagtgctcaagtgccacctgtggccagtggcggccatcatgggcagcacagctttaacgaccatgtgagtgcttaccatgtgccagacctcacagaaggctttagatcttttcatccaatccttgcatcagtcctgagagattcctgttttataaacgaaaaaacaaaacctacaaggattatataacttgcacaaatccacatggctaatatgcaacaagagtccaagccaagacagatttggctttaaatctgtccgtccccgtcgtccttaagcactagacacactgtagtgggagggaggtgggttccctgtcatgggactggatggttacttatgtctgaggtagaactttggcaatgaattccacaggcctggtgtacagtagaagtccaagggaaacaggctgtgtgagcagtttgtcctccagcaactcttgagcaaataaacattctttgtctttggtggggcacgttttattgactccagtcatttggtcattgcacagcttctctaaagaactagaagttccctagaaactgtatatcacaattagttctgagaatactatttcaaacaagaaagttactatattgacattttttaaatcatccaaagcttttatttttaactcagtgttcctgtttaatacattgatgatgatggctggaggaaggtggtgtgtaggaaggaaaggatacattgctttctcagccacagccgctttaggaaacatgccatcccccacgtggctgtaattagctgtgggcccacctttgagtctctgtggagtatttagctgtgcattcccagacagcctgtaaatccccagcagcaaagggtcatggggccagaggaaatggttctccaaaggctagggggaagggaggcaaggaagacacattgtgattgttcttttcacacagacttctgataaataggaaatgagaaaaatgatgtttacagatggcttattggattttatcctattttcaaaagtaatatatttgtaattaacttgaagggttttctctgtcatttgggagtagttgcccatatccttcaaaatgtgaaaattttgttctcatttctaaatttcatgctacatgaacatttcctgctagagtttaggaagaaaaattagtcattcagtgatatcatgtaatgactctgaaataactaaagttaaatgcaataacgggactacagtaaaagtgaaacttcagatgtcaattagaccagtgtatgtataatttaaacaaacttttgtctgtgtttccttttcttctttcttttctttctttctatctatctatctagatatctatctgagatggtatctcactctgtcacccaggctggagtgcagtggcacgatttcagcttactgcaacctctgcctcccgggtttaagcaattctcacacttaggcctcctgagcagctggaattacaggcacatgccaccatgcccagctaatttttgtatccttagtagggatggggtttcgccatgttggccagggtggtctggaacttctgaccgcaggtgatccgcccacctcggcctcccaacatgctgggattacaggagtgagccaccgcgcctggcccttttttttctttttagaaggaaagccttttccaataatactgtttccaccttatgtaaaagtgagcaaatttgaccctttagcttttatgttaaaacctttgtacgtaattacataacatgatgcctccctaggaagtggtggccaattgccataaagaacacctatgagagaactacggttttcgtacttccagaagaattttccagctctttactgtttactgagaagctcttctattctcttccacctgaagactggaagaagacctaacaaataggtttctttgttaaccctatttgttagttgctcaggcccttgaacaccatcctcctcgctgctgtgtcagctgacagaccaagcctccacagcccacactgaacgttcgctcccactggtcttcagactctttaatagctttctgatagtaggaaaggtaacagttggtctggctcctaaaggcttatgaggtattaagccagctcagaagtctaggtgctattaaagtcaggaaaggagaatattagatatcattcctgcactctgcagtagcaggccatatcagcagcacttgctccccctgcccatcaaaaagtagtctccgtctaaaaaagaaggaaaagtatttagagaggaaatcttgtgatacacttgtgcccatgttactgacagtataatgctacaacatcaagcacagaaagcccagactttgattatcaagcattcataaactttcaggagccttatagcagacctggtgaatatccgcaagaatgttttattttaaggtattatctttgaagcttcagtattgtatgtgtttgtgcactctcttaggagaaacagatttttgtgcataaggactacagtctgaaagtctgtctctttctctggtttgttaaggaccaagaagctgataattgatgtgatccggaaccagccagggaacacattgacagaaatcttagagacaccagcaactgcgcaacaggtaatttgactttaagtgtaaaataataatagacaggtgttgattttcttcataaatctttatgccatatgtttattatctcagagaaactgtatctgacatggtccggaagtaaggaattttatctattactgcagtggacttagttcagccatatataaacctgtatgaagtatcaatgggaatgaaatagaaaatacagcaccaaattcatgccgaatatacttttgtcttaacctaagatgatagttctgggtttttcaaagcccggaaatgttcatcataatgggcaaataagtcagttgagagagttctagctgacaggatattgaaaaatacctttcacattttatgtatttactaacttgaaacaaataagcgactcacatgttaaagatgttttccaaatgcttcagaagcaaatgttgagtccactgagtcaaagcatcattatgttagcgtaagtgaggtttcacaacaatcttgcatttagctttttattaacatctttgaaaatacgtcattgttcgttctaaaataaattcaaggttgttattttagtaccaataattgccgctccctaaacaaaagttaattatttaattaactatttcttagcacagctacacataattttcctggatcattcttaatttaattgattgccaaggaatccttgtaatagtttttaatttaaaaaatataaaaggctgggcatggtggctcatgtctgtaatcccaatactttggaaggctgaggtgtgtagatcacttgagcccaggagttcaacaccagcctggacaacacagtgagacccccatctctaatttttaaaaatttttaataaaaaatgtaaagcaaaacttcaaatcacacgtttgttaatatgtgggtatgttttaaacaatgtgggtaaaatattatactaggttagtataaaagacttttactccttactatttttcattttcccctaaatgtatcatgaataagtgactaagaacacagacttctgagatcaactatacctctgcacctcctaggtgtgtaactctgtgcacttagaagcattgctgtgccgcagtttcctcaactgtaaaatgggtataataatagtacccagctcacaggcaggattaagtcaattaaacatgttaagtgggtacatctgtatctggtgcacattaagtgctcaacaatgttggctgctgcttttgttatttactgctaacctggtaataatgttccaataatattgacctacctgtcctgtgtctaagattactgtccctaactaatagtcgtttccttagacttcatctattgggtcagtcaattgtctagtacaatgaaatgggaagaccaatagtctctttttgttactgtttccttgaacagactatccaaagagtattcattcattcattcatttactcatcgtttgggaatttataatgtgctagaatattcttattccctttggctcaaagaaactttgcaagtttttcagagttgctggtttgtgattcccttataagaataaagctctctgactgccttactgttggtttagtttaggactctccataaacatggctgatgtgtgagagtttagctgggttctgaacattcagggttctcatagccacatttcaataggtaatctagttttagtttcctcagctagcctatccaggaattgaaatccttccatgtggggaacaaagtagcagttatccattaaaatatgtccattactatagtgatttgtcaccttggcaataaagtagctattgagaatttttcccaaataaggcttgctatcgaaaagatgaagtaattcctttcaaagacctacttcaaaactcaggaagaacatgttctggttctagtctctgaactttggctggaggactactttcattttgacattaacttgcattgtgtagcttatgaactgtgaaattaggggatcagagaaaactcagcatcttgatattctcttttcaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggtttttggaaacagtattctttcttccttcacttagcagacatttgctaatcaccagtcaagtgctgggcactctgtgaggtggcattagggattcatggttgcatatgctgtggttactgccctcttcaatgctacagatttttcaaggtttcaaagcagttgatgactttttttttttttttttttttttgagttggagcctcgctctgttgcccaggctggagtgcagtggcacaatctcgactctctgcaacttccgcctcccaggttcaagcgattctcctgcctcagcctcctgagtagctgggactacaggcacgcaccaccacgcccagctaatttttgtatttttagtagagacggggtttcaccatgctggccaggctggtctcgaaatcctgacccggtgatccaccggggcctcccaagcagttgatgacttttaagagaaaacaatcacaacactttcatgtcattaggagagttgaaacagaccagaaataaatactaaaaaatgtacttgacaagtttggtctatacctttaaagttttaaaaataacactattggaagagttttctcctgagatgttagttgtcatatagctcagttgctcttagaacctgccactgagatggaactctgtgtccctgatcatttgtttttaagcaatttagcctaaatgcagttcagacttgaagattagtttctgttttcttatccaatatttttacacttgagaaacttcctgagcaaaggatctcaacttagtgcaatgaaacatcacaggaagtggctgagatctgtttgtcaaggataaggaagtatatatttgggttagaaggatatttcattctttttattcaaacatgcaaattaatatggatctagaggttaaaggcagttaaatgaccagaaaaaaaaaaaatttctcaccttctggaagggaaatgcgctcagctttgttctttgatagaaaattatgttcaattctggcagtaggcttattccttctagcccaagtgactcaagggaaataacatttctttctttagtttgggggtagaaatatttctatttgggaatatggggtagataaatatatgcttttgctttaaaaaagaaaaaggctatcatgaagacatgatattctatttaatgaatattctattatatgaagaatttctatttaatgaagaattctatttaatgaagaatattctatttaatgaagaaattttacctaagggcatggggaagttgtgggggagtgtatgtgtatgtaggtatttctttgaattcctaggggaatggtttttaacttgtttacaaaagaaaaataatattaaacaggcaccgttttcttaagtcaaacattttcataacttaccaattagaattatgaaaaaaacttatatctgcaagtttaaatttagcatagctcttgtaagctataagcagcttatgcaacttaatgttctaggaattctatttaaatccaagtaatagttatcaatgttgaatcttttcactcagtcttgacagcccagtgttgttttttcaaaccttgggaaatatttgtcagatgaaaaagtttgttcttttcttattttaaaaatgaatttaacaattaaatgtaaacttttttagtttaaagtactattcaaagaggaatattcaaaatagtctgaagaggccgggcacaatgtctcatgcctataatcccagcactttgggaggccgaggcgggcagatcacttgaggtcaggagttcaagaccagcctgaccaacatggtgaaaccctgtaactactaaaaatacaaaaattagccaggcatattggcacgggcctgcagccccagctactcaggaggctgaggcaggagaatcgcttgaacctggaggtaaatgttgcagagatcaggccactgcactccagcctgggtgacagagcaagactatgtctaaaaaaaaaagtctgaaaaaattgcatttctgctactttgtgccccttttaaaacgcaatttttccttaaactaaatgtgtggttattctaaaataacttctttgcctttccatccagagcaaaattaatgttaacaagtctcttaaagtgaaatatgtacactttccagttctgaagtaaaaagggatgggaaccctgtggtgttgagagtaaaataaggtgcctgagataagctacaagtcaagttacaaatagcgacttactactgcttgatattcttcttgtcccaaactggcaatatcataaagcaaacttctgcttaaatatgataccccttacttgttgttttaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaagtaagttaaaatcatgtcatgttcatttgtaatgtcatgatttctatgagatgtcaattctgtgtttctaggcagttgggttgggtatggaagaaaactttttgctctgtcttctaaccgaaaactagagtctcagttttattatttgccactgtgaactaagaagtcaggagtaagtgaaagcttttcaattccccaccagcactagaattaaagtggcttacctgttgtatattgagcaaatagcattagtaagttagggaagcactttcattattccttttgtcttttttagccaaagatttttttaaatactattatttttaaagtctcttgtttttggaatgtattttatataattgataatattagataatgccaggtgtttgctaattgcacagagcagctgaatgtttttaaattgcttcatggttttaaaaaattattgacacaactggcaaaatttggcagccgtctattatccattagcataagtattataggtttttatatacagtatagccatttttaatgaatatcctttgcttagtaattattcttatcactagactatgatcaatgctagttaaattttaattacccatttaaatatgtagtacaatatttttatataatccttgtcatcaaattggcaggaggaaatggtgctgtatggaaaaatctattgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacattattattagctatattcaccacactgtgcaatagatttcaaaaaaaaactgattcctcctaagatttcatatcctttgaccatcatctccccgtttcccccaccctccagcctctgaaaccaccattctattctgcttctatgagttcaacttttttagattccacatataagcgagaacatgtggtatttgcctttctgtgcctggcctatttcacttagcatagtgtcctctaattctgtccacattgccccaaatgtcagaatttctttgttttagggccgaatagtattcttctgtgtgtatatataccacattttctttacctgttcatctgttagtagattcttaggttgatttcataacttagctaacgtgtgagtagtgctgcaatgaagatgggagtgcagacatctctttgacaaactgatttcacatcttggagtaaacacccagaagttggattgctgaaatcacagaagatttgataaagggatgcagccacatttaaaccttattgatttggctcccactagtcctgaattttagttcatttgcttcaggcttctctctgtttctctctctctctctctctctctctctctctctctctctctctctctctctctctcactctcgtgctctctctctctccatatatagttcatttgcttcaggcttctctctgtttctctctctctctctctcactctcactctcgtgctctctctctctccatatatagttcatttgcttcaggcttctttctgtttctctctctctctctctctctctctctctctctctctctctctcactctcgtgctctctctctctccatatatagttcatttgcttcaggcttctttctgtttctctctctctctctctctctctctctctctctctctctcactctcgtgctctctctctctctatatatatatatacaaaaatacactaaatatgtatatacacacactacatatagtgtgcatatgcacttataattacataaacatatacactatacactaaatataggaaggaaggaagaatatatacatatacatgcaaggaagaagttggtcaagcttactttcagtagaaatgagattgttagggatttactttaaggcatttcacacaagatccacagtcgggcgaattggatttgggttctgattctctcttatgtcgtgtgatcttgagcccagttcagtgaactttgagcctcagttttctcatccttaaggtggaattaagagtaccagcctcaccagcttggctgacgtggcgaaactccttctcctctaaaaatacaaaaattcgccggatgtggtggcatgtgcctgtaatcccagctggaggttgaggcaggagaatcacttgaacccgggaggcagaggttgcagtgagccaagatcacgccactgcactccagcctgggcaatagagcaagattccatctcaaaacaaaacaaaaaacctccccccaaaaaagcaaagagtaccagactcacaagtatggttatgagagctacatgatatagtatatagcaaaggaatttattagtttaaaagtactatggaaatgttaattttggaaatgtgaggtaatatttataaggcacttagaacaatgctagccacatagtgtttgttaaatagattaaaacagtcctagtaatatcgttatctaggaatacacagttcatgttattgcaccaaagctacttctgaaatgactaaagatagccacttggttcaatatacctgagaaaatagagtgtaagttttattaaaaatgttagtctgtaatgcaaacttcagtcacttgggaaatccctttccccacaaacagtttagtagtgaagttgcactctatggacaaaattacctactatcacaaaataaaaaagtgtatattcagcgctctgagggccaggtatgaacagcgatgtcactctgagtatggtaatcgcactaccagaagcctctgcatttgccatcataacaacaaatgttctgttcttattttgtcagaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatagaacacgcatgccatttgatttcttgtggccttggagagagctccatttggtctagcaaggcttaacctcaattactgatgggtgacaagggaagaatacacaaattgttatggctactcttcccttggcctcagcatctggtgctgtcagtcatatgtagtgttgatcagtggttgtctttcccgtggcttgtgcaatatgtttggattggtgaacctccagaactgagtcatagcaatgagagtaaaaggctgtcttttggtcttgatggatgaattatctaccattgcaaaatagcacctttctcatttaaaataggctgtgccaacccctggatcagagccatttccaaagcatgctgtgagtgtgtgtattcggtgtagtggaaaaaacaaaccctccttcacagccccacatcaggcaccatgtgctgcctccttttaaaggggtcatgagcccagtgttccatcactttcttgtcctaaaatctcaagggaagccagactcactggcatttgccttttctttaactcctgccttccttcaaagcctgacttctgtttatcccatgaaacctcctgacaacaccaactcagaagaaaatgcttcttccagagatggagtctcactctgcggcccaggctggagtgcagtggtgggatcttggctcactgcaacctccacctcccaggttcaagcgattctcctgcctcagcctcgcgagtagctgggattacaggcacatgccaccgcccagctaatttttgtatttttagtaaagatggggtttcaccatgttggccaggtgatccgcccgcctcggcctctgaaagtgctgggattacaggcgtgagcgactgcgcctggcctgaagtttctataaaagttatcatctgaaatactcaattggctataggtcaataatgttcatgttctgtgactcacatatttccaattatgttttatgctcttgaagagcaaggaccgtatcttctatttcttttgtaataaagcacctatgtcagaactctatgagctacagatctcaacaatagccatcaaacctagtgtttggagagcagaattgggggaaagatgacgtgaggtttttggtgacttccttaggattttctcaacaagccattatttaaaaatgattatttgagattccattagtttgtttcagctttaagcacatctgtatttgtaatttctcatgtatgaatgttcctttcttcacaggtttaagaatgttacatttgatatcatagctactgaagatgtaggcattttcgatgtaagatcaaaattccttggtgttgagatggaaaaggtgcaactcaatattcaggtaagctgctggaatttctgcacattgatgataaattttatatgtggatcatacattgctaccctggctctctctcttcaggacaacaataaagtttaacagaaaaccagtgccagccttatttgccaatatttgttaagtgttgatgatttttaagagctgtgacttttcaaatgattggaaattgatatgcttctagctggcaaaccatagcagtcagtttctctaagccatgtttccattttaaagcttagacaaaagaatataatttaaaagtattcagagctattaaataaatgctataaattttccttttattggaaacttgcatttctttctaagactatgtatgcccaggactggaactttcatgatctcatttttccctctctcctagaatggtttttcttttttgtggggggagggggtgggggtggggcattgagaaggggtcttgctctgtcgcccaggctggaatacagtggcatgtatgcccaggactggaactttcatgatctcatttttccctctttcctagaatggtttttcttttttgtggggggagggggtgggggggggcattgagaaagggtcttgctctgtcgcccaggctggaatacagtggcacaatcatggttcactgcagcctcaacctcctgggctcaagcgatcctcctgcttcagcctctcgagtaactggtactacaggcacacaccaccacatctggctaatttctgtattttttgtagagacagggtttcaccacgttgcccaggcttgtcttagactactgggctcaagtgatctgcctggcttagcctccaaaagtgctgggattacaggcattagccaccacacctggcccctagaatagtttttacgtcaatttattaactctatttgtcaaatgcttgggatcacaggaatgaaaggcattatgcaaaacagatatctatacatagaaaaatggtgtttgcaatataaattatcgttattttatcataagagccacatttaagccaaatacacgtaaatgaaaaccgagaaatccagtttctgtgcaaaaaaaaaaaaaaagagagcactgcaaacaaatgttcatctgcccccaacttcttaatccttagcacaaaaccaatttaaagaagtaatttatttttcttttttgatgtaacactttttaaatggaaataacatcttacctgggccccaaactacttacaaaatggtttccaggtattttgcatatgtttacatgaatcatctcactaagatcctgagagtgatgtgaattctggcctcactgtctgtgcagcccagggctccatgcactggaattacttccccatcatgggagtgtgtgccagagcccttcttttctggcagcccttgtaagtttaaaagaaaaacgggagctgaatgggtttgataaggacattgagataatggagtaaattagaattcggagataagatgaaagctattatgtaattattgaaagtataattaagtaaacagtattgttttctaacttactttaaatgtcactaaatgtatccatttaataatttagctaattagggtcttcagttattttgtgtaacagataaatacaggaagagaaaagaaggtgcttgtggtgataccctttggttagtgattcctctgtagaaatagcaaaagacatatgtgattgccaagaaggaaattatccagggccagtcaatatcaactggaccaatgagtcacaagtgaccaggagacaccttatattgtgtttagagagaaagcaataattccatgagacttcctttgagtactggtataaaaaccaagcttcacttgttcctttgttaaggattctgtatacagtaagattagctgttcataccattcatttatacacataatggattgtgaaatgttaatccttagctatatgcaggtgaccagtatgtcctgggttttttaaatcagtagtgcataatcagaactggctacatccttagcagggctcagagcaaaataaaaatgcagtgccctgtttttaaaattattaaggattttaggatgatgacagaagagaataaaaccctgggcatgggaccctgtgcggctgcacagattgcatacccacggagccagccctgcatttgatagctgtcagatgtaaaggcagacttctatttatatatgcagctttcagtcaattgcatgaatgtgtaaattgtcaaagagaaatgtgatggccaggtccttactgtgagtaaaggaccaggaacaggaccaaagtttgaaaggactaaagaaagccccttctaacattacagctctatgtctcttggttatcttcagcccattttcccttcagttcctaaagaaaaccataggatagaattatatcctataattataggccatataggtaacaggaggatatgacttatgtgatatatattcttcttgtaaaaataatgtcaggtatttatcggggactgcagggtgggccttcttcctctcctagatgaagaactgaggttcagacagctaattatggaagataattagctgggataattatggaagataatgcagctgggatccaagttcttcatcactctagtccactgcctgtctcataggattccagttgatcctgcaagacaagagtagcttacaaagggtttgcatataccttaatctcatatctcattcccagtagcacccttgtgaaattggcagtgttatccccaatttacacacagggaaacagaacttcagagaagttatgtcatgttgcaaggtcttaagatagcaaatggcagagctaaaactaaagtctgcttttcaagtcatgagtccagccatgttttctctgctccctactttggggacccagctacttcccctacatatgccattccttttcaatctaactctattggtttaattcttttccactagactttgtttaacagatgttgcatttcccagaggaaaagtgaatctcctctacactctaaatagctaaaagtattattgatgaaaggacttcaattccctatagaattttagttctagaagcatatctgaataatgtaggggttttcttaagtgcagtgagaggtaattgaggaagtggaggaggaagctgccaagagtcagagttctctcaaagatgactccaacttctacaattgaccttgctagaaacaagaaaatgagacttagatattgggccaggacagctcaggaattatatcttccattgggaaaggcttcctgtacctatgttactatgaaatgttacagcttagtttcatgcatatggctggtgtgatccagttacttattttaaaaagagagttgatttcctttgtttatatgctggcagtgaaaaacagaatgacagttcgacttaagaatgagggcttgttctcagtacagaaacagaagtagcctagatcaagaagtgcggaccaccgctttgtacaatggtctccaaactttggtcacttcatcaggaaatagtatgagcacttctctccatacatagttatttgtaaagtatacatgcttctgctattgtactctaaaacgtgctgtattatataccaaaaaagtccaaaaaatgagaaaaaataaatagaaataggagttctaatattctttttgcttccccagtgaatgtcttgctcacttcactttaaaaaaacactgctttctgtgtttttgtttttgtttttgtttttgtttttgtttttcgggttttttgagacagagtctttctctgtcgctgaggctggagtacagcagtgcaatctcggctcgctgcaatctctgcctactctgttcaagtgattttcctgcctcagcctcctgagtagctgggattacaagtgtgcaccaccacgcccagctaatttttgtatttttagtagagatggggtttcgccatgttggccaggctggtctcactctcctgacctcaagtgatccacctgcctcagcctctcaaactgctggtattacaggaatgagccaccacacccagccagaaaacactgctttctaaagaatatgcatctagccagaactttgtgttttaacattttcgattaaaaattgaaattatatatctgacattaacttaatgatcatcatttactttcatacagcccttatcaattccaaaaagctattttctttcatctaagtcacaatcacttgggaatttattaaaatgcaaattgatgggccccaccagagagctacataacaagaaattcctgtgggaggagcccaggcagcctttattttaactagcctatgtttttaaccagatgattctgatgtacacttaagttttagaacccccatctatggcctggtgccatggcatgcgcctgtagtcctggctactcgggaggctgaggtgggaagatagcttaagccaggagtttgagaccaacctgggcaacatagttagaccccacctaggtgattaggtcaattgaatctgacttttgtcaacaaattcttctaatatgttttttaaatgcacaaaatgtcaaagttgagatttaatgatgctttttacaatttcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccattaatttggcttttaagttgtcttaataaatcaaagtcatttagtgggtaggggaagattcttggtcgggtttgttaggagagaatacatttcttgctgtactggttaaagtagagagcaagctgctgtaaggaaaagatacaaaaccctggtgtctaaaacaaggggtagaagtttgtttttctcaaattcagctcaacggtgagcagatccacaaggtaaagagtttccaggtgggtcagttggctctgtccttgtactgattccccccagccagatgaggaagaggatgacgaagaagtccagggcaagccttttcagttatacgcatcactttaacttccacttacattgtattggccaaaactgagtcatgtggacacagctagctaaagatagtccctaactaggcagccatgtagccagtgaatacagagaggtagagagggaattgggtctgttattaaaaggaagaaaaggagtgtgattcctgctgacagtttaggagtcttcaccacaaaaggattccagactctcaggctggaacctccctgccactttgttcatgcctgcaacaggctttattttttcacaaattgcaaaatattgagaaagtaggttagtttatgtacatgtggcacaaataaacttgaagggtaagaccaacagaatttggaaaattcaaattaaaaaaagtaaaatctgctactttagtgatggtttcaggctatgtatatttttttgacaaagagatgaatagcttaaaacaatgctcactatctcaacagtttgcgggtatgtatgttttgtaatgcattagccttaatgcaggctttggtagaaggaattaaatatacagttaagtttcacgttgaaaataaacctccctcttgccctactgctagcattggaaaggggaacaggagccaggggcaatgaggggtgggcagggtaagcttccttcttgctccgggcaaggcttttagtggaaatgtatagaaggagccaaaattagggagcaatgttttggaggcaaaagccagcctttcccagcatctctgaaaggagcttatcttaacttattgcaacactgaatgatatgcttgaatgttatttgtacgaataaagatatttgcatcatgtcaataccttcaaggaacgctgtgaatgatttctctgttggcccacaagatgaggttattgttgaagacatcaccaattgctatttgtgtgagatctttaagcggtatgaatgggtgacctgagaagaaggctcatgatgaaggaacaaaaccaagggccatcggggcctgggtgtagcagacttcagtttacagagatttgttggagccaagtcctgtgctactctttaagaggactaaactgtccctcaagccagaggacaattcttgataaccctgagcctgagccactaaggactccaacttcctcccagagcccatagatttttcttactcaatggaaaaggttttttgttgtttgggttttttgtttgcttgcttttttgcttttaaacactgagcaattggaactataacttatttttgcaaaactgactcctgtattttgattattttgattattttgatcttaaaagcaaaaagtacttatgcaacactataggtgctctcaaaggatatgctttagtggtcttcaggagaaggaaaatatgtgtatgctttattctgaaagttagtggtgaagaaagaccagcttggtgtgaccgttgtctgatatgaatgatctcaactataattatacgttagtgtttgtgtgtggttgggcacaaattagaaatgctattcatgatgtgatttttatgactttgtcattaagtagggatttgtggtattcctcaaacattccaagaggcaaaccacaaaactctgaatggtgaaagttgtctttattttgaaaaattatagtgagcactggatgttcttattgctggttagctttttgaaaaatctattgccaatgt

SEQ ID NO: 16062 - DNA, 9003 bp, Human
tgcagctggagcaggggaagctgacaagtcagtcctggcttggggaggcagaagtgaggggtgcgtatttccagcaggtaaggagaatgtgttggtttcaggggtcccccataccccagcatccatctttcagtttgccactgttctgtggatatgggagggtcaccccagttgcatgtctgtgggaccccactgctagcagcagcagagtgtgtgcagagagccagcacagaacacagccaggccgcccggccagtggggctggggctgggacagcctgcggtgggggcggggcccttgttgcctgaggaggtattttcagagtacccctccctctggagtttccaacggtagaatagagccctgtctagtatttgaccaaatatggtggcatctctcatgctcgagccccagccagcatctcagttatgctgtggaagcctgccccggacagattaatcttgtgacattcaggagcgcctctcaccctgccttcttcccctcggacgattcctgtaaatggccaagaccggccctcagcacgacagggccgtcctcagtatctgttcacaatgcccctcctctgtcctcctcacattccctcccgccattcctgcctccctgggtggatgtgcccgcttacattgggctgggctgttcacctgaggtgagagacattggccagaggaggtggtcagttgagcatgtgattccaggacctttggaccctgaggtcatccgacctcacaaacttgtggcctgaatcttggaggcctagacctctctcagcagccaggagggtgggcctgagggggttgaagggagagtcagtagagaaatgagaaccatgctacctctaatgctaattagaacaactaatgtttataataattatacaattattttataataatctctataataaatagctaagtgtttattgagcacttactatgtgccaggtactgttgccagctatttaacataggtgatttcctttattccttatagcagttttaagagggtgccatgattcttcccattctagagatgtgggaactgaggctcagaaagatttcaggagggaatgggccaggccaccgtctacttctggatacacccaccattttatggaggagggaactgaggctgacagtaaagctcacatgcagccacacagtctctgagagcggagaccaccccaggagggagagtgctgtgtcaggaaggccaggacaatcagccgtaagtcctcatggatctgaaacttggccagagtgagggcgtacagcttcagaaatatgttcacagcaggctgaaattgtgcggaaagtctcccaagaaaaacaacatggggtggtggatagagccctggatggggacagggtgagaatagcagctctgacacctctaactcactgttaatagtgacaagtccctttctggctccagcctcagtttccttgactgtgatctagaggggtggggctttggtctcctagggctgctgaactcacctgaggccggcagaggctggagtgcctgaggctgtttccctgggagatggggcctgtgtcccactcctggccagcacaatttgagaacatttgctctcctgaccaaccaacggcccatccctcctccaccctcaaccccttgccatcccctaagcaaacgaagctgattgtcttagctggccctgtgggtgctggctgggcggccggccgcaggccacaggcggaggtgccaccggccagagccccaccagacacacagggcattgtccctcggtcaacagcccctgggcacctcagctcggctcctggcctgcccccacgcccctcaccgcctgccactgcgctaggctcagccagctgggggcccaaggctcccagctgatgacgagcccacccactcactcccccagcagcccccagttgagctataattgcttcgctccatcctgttgctgccattctctcggcggcatctggggttccaggcgggcagcagctgcaggctgaccttgcagcttggcggaatggactggcctcacaacctggtacgtggcgcttccctgccgcacccccacccctttttaagagcccaaatatgtcagtttttctttcctattgattaatggctgcctctgtttggtttagaatctgcagaggcaacttctctgtcttctcccccaggactagaaagaaacagagactggtcactgtagccatggccagcagtgcaggctcctgaacggggctcagccggggcacactgaagccttttcagaccagaggcgtctggggagatcccggcaaactcagttatcggggtttttccaaagagacccggcttctgaggtcctggctgtgtgaccttgggcaagtccttctgtttctcagtgtcccatctggagagtgagggagggggactttgattctattctacgtttctccgagtggagagccagagtttaagaatgccctgtgagaaactctaaagagagagcctattgttagggagacattttttctgcactagaatctaggaccaaaaaggaagaatttagcacttgaatctctgttgcagattttgtgccagcaaatacctctgccaagaggggctctgctgaaacttgtttcctagggtcaagacttgctgggtagcctggataaagcaggcatgggccatggggctgtggggctgtgaggtgaggcatacagggaacatatggagcctatctcaatttaagaggagtcagaggtgcctccatcctgggagctctgcctcacacgcaggcactgtcccttctctctggattcctggggagtctggcttctgccgggcctgagtcctcttccttgtgagccaaaggctttcctgatactctggtgctgggagggagaagtggatggcaatgggtgagggtgtgtgtgtgtgaggagggcttgggggatggctggaagagggaaggctcaggggagaagggcagtgcaggcggacaggacatccttagcccataacttgcccatctccccagcttcatctcatcccctcttcctcccacccactcttaatcaacattccattcgattcagcaaagttcttttttcttttttttgagaggagtctcgctctgtcgcccaggctggagtgcagtggtgtgatctcggctcactgcaagctccgcctcccgggttcaggccattctcctgcctcagcctcccaagtagctgggactacaggcacccgccaccacacccggctaatttttttgtatttttagtagagacggggtttcacagtgttagccaggatggtctcgatctcctgactttgtgatctgcccgcctcggcctcccaaagtgctggcattacaggtgtgagccaccacgcccggccacagcaaagttcttaaccagttcaaacctcctctctcatcttcccccaacccacccctcccacacctgcaagacttcaactccctcagcccatgcctgccatgcctcacctgacatgtcccttccccagaaaagtttcccaggccattgtcccagcacagctaagcaggaggccccactcttctccagccacaccctgaatgggcccatcctggacttgtcgctagggagacttgggtgtttgtcttcttgttcactgtcttccttcttagacataaatgacagaagggcagcgatggggacagccattcatttactcagtgagtgttcactgaatgcatcacgcagacacgggagatatgacagtgtgtggaaactgacacgtgcccccacggagtccatgctgagttgggggcagacacataaaagaattgtatacacaaactttaagattgaagtcatgcaagaggtgtgtgggttatgagagcccaagaaagtccagaggcatccctaagaaagcgatgctaaagctgacacgaggggtgggaaggtgtccaggaggtgaagaggcagaatgctgcaggcagaggctgtgcaaagtccctgtggcaggaaggagcatgctgagtgtaagactgagagaagaccagaggctggaacacacaagagagaggaaacagggggtaatctgaggagggagagctgggggatggtaggcagagtcagacctgagcctgggagacccctaagagcaatgggaaaggaccatggaccccaagtcttggcccagatagagacttggctctcccacctttgacctgtggctttcctccccagctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacaggtaggctgggcagtggtggcaagctgtctttggggggtggggacctttcctgtgccccagtcattgtaatggttaagatctcagattcagaggtctgggtgcttgggttcgaaccctagctctgcctcttacttgcctgtgaggctttgggcaaatggattagcctttctgggcctcagtttcctcaatgtaaatggaggcaacagtagtacctcagagtcttgttaagtgagatatccatgcagagcactgccctcattgttcttcaagtctccatggaagtgcctgcaaggctttccccagatgtcacttcctctgctctgtgggcctcggacgcccttctcaggtgtggcgcttccatgcggtgttccagtctgtctcttatgctggacctgggccttcccagtgccggcatcagaatcacctagggattcccatgcccaatccaaacctccagcggtgaggcccaggaagtgctatttcttatagctccacgtgatcagggcgcacagcaggctgcgatttgggaatcaagacccattgccctggataacgatggcagcagcgtcctctcttggttgtagctccgcttccttgctcagtgcctgacccatagtaaggaccaaagatgaaggaaagggctgaccctgaggtcctcactcacaaacccaggccagagatttttcagccacatgacatataccctgagactctagaatagcactgttcaccagaactttctgtgatgatgtaaagtccagtatggtagccactagcctcatgcagctactgagcacttgacatgtggctactgtgactgagggattaactttgattaatttttttattttttgtttgagacagggtctcactctgttacccaggctggagtacagtggcatggtctcggctcactgcagcctctgcctcctgggctcaagcaatctttccacctcagcctcccagtagctgggaccacaggcatacctggctgattttttttttattttttgtagagacaggatctcactatgttgcccaggctggtctcacactcctaagctcaagcaatccacctgccttggcctcgcaaagtgctgagattacaggcgtaagccaccatgctcagcccgattaatttgacacatgaagctagtggctactgcattggacagtgcagctccagaatgtgaccattggaagggtcggtaaagatcctccagaacggagcttttcacatctgattgtgccaatgaatcactcagggatctgataaaaatgcagcttcagatttaggaggttctgcatttctagcaagctcccaagcataaggtgatgctaattctacatgtccacaggtccagttcacccacttccttgtcccgtatttagcagatggggaaaccgaggtgcagaaaaggagaggtcacaaagcaagtccctgtatgcaaggctccctgagagcaccaggagggaacttgtctgctttgttcatcaatgaatacctaaaatctaggacagaactgctcatgtggtgagcatgtaagtgttgaatgaatggagattaagtcagaatagaacccagacctcctgacttctttgccagtggaaattaggcatcaataaaaataatccacactttatttccgtggattaagtttcccaacaatataaacacagtgggggtggggcaggcagagggaggccttaatcacttgagcctggggaggctgatgctgcagtaagctgtgactgggccacttccaccctgggtgacagagtgagaccctgtctcaaataaaggaaacacatgagggccctaggtggtagagggctactccacaatccccacagcgcaacctagtactgggatgggcatctggctgcacgaaagaaggaagctgggtgactggtgaccttgaagctggataaccttggggctctcgacttgccttccatgatcttcagtttcctcacgtggaacatggagttgattactgcctttcctccagcccaacacagtcttgctgtggaaattaaaactctgattaggaaaggcaggggtgtggagtatgggtgctgactggccctttcctgatcaccttccgctctgctctttcttctgctccctgcagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctgaatcacctggcccagaagccaggccagcagcccgagaccatcctccttgcacctttgtgccaagaaaggcctatgaaaagtaaacactgacttttgaaagcaagactttgggtttgctttttgtggcttcgaagtcaaaaccagggtcagggtaggaggttcctgggaggtagatttcagattaatataaaggaggatttttcatcactctgagttctccaatactgaggtggcctattagaaaataatgtgttcacctctaccacctagggccatcatgtgtttcctttatttgagacagggtctcactctgtcgcccagggtggaagtggcccagtcacagcttactgcagcatcagcctccccaggctcaagtgatactcgcaccttagccactcaagtagctgggattacaggtgtgtgccactacaccaagctaatttttgtattttttgtagatatggggtttcaccatgttgcccaggctgatcttcaactcctgggcctctctgcagatcagacttctgcccacctcggcctcccaaagtgttgggattacaggtgtgagccaccacacccggcccatgtgtttcctttaatctgggtttataagtctatatttcagccatgttaatgtagcttggttgctataaaccaatataggagttaacaagagttaactctacccacttaagggtcactggaaacaagctcttttgaggcggggagctccccatctctgaaagtgttaacttaaagccaggcttctcaaaggtattatggagcagacccctgctctggttggagtagatgatctaaaaagtctttttcagctctgagattctctgcagatcagacttagacccaaagaaaggcctccaggttgccaaagagcaggtgcatcagagatagtgcatccctgaaatttttatgtatgcactttttctgagctgaggattcctggttttgaacagacactcgtaagttgagaagtgtcaatgtagatcattctttcttccagccctgtccaaaaggggatcttattagatggtttgctgatatcagtgattctcaaactttagtgagcatcagaatctcctggagggattgttaaaacagcttgcggggccccacatctagaggttctgattcaggtggaggctgatactttgcatttttttgcagtgtttttcttgcatttctaatatataaacagttgttcccaggtgatgctggtgctgctggtctgggctctgcactttgagaaccactggcttatattaagatactttgttgatcaaaaatggcagtgtgttggcttactcctgtaataccagcacttcgggaagctgaggcaggcggatttcttgagcctcaggaatttgagaccaggctgagaaacatggcaaaacctcatctctacaaacaaaatacaaaaaatagcccagcatggtggcatgcgcctgtaatcccaggtgttagagaggctgaggtggaaggatcacttgagcctagggaggttaaggctgcagttagccatgactgtgccactgcactccaccctgggtgacagagtgagactgtcaaaaaaaaaaaaaaaaaaaaaagccaaaaacagcagtgtggactaatatatcctaaagcccatgctgactcttgatgcaagagtcccctggatgcaactccccacttcccattttgtcccctagcaattcaatcctccccctgggccctctaacccctgcagcaaatcccaaatcagctgttctagggtctaaaaataccttccctcccacaagacagctgaggggctaagactatattctgagggtaagaatagctagcactttagagttaactttaataaaagggccaaccgcccaggacaggaatatgtggcttggctgctctaactttagtgcttaaagcagctttagctctgaatgtcttaagggtctaattcatgaaaggccagtgattaggtatgtgcctgcctgggatggtaagtaacttaccttttttggtattgttctagagtggatactggttaaaattaccccaggaagcttcggctgggttccagacacatggaaaacagacttcctg

SEQ ID NO: 16063 - DNA, 66989 bp, Human
  misc_feature (1)...(66989): n = A,T,C or G
gtaaaatctacaggaaagatgcagagagagagagctctgctggtttccatagtatgtagttaattctccttttactctgttctaaatataatcctgctcatttgcatgccaatccccagaatgctttgtaatttcacaactcttggctagtggtctcagcacttacgctttaagaacaaagcaaaatgtttagggcgtgcctttggcccagtctttttattcccccttgtgttttgcaagagtatagggaggtgatctttgcttggcattcatcctcctttgcagagtatcacagaaataaagtggagactgctgtggacttttcttgcgaagactgcattcagtccaattaaccataaataaccagaagcttggattaactcacttgagagggagtgtttaaggggggctttgtgtgtccttggattatgtgaccagtctggttcgtttcgggtttatggaaagcccaagccggagtattctgtattctctttctgtggatgccttatatagtttctttatcgcaagcacgtcttcactttaatgacaagatgtctagaattgccatcagtgggctgccttatggaaacgtgaattcaagattcaacacagctttagtcatgcttagtgacatacaggatttctatttaatagaacattaagattgacaattggggagcggtgggaaaattgtcttcaaagggttttataattttttttgcatagcaagtctttttttggttccttaaattttatgtttggaattatttgtcgtgagagttgaggagctccctcacccccagccaccactcagaccccacccacagtggcctctccaaatatgtctccctttggccgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaaggtaggagatccgacgaggagctggctgggggcggcggcgcccgcaactcggccccgcggccgggagggcgtagctgatgctcccacccccgggactcagcctccgctcccgaaaagcccctcgcgccccctggtggctgtggagcagcctgactccgcagcactcgcgaatcagaaaaaaaaaaaaaagaaagaaaaagaaaaagtgggtgaggcagatgcaaagaggaaaatcaatagggataagagagaagagggaggagtcgcagatcagccattcttgtcttatggggtcccagctggcgcagcaaaagaaaaaaaaaaacaaaacccgggcgtgaacgcgggtggaggagggtgtgcgtgggggggcgggggtgaaagggggaccggggagatttactattgtctctggcagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacggtgagtccgggcgccgctgctccctccctcctcgctcgctccctgtccgctgcgctgcgggcggggtcggctcggatcccgccggcttctctggcctggtccccggggagggacggagacccggggtccgggtggcggagcgcggcggtcagtccagccggcgccacacagactgagcgaccctggggtttggggaaaacaaaacaaagaggaaacccaaacagtggcacggagaactttggattatttatcctcccttcccaccgccggtagttccccaggagcgcggggctcgcggctctcccaggaccactgctccgcctggagtgtcggtttttgccgccccaggttgaggtgtgctttttgtctaaggatccttttggccgtgctgggtttggagagatgacacctttccccaggggtacttggcagcccgaccgcgcccctctcccagctccagccccacggctctgacccctgcgccgcgagggtggcagggtgtctggaccacctgtcctcgccgtgtccccttcttgcctgcgttcagtccgactcatgtttcaatgtatcgtttatgggactggacagctaacgtggctgcagtgggaatgatcaactttatgtgtgtgtgtgtgtgtgtgtgtgtgtgtgtgtgtgtgtgtgtgtgccttcgatgcactatacatttttcatttcttttctccctcacatcaaagaaaaggccgagtttttagagcagattttagtttactgtcgcgggcgcacgctgtatgcatgcagtgttcaacccattgtgtgcaagacggagacaccgcgactggcgggtgtcagatgcgctagggtgtgcctagggcggggtggagaggggacgtgccattatcaggtacagaagccgcgtcttcaccggcgcccagcaaggctgggattccgtggtgatgcgctgtaatgatgcccccaaatagtaggcacatatggcaggctgggatggtcatttacaaaaatagaataaataaaaactaacgttttttagtttagcacgaagcagtgcggttgtgctttgtctatagtgaattggatggtgtgtgtgtgtgtgtgtgtgtgtgtgtgtgtagtgggggaatgggtggctactccatctttgcaagctgaacaaaggaagtgatcagctggcccctgggaggctctgcagccgccctagggcagagctttacctgccacagtagttgatttgcagggtccgccaggttttgttgtgggcatgagtctgtttgcacttgttcccttaggcttggaacatcctgtgcgtttgcgattgagatgcagaaccttcccctctgcaggcaggaagaagcctcccttgcgcctactatgttttattgtcaaatggtttatttcttttgccgcaccatacctttttcatgcaactgagcttcacttcacacaaatgcaccccacccctaccagcttcccagctggtgctggggaagaaacactccccagggagaagagttgaggccagcagggatccttttgcctggtagaggctttgggttttaactgatcctcctttaccactacctgatggcattcactttccattattgaagaaacatcgtgggtcttttacaatgcacagtattgtctagtgctgactgtcttgtctttccaaagagctgtggaaattatcatccaaaaaaagaaagaaagaaagaaaaaagaaaaaaagaaagagaaaaagctgattgggacaaaagctcaatttttacttatctccccaactcaggagattgaaccacagctctcatgctattctatgctggaggtatgccacatgtatctgccacttgctttaacatccagtatatatttgctagttttcctgtttgggataggcagagaaccgatattttttttccctcctagactgcagtggttcttcttctggactcagcctgtgacatgacattgagagccacacccattcttctaggtatcatttaagccacctttaaggaaagataaggaaattcagcattgataacttgccttaggagctccagtaaatgtggttgtgccccaatcccaggaccagatttgcagtggattcccttttgtctctggttgaatgatcttccctggggtacatccttcattttcagtgcggcttccatcctttctctctgtgtgtggggcgtggtgctgcatagcagcctctgccttgaagctggggctgtatctccagcagctgttaacaggagtagacagtggttgtgaatttcttcaaaccaggctgccttgaattcattggttttaacaaccaaggggatgaaaaggaagggcatggcaggaggcggatgttggtctttggggataaggaatccatttgtaaattttctcatgcttcgtttttgcatttccatgaacaaggaatctattttagaataaaatatttatgtatgtttgcatgtctatagaagattatagttgtctatatactgtgaaggttgaggtaccttttctagatatagttgtaaatataacaatgtagacatagatattcatgtgcagcaaatatgattaaagatctaagtataacatataccccctaccatcaattctagtacattttaaaaatggtaacatggaatttgaattgaattttctatgccacctctattcctttctgtgaaggcagccccacccagtagctgaagtgtcactacaatctgaggactagtgggggcagtctttcttggcctggtaccctttgccttcctgggaactactttctaccactgttttgggtccaagataggattggttgtttttgttttgttttgttttttcctccttccacctatttttattgccctcctgagattaaggcattcttactatccttgttttattggtttcctgtggtagggctggaaatgagggggagatttctgtgtccctgttggagttggctcggagtagctacctttctcccgagtagctcccaagacttcagatcttcattgtcccctctcagggcagctatgtggattatctgttctacctcaacacaagccttgcttctaattatcagagactggcagttttgggggttcgacagatcacagcaagggatcttcactgtctcgcgatgggcctggtttacagatacataatgattatcacttaaatggattaattgatttaaaattgttcctaataatagcccatacctgttgagtgtttattttgtcaggtattatgtttttttatgccttacatgccttgtttcgttgaatccttgactcagtcaatactgtctgagagggactatagttacccctattttacaagttaaaaaaatcttagaaaataaaaaataatttgctcagggtcagagatttagtaagtgttggaggccagacttaaacctacatacccaactgaaattaaaatgcatgtccctcaccatcacactctttttggtgtctccgcctctgcctctctaccattgctgttacttgacattggtagggcaaatggtttccagaccatctgcactgctgggaggcatatttttcttgtcactgtcaacaaatcccacaacatggtctttcctaccttttatattaagtacatataagaacacgtttttgaaatagtagtcaccatcaattctacaggtaggaacttttgataagttacagttattgttttcctctgacatacgttacaacttgaagctgaccacaggaatgggccaggtcctaatacttaggcacttaggttccagtgttttatatgtattttcatattagaacctccacagataatcatttcccagttaaggaaggacattgaaatatggttaggtgaagtcagttatttagagttgcctggtgagaatattggggcaaagctagcaatcaaagctaggccttgtccagcttcaaagctgaggctgccatggtgcagcagctgcctcttggaggcacgtgcagctgagatgttgaaagttgtggaaacagctccagaattccctctaggagacaaattatagagaactggtcttttccaaccactgattggatttctgtaaacattgtcttgcagataatgcatttgttttgcattgaaagtttggttgtgtgtgtggtatttgggaattgctggaagacgtatccccagttaggaatacaacttgcaaagttcggtctagggcgtgtagtcagagctctgtgatctcccttgaaagggtgtgattgtgagtgtagtaggtgccactggaatttattttctttttcggagaagtgaagggaccttatgaactggagtaacacccagatctctgcagcagttaagctgggggcctagaactagactagagctagaagaagggacaaatgcaatccgacctttggatctacacattcctcttgcttcaatgggtgtcatttaagaattagaggaaaatattaggagatggagaactagagttgaggaaaccaaaagaagaggagtcacagaaaaccagctctctctgtgcaaggcatcttgaaaggggaattccagagtcaaagacagaagaaaaatagcaaacacttaagaatggaaagcatcttagatatctgatcatggaagtctcagcccagtctcagccctgcctaaagtgttcatttgttattttaaattttgagcaggtatgtgctgattcttagccaggttattccttttcctcaaatactaggagaaggcctcaggtatagaaagagccctgaacattagtagctgtgaccaagccagctgggcattgggaggaattctgaagaaatagatttcctgagagaattcaagtctatgtggcaagaccctcagtttgtaaataaaaaaccttcctgcttattgcactgagctactaagaggctcaaatagtggccatgaaagtggtctgtgaactctggatgtgttcaagagagcagatgctgatttatatttataaaatctcaactactttggaatgtggaaattaataaaagaagacttgacaatggtctggtttagaaagagactacttaggaaatgattttgtaaaaataagagttttccaaaacaaaaataaacagcgttatataaaaacttttttgttgttgtttagttacgttacagtgttcctaagaattttatgcttgtcatctctgacagtccgacacaggccattagaccgcctttgaacttttgatacagagactctcccttaacctgaatagagggcattttcctaaattaattgaactctgtatcattttttagtcctgatcaccttctagcctagagtgacacatgttatgaagatcctttcagctgtttcttcataactcgttttttagtggcttgactgctcttttttcttcagttggaaaaaaataaaactaaatttgaaaagaacaacaaccaaaagaaaaaaaaacccctcctgtcctaatgggccctctgttctttacctattgacatattttatagggccatttgtgtttgcttattacatttgaaaaacggcaaaatgtttacagtagtaggaatgagtctctaaggtgtaaatgttttcatcctttgatgaaatcagtgcatctaatcagaaggagacaggaaatttgaatatgtcattacctcttgtgatggatatatgtgtttgtttgtttgtcttttgttttttgagacggaggtttgctcttgttgcccaggctggagtgcagtggcgcgatctcagctcacggcaacctccgcctcctgagtagctgggattacagacatgtgccaccatgcccagctgattttgtatttttagtagagacagggtttctccatgttggtcaggctggtctcgaactcccgacctcaggtgatccacctgcctcagcctcccaaagtgctgggattacaggcgtgagccaccgcacctggcctgtgatggatgttaataggagaggcgaactgctccctggttactccctcctcaaatcaatgctcaactttgccttttctcccactttctctaggcaaatgagaaacaaataagaaagaccttggaaaacccagagaaatcgactcctgtattttcagactccttttgctgtgaagtccctctttcatcaacatatgcctatttcaatatacgaaacacaggtatcctcccatccctcaaaaaaagccaaagctagtttggtggaatagaatgaacctctcaatttggcctcttcttttggttccagtccctacatgaagcccagtataaaaactacttttcttgaggaactttcttctgttaattagattgtagggaacacagtggtaagaaatatgggactaagcatggtggagctattattgttaactgtcttagtaaaagctacatggattatctcatttaactcacagcaactcttatagctacagttattaaccatcattttgcattctggagagaggctcagagaaactaagtaatttggctaaagtcacagagctgaaaaagcaagatcctgggattgatccctgcaaaggtgaattcgtttcataggcaagaaagcagtagttccataggcacaggtgactacctcctcccgccattagccattatctccagctgtccacacctgttagctcctaaatgtgggtcagtattcacagggtggaaggattggggatggtctggccaaccctgtcacatcactattggaacaacaagtgagttgtgtgtcctcttgacagtggttcatgcattgcttctgccagctgtctgagttagcttctggcttttgcccaggagcatgtatgagtacagggtggaaaagcagatgctgtttttctgccttgcttcagagcagatctgggtctaaggccctttctcactctctatccctgtcttcttcccagacatagccaggctgtctgtttcccttcagtcacgcggagaaacattaacaggacacacccagcactttaagctagatggggaagctccacagtagaatggtccaggaacccatttggaacatctggaattcaaggacaacatttctcatggcctaattactatttcttttctctggaagtgctggacaatgagattttaagggtaaaacgagattttattttttaagagaagagttcctcggactagaagagcaaaagaaccatcttgttcttggatgcggaataaggaagcgaaccctggagggagtatcagcacactgtgcttcaggcctgcctttgcctctaatttacttgtcactttgggcaaacccttattatccctctcagattctgcatcagtaaaatgagggcattgaaccagatgatccttgaggtccctgccagtgcaaatgaccctgtgagccagcccctcctcactttgttccaaattcacagagaggagttctaaggccttcctgtgagggaaaagagagtagggagaaagtggatgagagcgaccattgttggctgaaactcagagggaccagccaacatctgtgttggatataagcggctttggttgctttttacacttaaaatcccagtctttttctcattcagggagtagacttaattaatagattttgtgcagaggagaaatggaataatgatgactgagatcctctgcctagtagagcgttagtattaattcagatgaacattattaaagtgatatcatgattcatttgctgtcacatacagtctttctttaggataaggctactattgataagggcatgaaggcgataattgcccaaaatctagactggccaaacaaacaagaaaacaaaccaaaaacaactcggagtctgtatctgctcaccaggctcttttttcagctgctcttgctaatattttaaatatgatggctgccatccaatggaaataatctacccccaaaggcccaatcatgccatgtacatgccatgaggatagggatggtttttgttttgttaccactgaatctccagcacttaatctttggttgtcacatattaggccctctgtatttgctgaatgagtggatatatttaacacttacctacaggaatgatttcaagagagaagatcacctgaaagtgtaccaatttgttcttgtacataagcttccctttgacatctttctagaatattaacttctaaataaggccagactcttaaggcataggatcactgggccaagagaaacatgacagctctttagcagaacaagcaagtcattgtaatgcagggcctgacctgggcacatgtgccagaaagtccatccatcacttggacttctttcttgtctggcctccagtcctctttttcttccagcttctgcatctgggctcattctgagcttgtttcaggggcctacctggatacttattgcctgcaacaaagacatcatttctcttactgcaaatgatttgaaagaattaatgcagacctttatgtcgtctttcatatagaggaaactgtcaccatgactctttgaaccagaatacaacatagatcttaattgaggtctctttctgcctttgcacgtaaactacaaagtcattagagttattagcagcaactagatagaccaatctgcatttgtaaagcaaacttggtattttggaagtattggttaagaagcagctcatagttctttttgtttccctattagggctggacatttacatggaatggttttgtgtctgtgtgtttcaaaagatttttagtctcttaccccactgcacctgtcagctttctctgagctacatttggagctattcttattactcgtttttattctaaatgtaattctttggtttgaggggtggggccagttaacacagattttaccaggcttatctctgggtacaaaccagagagtttatggtttcaataggtttatgtgtaatggtaatcactagagccttttaaagggaggacaaaatgggagaatcaaagtatattcatggaaccaaaaacctttgattagaaagtgtttgaagaactatgtgtgttataagagtgtcatatataatataatcaggtatgataaaagcattttgctattttttattgcataaaagatatttattgaccataagctctggcaaaagttagtttaataataagaataattcacatttattgtaccctgtgtaaagtgctttttattcattatctcacttaattatcaaaacaacttaattaggtagatagatttttcaccaggtctttctttccattttattgatgaggaaatttagagagattaagtaatttgcctaatatcacacaaggcttaaatgatggaaccaaaattcaaacttaagtttatgtgacttagagcccccattcttaaccccacggtatggtgctaccttaaattatccctccggagggataataacttatccctctcccacctctggagtcacaagactttgattccaattggagttcacttacttcaagtccaggggtaagtccttctctgcacctgtttcctataaggtatgagtggtgtaggttatgggggacatggaaaacagttggtgcccctcttctgcaagggggatggactccttagcactgcttggcatcaggaagccctctagccctcctgttaagagcggctttgtttctggcatgtccaaagctgctccacactgttatacttacacaaacaacttgccagggagattcccaccactctcagcatctttgcattgaattagcaaaactaccaattagggattcttcctaacgtgaatttaaatgccaccttctcatttcatactccacactgcatgccccattctcttaaatatatcttaagtaagattcttttgaggtttgacttactatggctctgtaaaattcatactttcagagtctccatggagataacttttttctttatctctccttaaaaaaaaaaaaacgggatacatgtgcagaacgtgcaggtttgttacataggtatacatgtgccgtggtggttggctgcacctattgacccatcctctgagttccctcccatcacccccccaacccccaacaggccctggtgtgtgttgttctcctctctgtgtccatgtgttctcaatgttcaactctcacttataagtgagaacatgcggtgtctggttttctgttcctgtgttagcttgctgagaacgatggcttctagcttcatccatgtccctgcaaaggacatgatctcattcctttttatggctgcatagtattccatggtgtatatgtaccacatattctttatccagtctatcattggttctatgtctttgctattgtaaatagtgctgcaataaacatacgtgtgcatgtgtctttatagtaggatgatttatatttctttgggtatatacccagtaatgggattgctgggtcaatattttttttaagtctaatgccccatcttatgaataataaaaccaacacccaagtggtacccacctaattagtgtttttgctactatctgttttactgtgggacacaaggattttaaaattaactaaggctttttttccattacaaaataagtatgctggttgtagaaaaatttaccaaaatcacaaacaataaggacaataaaaataagctacaatgaaattactcagagagaaccactgtaaactttcagtatacccatctagatttttttttttgactatatttgccatttattaaaatgattccacatattgtttacgctgttttatgccttacttttcattgcacaatatattacgacatctttccatgttttaaatatccttccataatttaatttttaatagctatatattattacattccttggaaaatctagttaaatgaatctcattttttttgcattgttttgattttttccgagatctttgcattaacaacaaaaatgaaatgacagatttattgtcggttgttttttagttgaagccaaactaaaaactgcctcaggatgagaggttgagtaatcttcccgaagtcactcagctcacgagtatcagactacagattgaaatcccagtgtctttactcttagccttatattcttgtcaccactcattccttcattagttgtgccattttacatggaaaactctgctttctctcatttcctcccgctcttgaatgagcacatttgttttctcaccgccacctttgccttcctccctgtcttgctgaggctgttgacatttgtagaggtacactgtgtcttgggacctgaagctacgcagctggagaggaaacatggccagttcttccccactccttactggctcaacctataagcttggaagctggttttaattttacattttctgtgtgtatgtgtgtttgtttttaaaacttttttccacttaattctttcaaggagacctttatttgaaatcatgcactttttcccgcaaagcgaatctgtgcctcaaatcttgatgagattactttgtttggggatattgataaattcatagtggggtttttggtttatccaattaaattggtttaaattatggccttatagagagaaagggcctcagaaaacttagagggttttaaggcaattgaatataatctgcttctagggacttcatcctgggtttattccacaaagaaggtatgttctgtttgtttccttttcatttcacttacttcattgcatgctctatctcagaaccctttttgctatgagaaattgtgggaaaaaacagccttgcttggctaggggcaggaagagaaaagggacctgttattccaaccccttcatttgaatgattgagaaaatgtggatcaaaaagggaaaataatttgccaaggtcatacggtaaaataggtttaaaaaagtatgaggcataggactcatttttccttgctcttctgataacttttgttatgagaagttatagtgcttttctcgtaattttgttgaggaaggcagagagtgagggggagagtgaattatgtcccctacccagtaattaaagtcttaaccctcagtaccttacaacatgactgtattggaggcagggtcttcagagaggtaattaagttaaatgaggtcattaggatgggccctaatccactctgactggggagttttataagaagaatagattaggacacagacacgcacagagggaagaccatgtgaggacacaaggattaggggagtttgatctatataccaaggagagaggattcagaagaaaccaagcctgctgacaccctgatctcagacttctagcattcataactttgggaagataagtttctgttgttaaaaccatcagcctgtggtactttgttatggcagccctagcagagtcataaagggagaaagtgaagaacaaagaatgaaaaaattaaaaacttaaaacttgagaagttctcagagagcagaaaagggagccccaaataaaatttataagaaattatggcaggccagagcccatgctaactgattttcaaccataattgtgtatatggcatttcattcaattctattaccatgccgagatcatagttattattaacccactttacaaatggggaaattgaagctcagaaagttaatttacctcaagttacatcattattaactaactggcagaactaagtccaaattcacctcttgtcagccttgaaaaccctcacttactgtactgttctatctccttttaagaaggttaatgtaagctgcttaggaaacattacttatcaagttatttaatgttaggagaaataaaaaaatgtactccaaagtctcagtgacctggaatccacttaattgattagacaggaaatatttggcccctgattttaggataaaaagagagattggggaaatttaaaaagatagcataattagatttcagtacagtcttccccatggctgcactttcacatgtctaaatgaacagctacacataatgaagaattaatgttcatagtgatgtgccgtgggccgtgaagacatctgatccatcagagagaatcaacaactgtcactaggttgcatttgctaaagcaggaaaccagatccataaatctataacatgaggagacttggaagctgtctatgtcagagttttacaaagacataatttcagtgattagatagataaatatgcaatcaatccaaaagaataatcaaaataacctgagctgctggtaaacccagatgttatgttttttgtttttatttttgaggtggagtctcactctgtcacccaggctggagtgtagtggcgtgatctaggctcactgcaagctccgcctcccaggttcatgccattctcctgcctcagcctcccgagtagctgggactacaggcgcctgtcaccatgcctggctaatttttttgtatttttagtagagacggggtttcacagtgttagccaggatgggctcgatctcctgacctcgtgatctgcctgcctcggcctcccaaagtgctgggattacaggcgtgagccgctgtgcctggcccacccagatgttataatatgggaactatgaagcactttcaatattgaatgcagatggctctgtcgaagctgccttctcactgttttaaagttgtgaagtctatcaatcctgaaatatatagattaaatttacttggatatttagtaatgacacagtcaaggtaagaggtggacaggcattgttttcaacagatactgggatcgagtcccagctaactgtatattagctgtgcatatttgttggttctacctttagagtagaatattaagccaaccacttctcaccatttttcatcactgtcatcaccctcactcaagcctctgtcatcttactccaagaactcttctaacttttctctgtggtttcactttgcctacccctaaattcgttctctattcatgataaccaggtggtcctctaaaaatgtaaatcaaaccaagtcactcccctgctcaaatatctcctattacacctcaactaaaacccagaccatggctcttgaggtcccatgtggagtggccctgcctacttctctggtctccagtcctgccactgactgtcagtgactcagcatcagccatcctcccattatgacactttcatgtccagctcaaagcttctgtacttgttgtttttttttttctccctaggactcagattattcacatctgttcaggagacagctccttagacatgccctctttgaaaatgtaaccaaatgtcccagactctcttcccagcctccaccgtccccttatcctttttctaaatttcacttatcactgttgaaattacgctatttatttagtaacttacttattctttgcactttcagccactgcagtgccttattttattttgttcactattgtatcaatagtactgtgaacaggaggcatttacaaatattagatgaaggaatgaatgaattaatttagactaatgtttctttccctgggttaagtggtttggcgagaacagttgtcaaggaaacagggttatcaaaaggctgttagtctgtctgctccatgatcctagggactctgtgtcataccccactgtatcaccaaaacctagctcagtctacccctgaatgaatggaatgataaatgaaagatgaagacttggggcaacaggggaagagtgataacacataggtgaaaactggctgtgtctgagatgactgacaaagatgataacttgtttgctattttttggacaaaatttaatacatgttacaacatacatcttgctttgatagacataaaacatgtaactgtaaacttcagtctgaaacatttctgagcagagacacatcacaaaagagtagactattccaaaagaagattattcacctgttgttagactcatagaatgttaaatagtgatcattgggaagagaagtgggcagctttatggctttgcaggtaagggatgaagtcttggaggttctaagcacagagaatgtattcccataatgttaacatggtctttgccgatagtaagcggtcttgaatacattccaggaggtgcctagtatgagtaaagccttagatctttattgaaggcgaagaaaccttttgttctaggattaactacccacttgtctctgatttttgagttctgataatttttaagtggtgtctcgtttgtatttagttcaagtgtttgtttcattcaaggtctgcctgacctcttgaagtccttgttctcagagcatctgcagttttatctatcaatacaacttgaagaagttcagggccaaagaatcaaaaatagcctctgctttgataaccacctctctatccaatgaaagcagagttgcgggtgtataggtttttagacagacagatggaagcctgtaaccaagaaaatcagtcatcaccattgtctgctttgtcaagaaggaaccagaaaaaaagagcgaactcttccctttctttccttacccatattcttttatagaaggtgtgtttgggttgttgtagaaaggtagttaagatatgtggtatgaatcaaaccaacctaaaaagaaatgaaaagtcaagttacttttcagggataaaggagagggaaggtaggcactaggtggaaggctttgacctgagaagatttagggagattctagcttctaaaggaactcacatttattgagaatctgggcttcatcctcacagcattcctttgaaaaagatattattttcctcgctttacagtcaggactccaaagcccttctctttcccaccattccatcaggctaactggcactgattcatcacttgaattcttggactgctttaacaatgaggaccctctttgcactcctgtatgatagacctaatctttgaggtctggactacaaggcagagcaaactggaagacatctgtggtctttgagacaattccttccttccacactctccatggggccctcttcatggccgcctggtgtgactggagcaccacagctgagtgttctgttagacttgcacaccacggacagttttaggaagttacataagccagtggttgtgtgcttatgaccacaatccccaagaagctcccacaagctttaaaaatacaatgtcagacttgaagaagaatccctgtggcctccacaaatagatggggagctattgcctgtcatttgaaggtgcttctcacacattccaaggcctgagcccgcattcctcctctgggagttgcattttggcgggctttcagatttggtgaaaaggtttcttgtttctgagaagcaatagggtgggaattcactcgacgtctttgtcattgtaaaggccctgtcaaagccagctgtcagtcagaaaagatgaaaagagagagctgcttcttaagagggagctgggtaccattaacggcacagcctcttggaaaggcgaaggggatcacagaactttgaccggaatccttggctcccgactcccattctagggatctttccacccttcttttctgcctttcagttggcacagccattttcagcgtggcattaactcaagcccgtccactaacacctgacctttctcttaaatcccaggccaccatttcagtgacctgctacattgctgtatggttgaccagtacctcaaaattattcttagtcttacacttcaattttgttagtcctttttctgtttcctgtgtctattaatgggtcctctgtagacatgctgctttaaaactcagtctggtttggcacgtctgcatctgcgtcactttcccttcctcttcagttacttagttgattgacactttcttctgcagtatgccattgcattttctaatccatattcttcctgtcacactggaccacagcaattaccacattcttttacttttttataattttctttattaagttccttttaaaagttataaagtacattacgcatatgcaactagagaaataatgtaaataaatagaagagagagaagaaaaagtttaaaaggacccctacaacctctctctgcatcctttccttctacaacatccaatgttaataatatgatgtgcatccttctggaactttcttccagatcagctcacacaaaaatataataaacatatttacatacagcattttttgtttgctttgacaagaactacatcatattttgcatattgctccagaacttacttattttagatatttcttcagttcatgatatagatttaaaggtggccataataatcataatccatatttgtggtgatatcatagtttattaaatcacatcccattgttggctattcagggcctgggctgggtatttcctgcttgcatccccagatatcctctccacctttgtctaccctgctccatactccgtgtatggtgtgccttagttggtttctttgcccttgggcttctggttgcatttagctcttagggcaccaataggagattagagggagagtgaacaatgaagtcggggtattttcccctgattccttcctatcactaggtcattgtggggcagctgcatgtctctgctgaaggttacggctcctgccaggcagccctctccatacagctacagtctccacttccaataaccactccctcccctttccctcttctggccttggcaatggctccctgatgctggtaggccctggatgctgcatatccatttatttgccctaaacactgcccacactttgttaagtaatttctttgttaaattctccttaataacttcttaataattttatctgtttcctgctggcacccagcatgctaaaggtcttttcttattttgttttgttttttttccccctgccacttgctgtttctaagtttttccttcctttatctccagcatgggcctctgtcagcttgattttttgaccctatgattgactattttacttattttttgaagatccttctagggctactacatagtaaaggtcaaacttcctagttggcagccgtttgcatcccttattccagtatcttaagctttggaagaaggagggtgcctaactccacaatctcttatagagatgcatttcttgcatcgataccattggttctcccaatgattggttgtgtaatattggaccatgagctaacctccctaagcttccatgtcttcatcaatgcaataggaatgacagtagcatataattcatagcacttgaagattgattgaacaacatgtacttaaagcttctacctgttttcagcaaataagaagttttcagtaaatggtaattatgaattattgtaacacgctgtgatcataattgccgttggccatacccacgtgtacaaatcagctatttaccttagattcacttaggcaaggcctctgtggatcctttaatctctgccagacaaaagatttttctgcctgcctctctcctctctctctctcttccccccacctttcttaattaatagactttgttttttagagaagttttaggcttacagaaaaattgtgcacaaagtacagagagctcccatagactctttctcactccctcctcacccccaagtttcctctcttattaacaccttacattggtgtggtatgcttgttacaatagatgaaccaatattgatacattgaagagagtccagtttacattagaactcactcattgttgagtagttctacgggtcttaacaaatgaaaaatgtcatgtgtctatcattgcagtatcgtctaggacagtttcactgctctgagccacttcagtgctccgcttactcaccagttcatcccctccctgttcccctaccccccgccccaactggtaaccactgatcattttactgtctttctatagttttactcttcgtcattttaggtcacattactatttgcgatcctggcttacttttctaactgttttatctttacttctctattcaccttctgtattcaacttcatggctagtagttacactagcatatgtttcaggaatgaattattaaactcgtttacccttagaataaagacttaggttgaatttaggcacttcttcctgatggaataggcatttggcttttgcacaggcccaggggctcaagggacaagagatcctgtttgattgaagctggatgtcacttctctagtccgcatatgtaagagagcttccacccatggcacgtgtatttgaggcctaaaaaggaacaatgcaaagcaaaacaaacaagtaataaaacacaaaactatcatataaatccagaccaaagagggacatgaattagctctctaaagcactgacttggctttaatctgtactggactttatactctggtcctgagctacagatttctcaagcagcttgtataaaatggtaatagctgccttgtatttgtactgtaatttggatttgattttaacagtacatcgatattacaagagcagtagaatagaagttgtagcaaggtggtaggagcagtagtaatatgtgtaatacctaccacttaggagtcttttttttttttttgagacggagttttgctctgtcaccaggctggagtgcagtggtgcaatctcagctcactgcaacctctgactccctggttcaagcgattctcctgcctcagcctcctgagtagctgggattacagggatgccaccacgcccagttaatttttgtatttttagtagagacggggtttcaccatgttggccaggatggtctcgatctcctgacctcgtgatccgcccgccttggccgcccagagtgctgggattacaggcgtgagccactgcgcctggccaggagtcttttgtgagtaccaaccctgcatcatgtctttaactctcacagtagccctgtgaggtaagcattattatctatactttacagatatataaatgtacctttttagaaagatttaccttcactcagctgaagaagctgaggcacaaagaagcatcaagttagttgcctaaaaatcacagaataacttaatggcagagatgctaatgtagccctggcttctggactccctcagttgctacctacagttctgggggtagcttcaaaaactgctattaggctggttttcttcccaggcaggaacctttctattttttccaaccaaaagcccagttaaagatttgccatatgtcttcacttacccatatctggtttcctgttttctgataaggcatctttgttcctacacctgaccctaccccaccctgcctctttccccatccacccaagcttcggacccagagcatggtccccagtaatctcatccttctactgtactgcctgatgtgggtggtccccgtcactctactttgagtcctactcttgcttctcacaggcccatgtggacacatatggacctatacttcaatagcagagatggttccagctgtttcataagatcattttagggggttgtggaagaaggcattaaataacatggaatcacataatgacaaattttgtcccttttctagttctttttcaaatcttctgagtagatcaaggaaaaagtctccgtttactactagtttctcattaacatctccctgatccgtgataatcttcctttttaacaaaataacagatccaagatcatcctttagagccctctcgaaggcagcagaatgtagacaaaatttagtgatgtttttattgtattcattcctaggttcactgtttagttttggcaagtaatactagtttagaatttatgagactaagatagtgttttcttttaaaatacatttatataaggataatattaagcaaataacagcacagtttattgcaggctgtgtcagatatcatgcaggtagtgcacaaatgactgaggtttgagctacacagacccagctgacctttctcgttgagaatggaatctctctagggctcctcttgtccagtgctgtccctctcctccacattctcttgcttctggcgtgttatctatttgtacttatctgtgtctggaacgctgttgaagattaacagaccattatcgggagctaggattagggtgctccccacagtccattcccccatccactgtgacccagggcaggccacatcacttgtcaggccctttgataatgacatctttaaaatggttaacatgaagttctggggagggaagaatgcacatagctggctttgattctccagttcagacaacagagcagccactctgccctgattaatgctgccctgggctactgctgcctccacattgctgtttttcctaccttgtgtctgtccgtctagggctaaaccaaagataataaagaaagtgaagacagtgctttccatgtgttatgtattctgcttcgtgggttgcattttgaagggagtgccccaggttgacctacttccagcacacctcagtggtcattaagtatgtttaggtgatgaggaaagggaggagtgtttgagactctcatctgtagcagttcagaggtttggaatagccaaccctggtaaactatgcccaatttcaatgaagactcggagccaagaaactgcattgctcctcaagatgtctatcttctcccaggcctttctgtttgtctcaatggcatgcttgtcatcgagggtcctagaaacacacccatgtactggagggagcgtgggtgggaggcagctttaagaccttactgccctctctacagtcctgctggaagagtgtagattgttatctcctcacaagggcttatttccagaggaaaaatgacctggaggggccatgggaacttgccctgtggggttgggtttaaaaggggaagtcttggctgaccttggctgctggtggcaggagctgagaacagttgctgaggcttagctggggactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctctttttacttccttcctttattcatttctgtgttcctctctctttcattctccttctcccgcactgagttttttatggttagttttcctaatcagtatcataccctagtgaaggaaaagatgttagacttatatcacactttaaagtcctgtgccaagctggattgcaaagtagatccctttataaactacattaacacattcaggccattaaggggcaggtgtattgcactgattttatcagtagtggcttgaaagttactgaattcctaaagctacctacctgagagaactggacgcagtttggacactggaacgaattcagtatcaaatagagaagagagccctgtcagaaagagctgcttgtcataaggtttaaagacacttggtacggtgtcctaggagaaatcagtgatgtgccaggagatgggagacatgggtttacttcaaattggaactaatctactctgtcatttggagaaggtcactcacctctctgtatatatctccccatttggaaaatagaaatagtctctcaccaacatacttaaggcttaaaaacattcaaagtattataaataatattaatggaataaatgtaatatttattagctatttacttgtgtgctagattatacacgcacacacacacgcacactggcagccaccctgtgatgtgagctaagtattactatccactctgggctgatgaaaaaaaacgatgctctgagaggttaagtcccaactcaagatcacacacgtagttaagtggtgtgtctgattctcccagcagtggcaaaacctagctggacccaaacttgccagctggtatgcctagaaccctgctgggctgcaagacagtgacacacgtagctcttggtagctgtgcagggcctaaggcaggtcagtggcgggttgcttcaggctctgaatacgttcattttgggttccagatacccttcagattaccacagcatgccctagtggtatcatcattctttatatatatacataattacattagaaagattgctaactttgtagacaagaccatttaacctcctcagacatcagctcatggacgcttggcagtcttggctgccaggaacagaaggtgaagaggcccactgagccatattcatcactgagggaacttttattttattttattttaagttctgggatacatgtacgggatgcacaggtttgttacataggtaaacatgtgccatggtggtttgctgcatctatcaacccatcacctaggtattaagcccagcatgcattagctatttatcctgatgctctccctcctccccgcaccccacccaccgtgacgggccccagtgtgtgttgttttcctccctgtgtccatgtgttctcattgtatgtagtgtttgattttctattcctgtgttagtttgctaaggataatggcttccagctccatccatgtccctgccaaggagagagcaacttttaatcagagatgttgggtttgttcattttgttggcttttgatcttagcatgtgttaatctatcaggctcatccatgaattcatagacaaacacttttttgtgtccagtggggtttgattttatgtgacctgggggtggtcagtggttatgtcataccccacgctcacattccccagtgccaagcctaagaattgcctttcagattcctctttgttgatgactgatttgcctaggccgccatttatagtggatcccccttccatggaaagagttaaaattggggaggatagcagggcaagctgaagacccatagaggaagcatttatttgagctctttaagttcaggttttgatatttttgctctgcatggtgaaaacaaattaataatgttaatatttgtagcccatggagaaaactcttcttaatctcttctctgaaacctacaccaggcctatgattcatctttgggctctgtttagattcctgattattgagccagaaagattttatttaattactatttgaaaagtttccaatgacaccatctcaatggtgttaattccacttggatcagtgcttactatccccctgatgttcacaggtctggatatagcatttgcccctttgctgacatttcatgcttgttgaagggagtgatgatcacaccagtggctcagggctgcgtgtccttaggctggtcatatttcataactggtctcagttcagacagaaactggcccctttccaaaacccagtttagttcagttctttgctgggaagatgaagaaaatcaggaaagcattgagttatgagagggagggtactcttacagttaccaagattgttattattatgaagttcctgttgaagatgttctgtcaccttcctggacacacatagaactgtggggtggggttgggggcaggcaggagggcagtggttccttgtgctggtctgtgacttggtactgggctgcctgatggctgcataaggagcttataaaatgcagatttggtgatgtagagcacagcctgggaatatgtatttttctaatgtgtacacactagtttggaagcacagacctaggactgcctcatataattttgcagtactgttaaaatagtatatcacaaagccatcatttattttctcaaaactctaatttttggccgcttcccacaatattctgacccagacacctttacatcatgtggatataatacaacctcctgtgtcccacccttcacctattcattcaaccaatatggaatagctgtctaggatgagctccaggaactaaggtagaaatatcaaaagatacattgttccaggactaaaggagtctttggtttagtcaggagatagcttgagtaataaataaatcagctacagtagaacattgttatttttccaactaacttgcagtgggagcaggtgaaatttgctggaaggtcaggtcacacatcgtggaggaaaagccctttggagccttgacaaaggagatgactgctagatgccaggtgattatatgagaaggcagagagaacatttttgtaaatgcctagtggacagagagcctgataatgtgacaagaactgcatgttctgtcattttaaaatataggccacacatgatagaaatgagggtggacatattaacagaccagatcatgaggggcttgtatatcatgtgtggtggacctttgtatttgacctcataggcatatcttccttgccacatatgtagtttgttttggaacacttcattgatctgtatctttaaaaaaataatttcccctgacaatatgatatgatgaaatttcttcttatgcaataccttagaagagcagaggaagctaggtggtaattttctgtatcccagatggggcctaccttcaaatctcattctctggccctttcatttctgaagccagaagtcagctggttttggggctccgtcctccataaactttatatcctctttgaaagctgacgttctcaaacaggggctacagaatcagcatcaagggaatgatgaccatggttggccctgcatatgatgtctccctgcccttgaccccttaatcagtgactcttaatcctcatagtcaaatagccatggagaacattggccctgagcagtgcattctagagctgacttctcaacacaggtcttcacccctctgcttgcaatcctgacatatgtctcagtgtattttcattcaaactcaaactcttaccaaacccagcatgagtagcctgcctacctccccaacctgatttaatgccactttcttccttgaaccctaagctccttccacattgagctttttcaggttttcagagaaacaaaacttagtcctacctccaggcttgtgcacatgctattccttctacctagagaagttcttcacctccacctccatctaaattgctcttccctgaaaagacattttccagcctctaaacaagcccactcccctgtattttgtgacacgtaatataattttagattgcttgatttgttttgtttactttatttctctattgccagactttccctttaagctccataaaatcaatgacctgggaatgaatggatggatgaatggatggatggatggatggatggatggatggatggatggatggttggagttgaaatatctttgtgaagctgaattcttcacaaagtccaccctctcattctttattcatgctgtagctacactcagccagactcctgggaattgttttctcctccatgaacccaacaaagcttaatccatccctcatactccagcctaagctccattcatttaatgaaacttgtgatctgtcaggttgacactgatttgtccctctcctgacttatatataaagtatatatttactttgttaataacttcattaactttgttaataacttgcattgtttcctgtcgggtaactcaaatttcatctaagttatagtttttaaaaaggctttatttttctcataattaaagcaataaagaaatgcactcagaaaatgtgaggaatattgagtataatgagataaatataaatcctgcataatttctccactgtaagttaaatactatagatactttgccttttccccttctagcggttttattacacattttacaacattgtgtgtacttgtgcatacatttgtaagtatcctgaattttagacataaccatgatctgagcatgccctcgtgtaattgcaaatacttctaaaagcttctttccttgtacgcctaaccataagttctatttttgagaatcaccattgagtgtcaacagagtactagagagtgcactagccactgaggcatatgttatcccactttaaatatttagtgcctactgaatcagaaaatataatataaaggatgtctcccttacttgagtagatatgtttccaggtggctataatattaatacattgcagaagcaagaggtgaaaccctagaataatttgaattaagggcaaacaagaaagaccggatccccaacaaatacacctactttaaatgttgagtgcattgagcacacatatgtctttggtaaatgtgtttctactagacatctagaacaatgaattgggaaaaccttggcagatcactcttctctgaaatcatacctgtgataacaactcatgttttccttcttttctagagtgaccgtctccttatcaagggaggcagaatcgtcaatgatgatcagtccttttatgctgatatttacatggaagatggcttaataaagtatgtatatggaattcttctctttattgttttgcacttcctccttcattaatggctcataaaggaggttggattacatgaatgtagtgaaaaaaatcttaatttaatcaacagaatgaagtgagatactgagggcaaatttgggcagaaagtattgatgagcattctacgggtcatggaaaagtggaagatgtggccatcatccttaaggatactggaaaatgtgcacaaattacagcaccctaaaaatataaggctttgtgcaataggtatcaaaggagttgaagtcgggataagtgatttagaagtacaaagaagaagaaatttatttagaagtaatgctttggggtagagagagtatttaatctgaaccttgacttaaggataggacttagatgggcagagcacagataggacatagatttcatgcaagatttgcaaataaattcattagggatgtataattacattctaaaatgtatactattggatgcctgtaagtggcacagccaggtaagttttatgtgtaggtttcctacatagtgaactttaaaagaagatttgatttacatagtgtttcatcacaaaaaacaaagtacactaccctgcaaagatgttgtaaaagactgggtgtatccaacccattctattagccctgtctggcctcttttagttttatttttatatgacttaacttcattgactagttaaagattttggttacaagagatctcttgcttctctttgaaaaattggcttacatatagttttctgcaggcaaactttttttaccagcccccaagtctaggctagctttcccttctgtgtgctttcaaaacagcttgcggtcggccgggcatggcggctgtaattaagtgcctgtaatcccagcactttgggaggccgaggcggacagatcacttgagctcaggagtatgagatcagcctgggcaacatggtgaaaccctgtctttactaatacaaaaattacccgggtgtgctggtgtatgcctgcagtcccagctactcagggacctgaggcaagggaatcacttgaacccaggaggtagaggttgcagtgagccaagatggcgccactgcactccagcactccaccctgggtgacagagctaggctctgtctcaaaaacaaacaaacaaacaaacaaacaaaaccagcttgtgctttcatcaatcatagcaattctgacactgttagtctcctttgagagtaaggagacttacttactctcatatcttacatatcttgtttattccacatcccaattcttaacccaggacttagcacaaaaaattttgataagagctactttttattgagtgtgtagtatgtgccaggcacaatgttaaatgttttgcatgctttctctcaatcagccagcagccctctgaagtaagtactgtactattattattctgtttcctgagatgaggagaaagcagcacatagagtgtaaataacttgctaaaagttaatgtattagtcaaataacattgaatgaatgagtgagtgaatgaatgaatgaatgaacaaatccaagaaccaaaaatatttgttcatagttaccttgccaatttacattattactttcttatattggaagtaagaaaaatggaaacaatgggaaaaccaaaatatatgacaataatttcttcaaaatataagccacaattgattttatgtttttctattaactaaaaaattattatatatagttggctctattcagaggtagcaagctctctcatttggagagaatgggaaaaatttgttaccaaatgcttcctcatttcagagctcatcataggcagcactaattgttcacagaacttttttattattattattattatactttaagttctgggatacatgtgcagaacgtgcaggtttgttacataggtatacatgtgccatggtggtttgctgcacccatcagcctgtcatctacattaggtatttctcctaatgctatccctcccctttcccccacccccaacaggccctggtgtttgatgttcgcctccccgtgcccatatgttctcattgttcaagtcccacttataagtgtgaacatgcggtgtttggtttcctgttcctgtgttagtttactaagaatgatggtttccagcttcatccatgtccctgcaaaggacatgaactcattctttttttttatggctgcatagtatttcatgatgtatatgtgccacattttccttatccagtctgtcatcaatgggcatttgggttggttctaagtctttgctgttgtgaatagtggtgcaataaacatacgtgtgcatgtgtctttatagtagaatgatttatattcctctgggtatatacccagtaatgggattgctgggccaaatgctatttctggttctagatccctgaggaattgccacactgtcttccacaatggttgaactagtttacactcccaccaacagtgtaaaagcattcctatttctccaaatcctctccagcatctgttgtttcctgacttcttaatgatcgccattctaactggcgtgagatggtatctcattatggttttgatttgcatttctctagtgaccagtaatgatgagctttttttcatatgttttttggccacatgaatgtcttcttttaagaagtgtctgttcatatcctttgcccatttttttgatggggttgtttgtttttttcttgtaaagttgtttaagttccttgtagattctgggtattacccctttgtcagatggatagattgcaaaaattttctcccatgcctgttcactctgatgatagtttcttttgctgtgcagaagctctttagtttaattagatcctgtttgtctattttggcttttgttgccattgcttttggtgttttagtcatgaagtctttgcccatgcctatgccctgagtggtattgcctaggttttcttctagggtttttatggttttacgtcttacatttaagtctttaatccatcttgagttaattttgtacaaggtgtaaggaaggggtccagttcctgttttctgcatatggctagccagttttcccaacaccgtttattcaataggaaatccttttcccgttgcttacttttgtcgggtttgtcaaggatcaaatagttgtagatgtgtggtgttatttctgtggcctctgctctgttccattggtctatgtatctgttttgctaccagtaccatgctgttttggttactgtgaaattatagtgtagtttgaagtcaggtagtatgatgcctccagctttgttctttttacttaggattgtcttggatatacaagctgtttttcagttccatatgaaatttaaagtagttttttctaattctgtgaagaaaatcaatggtagcttgatgggaatagcattgaatctataaattacttggggcaatatggccattttcattatattgattcttcctatctgtgagcatggatttttttcccatttgtttgtgtcttatttccttgagcagtggattatagttctccttgaagaggtccttcacatcccttgtaagttgtattcctaggtattttattctctttgtagtaattgtgaatgggagtttgctcatgatttggctctctatttgtccattactggtgtataggaatgcttgtgatttttgcacattgatttttatcctgagactttgctgaagttgcttatcagcttaaggagtttttgggctgagatgatggggttttctaaatatacaattatgtcatctgcaaacagagactatttgacttcctctcttcctatttgaatacgctttatttctttctcttgtctgatttccctggccagaacttccaatacgatgttgaataggagtggcgctacggccataccaccctgaacatgcctgatcttgtctgatcacagaactttttacaattgagccttaaatacaggtttagaatccatcttcacatggtgcttcagggatctacaaccagggttgaaggtgtaagatgattccttttcgccatttctattagaaagactgaaaggccacttgccaaggatgttgtaggaggaatttaaccatcagatgtgtgtgttggtggtggagagaaggttgagttaaatgatcataattcaatcctgaaattttgtatgtctccaacaacattcttaactcacagagcataagaacagaaataacctcctctaactatcacatagttgtttgtctgtctgtgaatatttgtggaatacttgttatgtgccaggcaattttttgagatattggactcatgctatgtcacacggtatggtactcattatcaaggcccaaatcatcatgctgtcttcccccgggaccttttagtcttttaggggaactgagatatctgtatatatgcaaaggacctagcattaccaaggagtggcatatcaagtattatattcatagaacaggtgagattcagagaagggagtggactgattattaattatagtagctgacatttattgaattcttagttacctaacagtgttttatgggcttaacatatattcacatttaatctgcagcacaaccctatggaggaggcatctttattacattttacagaggaaagaattgaagcatggtaaggtaatttggccaaggttatacagctagtagctagcagagccaggattgtgaatccagatagcccacatccagtctcactcattattagacttggattttgctagaaacttgatgaaggagggaagatggaagctgagccttgagggattaatgcggccttcgttggtggagcagtgacgaagggggaagccatttctatttcaggcttggtattaaactagttgtcaaaatggatgaaaacacacacacaagccaggcaactcttcatgcccttggttctcaattttccttaaaggagaacctgtgagagagaaaaatgagaacagaattggccagtatctgaactagaatggacttaggatcagaggctgcattttaccagtatattttgaattatggtggctctggaatggcccagtggtgatgtggtaaagttgaactcttagagatgtcaggaatactttattttagtcgcagaacttggagtttgagaggccagtggtagacttcttactgccccaagagagtgtctttcttggctgtccgtggataaaaggggaaaatattcatgcaatggacagtgaggtacagatatcccaaggtaggagatttttaatggtcatatagaggcttatgaatcataggtctccctgttatccatagtggacatgtttaaccagctattttaatcaaaaatgtgataccacgtataagccaagcaatactggctgatctataagcagcattgtgtggggactagttgtatttgtcactttccttggaggcttgcctttgagatactcattggcttccttctgcctgagtctcccccctattcctccctaagatgctctgaagcttcctgggcgaagccgtgtctagtggcggttctcataatcactcagctcggctaaaagcttctactgggacactgaccatgtcataaaggcagctggtgctggaggcatctgcatctttgacttcctcctggtgaatctgccatcagctgtgattggctgataaatggtcaggaaagggtggaattgggagtgaagacttaggtgggaaataacccagacagaatcttttgttaggagcaaagatgaccccacttaaaagatagctgagttcccatacctgttctttaaatgatttactattatcttcttcagtctcttctaacagtgcactattttatactctttagattcttctccaaatgttatttctcaccttaacttaaagaacaaaatgaaaggaataataaaaatatttatatgaaaaaagtattacacacactatattctagacactatcagacccctggggttatagtactaaaccaggacacgtggtcccaccgaatggcatatcagatcattctgtgactataaacattgttttctgtgtatatctatctttgtttatagattgctaagcttgtgagtcacttgcaaagtttaatttgataaatacaagtaacactgtttaaaatccttataccactatatttgtcttggaaattgcacttttaaatgaccaagtgtttgatcatttttttgtttgtttgtttcaccagacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcagtaagtcttcatattttacacactcctgtttctcagaagtgtgtgtttaatgaatgtgttatctccagaactctcttactataacttgtatacttgtcccagttcagtttatagatgtgttgcctgatgggacctgagaaaagcagattgagctgaggaaatgggcagctccctgtaactaaagaggagattcatgaggctcttggtcatggcagcacctgccctcttgtctaccttagcagcaggcgctggctcctgcaatgagtggagaataggaaatagcatctctgggctagtaagaggtgaaagtagacttaaaaagttatggatagaagatgaaacattatttcaaaactgcccacttgggtctgagaaaggagggcagagcagcgtgaatggagctaaggagtatcacggagagagggattatggagaattacatttctcggaaattttgtaaacttcagtgggtaaagctgtgtctggtggaggttttcaaaatcgctgagcttggtttaaagcttctactgggacgctggtcatgtcataaaagcaactggcgctggaggcatctgcatctttgacttccacttgcatttagtgcttatggtctgcgctgtattttgaccaattcatatctttaacatttggcaagctgtaggagtggtttctcttgtttttaaattttgttttgttttgttttttctattgcaattccaaaaaaaatctagggagttgcatgccattggattactgaaccaatagcattccagggcagtccttcctgtcccaaaggaatcctgatgaattgggccccatcccagtgctggccccaaacttggtcaggcagagagcactgtttattttaacaccatatacatcccctgagaacacaggacagcctgagctgtagaattattcactgtcttttacttccttttgacaggagcataagcagggttcagcttcagctagttgggtgtggaagcccagaaaaattgcaccaaagccataaaaggtgcaattcagggtgcaattctccagctgaagggtggaagcctgctgacttctcagcagctgcctgctgatgaaagtcctggtgttgccccagacattagtaatgtagctccacgcatttgctttccgataagtgcactcaggctgcttttgatagaagactacgggaatgagtgatcttggcttggctttctgccatctgggcaaggagttggacctgtttggcatccttgagatttgtattatgcttggccatctgcattagggaagtcagattccccgtgacgagagtaaaacttacaaagaaccacaaaagcaattgtgtccttcatagataaattaggaaacctagagatgcaaaaagaaaataaacctcctaatcccacatcgctgttagagtttggctgtatattgtacacatttttaaaatcctatttggccaaactaggatcacagtatatgtattatattttaaccttccatttttgctaaataatatgtcatgggtatctttgcattcatttttgttctaccccaacatttaaagtggattcctagtcatccattttataaagcatttatgtatttaacctaacttctctattgttaacaatttcaattgtttccaatttttcacttagataaataagtagcaaacatccttggaaccaaaattttgtatacagcctcatttatttccctaggaataattcgtaggtgtgggaataaatgttgggttaaggtttgaaaaatgtccgggttttttatgtatatttcagagctgctctctggaaagttgtccttagctgtactttgtccttacttgtactttgcctcagctgttcaggggaactatgaaagtgtaacttttgccttttcttcatcaactgtagatgccattgtttaaaaaaaatgtatccatggttgtgggtgaaagagtagatttgggcctcaaagaaaccagattcttgacaagaagtttccatggaaataagatctgcgggcccagtatcaggtttatgtaactgacaccagctttgtcctatagcagagagcctcaatgtcttatgccctaacttagctttaaacctcgctttcgcccttggaagagagtctgacctttttcactagcagtgacctccccacagtactagtaataatgacacatagtaggcactcattgatggctaacatttattgagcacttaccatgagccaggcattagatgaagtactttacatgcattttcccatttaatcttataaattcagaagaaaggcactagtaacaccctgactcccaccccacttggcaccaacttaaaggaaagaaaactgagatttagggaagctagtaatttgccccaaatcacatagctttgtgacatttaagtgatcagcattcttgaaactatcagggaaccccttcaaaagttaattccatgctcaggaaatagagattctgcagtcacagctaagcaagcaggagcaggcctgggcagaggggagcaaaggctgtgtctgagagtgactcatctggggtctctgtcattcagttgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggtgagcccggacatgccgtcctccctcctctcttagcttcttcttgccagtccttccaacaccatccactcatttcagtcactgtcttttacttggagcctggaaccttgagtgtgagcactggatgtagggataacacaatgttccaggcactttatttacttcttacaggatccccatgagatagtgattgttttccccactttgcagatggagaaactgaggctcagaataagcagcccaagatcatagcattagtaagcagtaggtgtatccaaattctatgctcttcacctccatgcaatattgcccattctgaagaggaagaaactgaggttaggagaggctaactaatcttacataaggttgtatggctagtatgacctatgagattagggatttttaacctgtatcatttttgctgtagagatcaaacccttactatcatataacaatggcatccttagacaaggctaaggcatttctaggagcaaggatgtattggtactcaggctgggagcttagggtgtgaaaacatgttcatgtatatgtatatatgtttctgtgtgtttgccagcgtgtgtcctctcagtgagtacatgatttaggttccactgtcttcttagattcctccattctctgcttctttttgatcaacagatattgcaaacccctcccccccacatacaggcacacatatgcacaatgtgctcagcattgtaaggcggcctgggggtcttagagaagtgtaagtaatggcctttgctgaacacccaaggcaaaagaaaacaggctcatgaagaacaacagaataaatgtcatagtgtgcaagaaccattaccaaaggagtagtctagacacaaatgctaggagtccactggaagagtgtgccctgggatggcagggaaaggatgaccccctcagaggatgatattttctttccatcccctccttaccccacaagccctgcaaaatctttggtgacacagaatgtgagattaactccttctttctgtatttgcgtttatactgggcatctcaaccggcgtagaaaatcgaacggctttaacactcacttctttatcaaagagcctggatcattccatggataatgtagaggcttttgggaagggtagtgtttgggaagactgccctgagttgaaccactctgggtagggaagttctcaaattacaacccagttttggcccagaatactgtgggctgagaaggctctaatggttagagaccaaaattatccccctttcctcaaaatgattctcagttccccagtcccacctatttctgtaaatcactgtattagtagtttatttggggagagatctaaatagatctttacatataaaccttacaacttaagatatttaagcacaaggtaaaacctgcccattagttccctaagggtaggatctgtatcttagttctcctttctgatccaacaccctgcacagtaaaatgaactgatcccaggagatccattaattggaaaccaaatatgtgccaagcctggtgctaagagctctgtatgtattctctcctttaatattcacaaccactttatgaagtagggtattgttatttttccatttaacaggtgaggaaaccgaggtctggagaggttaagtatcccaagctcactgaactagtatgtggtggatttcagtggtgcagcccccagggtatgaacacaactggtgtgctagagtgattcttaatgccacctactactgccttgagcaataacaaagtttattgaccttctgggctaggggatgctggacaggggagtttagaaagaggcacagaagaagagaccattctgctatgacatctgttaggaattgttgattttatggggcaagggtgggcagagcaaaatgctcttgaagaatataaatatctgctttatgttggacaggagcccgggtaatgcagctgggtgctatggtcgatggaagtgggagcaaaggatggaggacagtcatgataatgttgtctttctcttgtttttcctcctgtccctcttttgcaggggttaactccttcatggtttatatggcttataaggatttgtatcaagtatctaacacagaggtaacaacccatttgctatgtggtttggggtatctggatgggtttcctattgttgttgatgaccttggcccttgtaacatgaatcactgtggtcactgtgggagaccactgggccagaatgcttcttgaagcctttgcagtccacgctacattttaaataaggtaacaggcagggtgcccatggcaagacagacagggagctagagtttccactggcagcagctttcttaaacggcaagaggaggaacatgcctaaatttccatctaccaaacaagctccaaacccctcataagcccagtgaaagtgtgaggctcttcgcctgcaggaccaggagggccttctgctgattggaataatcctactgccttgcctctgactctccccctaagaaattcatgacatgcgtttgctttagacagaggctatgttttcagaggaaatacaagaaatgaattcccatgcctcctgcttagaggtgaaggtatgtctgccttcacaggttaagagataagggtttcagtttttgtgtttgtttctggcctggctgtagtggttttctagagcatttgttgagaagaattctgagactgtctctcagctcaatgggaaaataattccattaaaaatgtgtgctagaggcagaggagaggagttggtggtactttattatatatttgctctgccagcctagggaacatggtaggttctttatatagtcagagtttcctgggatttctttggactagcactcctctttggtcatgcctatgtaatatatatttctgccctagtgacttatttcctctgctttatcccatctgttttagcttgggctctggtaattggcccttctgtggggctgctaaaagtgcttgcaagagtgacaaagactcatttctatttcagctctatgagatcttcacctgcctgggagagctgggggccattgctcaagttcatgctgagaatggggatatcattgcccaggtaacaccgtgcagctccctggagcgtgctttgggtctgcattccattttcttcttcatttcttcagtgctgcttgagctctcaatatgtgcaaggcaccatcataagtaccttgctaaagacagaacctgctccaaggtacctcacaatttaggtggaagaaacagaggggaatgtagacaagcaatgaaactagaagatgaggtaaaacagaaagagggctggccattgttggagaatcagaaaaggcatcctggaagaggaggatttcaaattggaacatttaatgggagagcatttgctgattctcttctgaaaatgtgtcaaagctacaagacattctctgtcataaagaaagaccgtaaggcagcatttctcagaagccagagattggatccaagtctgtggaactcatagccttagataatagagaatttaggtctcatgaggagcaaaggtctcactggattcctagaaatcatattgagaaacttgaggaaagagtgacgaaagtgagggccccaaggcccaaattgatcatttgtaaggaagaaggaagcagttatctctccatctcctgggctgcttaatggaatagatggacagatgtgtcttaggaagggttttgtttctcagaaacatctcaagattggcctttgctaggaggagacagcccgaaaaaaaaagagtgagctttcttcatccatttgataatgttggcaacaagaaaccgttattcattccttcaaagagtatttcctgagcactttgtgccaggcagtagctattgaagtgagccaaaacagatgcattccatagctcactaatacttgggctgtgcttttattttagaagttgaccagaacttggtgaatgtggtcagcaggggtgtaggaacaatgtctaggcctcccctcatctcggaccattagtttcctgatagcaggtgccgtttggtgagcactgactactgtgtgccaggaactagtaaattttctggtgtattctcatttaattttcacccaaccctttaaagatgctatcatcctccctattttatacatgagaccatccaggctcagaaagattacgtcactggcccaaggatcacagcaaataactaggaaaacgaaatctttgcccctaaggtgatatacctcagtgggtatctttactcagagatggcatatctgggatcccttgcctcccaagcccagctgcaggcttgtgggcaggcagtaccccagccatgcagggctccagctgttgtgatttcagactctccatgttgtcttgctggtgggggaggtgaggtaagtgtacagtttcctctcaccatgaccaaggaggctaattagtcaggaccctgacagcactttcgcccacttccaccacacacccaaagataatgaaatcattttctttagagagcccaaatgccttggtcccgtgggaggcaacccagtgatattagaactgtactcctccctttatccaagttttcagggcagcagccagaggtcccagccctgctttcagcttccctggaaaccaaactctctggcagttaattctagcccctgaggaggcagatggacttcaatccaaagtctgcgttctcagtttatttcctcttgtgaatccttagagtggaagtttctctggtttcccctcccgctgctatttccctaccttgggaagatctgttctcagtcaggaaaagagtaggggcatttttccatttggatgagtttattgtgtgtgtttattaaattcagcttgagcagaaagatttttatcacattgtttaaatgaaggcagctgctatactcagaatttcttgctgcacttattcaaaagtgagtatatgagagaggaatctttgcctttgggtacaaacaaggatgattttcaagaatttcaagttggcaaaacagtctaagacgacagcatctttagccattcgttcaacaaatatttgttgagcatctactatacgccaagccttggacggggaagatgtaaaagacagggttcctttcctcatggaccaagctacagttgtgtcatgacccaaactgtgatgtaactgtagctgtgatgaatgccacaacaggcccactgctatccccatgtaaggtagcatcagtggggctttactgctgttcttaatctctcagctatagggacatcatggcttcagaataggacttcctagcctgaacagtgcattagaatcaccaaatttttctaattccaggtattctggaattaggaaaagtcagtagcagagttcaggcaagtgtattttgaaaataatcccctggtgatttaaatgtgcttggaagccacctcttgagcttagctttgtcctgtgcattatcctggtgcactcaaacaagacagaagcacaagtgtcacctaagacagagattctttagttggagaccttaacccttgtgtgactggaggcaatttagagtagaaactcactagactttagaagaaatttaattcagttcaagtttcaataagtgagaatggtaagaatgaaaagtggaggtgcttttctggaaaaataagcctgtaacctttctttgttttctgtagagctggagatagtgaccatttcacttctcatggttgcttttagtatgtgcattttcctttctactcctcttttagagatttctattactaaaaacaaaaaacagaacgttcttttccaggtggtaagaatccttacctttctaaatgcctcacagtttcaaagtgagactaggcttgttgcattcaccatttttcctatgtgtctcacacattaccagagtactcccaggtcactaggccaggactgctggtgcagaggttcatagggaccagtcttaataatttcagagtgaatgccagtaacgctgaagaaatggtggcttgggatttctgccagttccaatcagttcatgtgtgtgtgctcactgcccagctacctgcttcttccataaagaggctagaagtctgaggaattttgccatcaaccacaagggacatgcacttcttctgccatgtccacaacttggttaaacagaatttcaccaagacactaacttaggtaatgctgtttggaggcactattttgtttcgttaaattttgaatccattcatttaagccatagatttaaaacatcaaaactcctgagtggcttattaaaatatgcatttctaggattcaacctgacatcttctgatatgttaggctaggatgggtgagaaatctgcatttctacaaaaacaattcaggcaattctgatgtaagtgatgagtggcccacacttcgggaaacatagcactaaattataagccccgtgaggtcaggggctaacattgctttaatgcaggtacttacccagagcctaggaggaagcagttgctcaatacattttgttgagtgaaatggcttaaagagcatgagtgaataaacaaatgagataagcaagtatagtttcagaggcagctgagactgagagagatgaacaataagtgacctggtatgattcttgaagggcagtatagacaaaaaatagtctaacagacaactatctttcttctaataaaaacaaatcacccttgaatgttttttctttttatccttttagttgagtctaccctatattgcaactccaaatataggattaatacatctgttcaacatacgcatatttattctttagatctttagatcagaacataccagcgtaatttttccaaatctcacttgagcttattgaagaactattttcttttttcatttcaggagcaaacccgcatgttggaaatggggataactggcccagaaggccatgtactgagcaggccagaagaggtaagttacaggggatgaaggtgcacacacaacgcatgaataaacattgttaaaaggcgacgagaatgtgagtaccaggttgcagtattggaacatttcttccaaagaccacttctgattgactctaactcaggagcccgtgagaaaattagaaaggaatgtaagagacatgcttatttctgacccctaatctccctacagataacacaagttggagtgtccttcacagctattcaggagtgttaaatttctaatccctttcttaaggaaatctcagtgtgaatctcatagacatttccacttattcccttatttcgagtcctgcaaaatattggcatatagataagatgttgaatgggttttttatatacattatactcatcaatttgtataaggtgatgattatgtccaggtatggaagtttctcatatataaaatgaatgcttatttatgtctgtacttagcagccaaacaacaaatcaaaggtgactagaggctggttccatgtctccgagatgtcagcagcttcacctactggcacggagcacagagctgggaattggctgcccatgtacctgaaagcacattggctttggaagggcagcctgggtctagcacctagagcaaagtcaaggccctccatatcagtgaagcgagtcctgtttctgtcctgtcattccaaaccctacaacagggagaagaaggaatcataaccagaaatgattcccatatcctgtctcttttagagtcttatttaaaatataaatagaacacatatagaaaaaaatgtttctatcctaaggaggcaatgaattttcacaaaccagatacacttagctagtgttacactagttatactagtataactagcacccatagaaggaaacagattatcagcacctcagaaactcctttgtatctagtgatatttttattgccatttaaataatttataattttgtgattagggttccagtcacatacagcatccctgaagtctgtctccttaataatactaggtcacttctatggaatgcattcatctggtatgtgctgattgcatacgttatctcagttctcgctgccgctgctctgtgtggttggcattgttgcgcaggtaaagaagctgaagctcagagaggttaagcccctggctgatcacacttgaaggactggaaaatggtttactcatcgtgaagagaccagggtaatcagcattgtttttgaagtttttcttaaatgctggtcactgtggagatgtgctggcaagacggatttccagcagcagccaggggatttcagagcaaagtctatttttgttccttggtttgttttttcaacctccccttagccttaccaccccaccctcctccttattcctgtctcctttttagtaaaaaagcctctcagccgcaaacctctatagccgtggaaggccatttgggtgaagttggagggtgatgtaaccttccaaagatagtcatgttgtcaaagtgctgaaaaacctgtagtgcttgggaggaatgagatcaaagggaccaggacagaggtcctgggggagctgaagtggtcagcatgggtgtgaagtgggaggagtgatcataggaggagccagcccctgttcaattcaagcatacccagacaccacctcaagtgatgctgttcagagagctgggaccccaggcatagagacagccgctccagagtacaaaattctgggtgcttcaggaaggtgtccatattcacatatgaccaggggcctccaaggtcccatccacatgcaataaagtgcagcttgggggaggccagctcagccagccaagttcttaggtctgtctgctgagctacacccacaatggacagtgactggtttgcattatacagccattgggcatctgcaagctatttttggtattttttttaagtgttgggctccacaggctaaccagaatgtcatatccataaaaaaatgaagtgttgccaattgaatggaagaatgtcaaagtctctgctctgtgctgaattggactaacttacacaagttgagagtagaccacttgagagtaacacagaccctcaactggttagaaaatattatcaacaataatatcagtagccaaccctcaaggggcacttaccttgtttccccattaggaatgagctaactgctttataaggatgaactcatttaatcctcaccacagcccaacatgtcagatcctattatcctcaatttacagacaaggaaactgaggctttgggaggttgtgcaatgtacccgaggtcacctagcttataagtgtcagaaccaggactcagaaccaggccatctgagagagcctcagctctcagaccctgctttgttaataaaataagggaaaacttctaatttcttaataaatgccactgggttggttagcatatttgaaaacatgaattctacattagggtaagatgggagagatcaataataaaacaagtctttgtgttgagaaacctgggaattattttcgtaagaaatgcctcctaaaattaaccctttgctgaccacttactgctgcaggaaaggatttgaggaaccatgatgcctaactgccttggctggttattttagacataatggtttgctattgtgtttgcccagagattctgtcctgagaagattgaggagcaaaggctttcattcagatgtcacctttgtgataaccacagaggctaaggaaaaagtacttaccctctgccagacattgctctcagatgacaatgctgtgctatactattttactagtgagggatagaggcactgggaagctgagtaaagtgacacagttaggaagtggtagatctgagatgtggatataggctatctaattccagatcctgccaaaattatccataacctttgtgcagcactgcatcctcacagttcgtggaggtgggagccaccagtttgagaggttcatgtttctattgactcctggagactttttcttgcagctggaagctgaggctgtgttccgtgccatcaccattgccagccaaaccaattgccctctctacgtcacaaaggtcatgagcaagagtgcagctgacctcatctcacaagccaggaaaaaaggtgatttgtgtttccaagatctcggagcccctgatggcactgtgtggctccttccctctctggttgtcctgtgtaatataaatggtgcctactttgctcattgccttgctccctaggaagccgctctccacatcctgtgtggatgggaggatcctgggatttctcccacttggcatttaagtaaactgaggctcaggaaggttagatgagttgtccaagatgacacagcttgaaccagttcttctgagactttgtgcatcttacttctccccttgatctttgattttcagttcaccttgtctgagttttataaacggacatatcagtcaggattaaattgggtgcaaaattcaaagatcctgctcaaactggcttaaacaaacacaagtgaataaccgattgtaggtgtttcaggtatggctagattgaggggcctcaacaatggtattaggtgtttgtcacgcttactcctttcttggctctctttcctctgtttggtttatgttcagtatgaacagttacagaatagatgctgagaggcccctgttgtcctcaatttttggcagagagcatgatgggaaagtaaaatacaccttttccagcaggtcaagcaaaagtccctaggagcactgtgactggtctggcttgggtcatgtgctcatccctggaccagtaaacaccccggggatgatataatctggccaggattgaggccacagtgcagatgcaggtcacacctcctgagccactgagactaacacaagttattttagagaaggggttgagtgggtctccaaagcatattggccaccatggccttcatgaccctggctgtgtccctgctccctgttgacttctgcttcttttctccactggtgttaacttgggcttcctttgcttgccttgtgcttagctaaagttttcagagctttcttttctgtttctggttctcatcctcagtgtcagactcgtgggctcagttgtgaggctgggtaagggacgagtgcaggtgagaagctgcagatgtgtggctctgtgttgggttgtgagaggatttaccaggcccagtgatgtggttgctactgctgcgtgccagtggccattctggtagtagagaggcccaacatgggtgattcatctaccaaactggcctgtgaaactccacgtgtgagtgattgcagtagctaaaaatagtctcagctgacgctgatggctgagtgttcagatgcctggccttctggcacagggtgaccctatttttcttacaagaggggaggctttcacattgtctagacactcttcctagctgacagattctggggcacctccttccttcctctgttcttcgtaggcctgctgttttctccttagcttttagaagtttcaactgacatggagtggttgctccactgggtatgagtcattgggcgagaaccaggaaagcagcccagtgctcctcactcattcttggagaaaagcaaagaaaagaaaaagaagaagtgtgtaggaactccttctgccctcacccagtgccgcacacacacacccctgccaactgtgaccacccaccgccctcatgccctctgctgaggctgcattctgcccgggacccattcttagggtgacctagggccgctcgggacagggtgttttagttatatgctggtcttattttaaacttcatggacaaaaattcctaaccctgagccttttggcacataattctctggcgagcagaactagtacagctgtgtctccggggtggaatgggggtattatttcagggatgaaaaactggctgctgagattgaagtcagtaaacaactcatggaccgtcattctcagggaaacacccaagagcattctttgcaagacaaagtgtagcagggtttgcacttccctcctgagcaggatatggttgaagtctcagtgtgtttagtcaccaatcatcagggctctttaactatatggctgctcagaattaatattagaaagctacaatttaatgaggaacagctatgtgccctgcactgacataaatactttaatttttttattgtgtagaattctcaaagaactctgagaaataggcatttctcagaaatgccttttttcagatgaaattgcagcacaacttgtccaggatctcccagctgggagagctggtattcaaatctaggtgtaattactatcttagcttcttttactcttccatgctaaacatagtccagagggagatttcttccacttttaagattctatttctttcaatagtagttgagtgcttgctgtgactttcatttcttcatatctttatggtcctgtatcctttagtgtgtaagtatttttggagagcccttgaattctcatcacttggatttttttttactctcacccccaaaagcagggctgtccaatgtgaatcattgccatcgcttccttcttttgcctatggcagacattactaattaatcatgagtcttttctactgagaccccgcgcattattagaatttttcccttcatggaattctaggcaactattaccagttgaatggagttgaaacaaggcaaaatctatttgtgatcctggccatagagtgcaaacttgtggagaatttaactgtggaagttggaggaccaaagttaaagaagtgcagggctgtatagggtagctttggccccagattttggcatagagaaacttggtaccaaccacctagctatgagctagcatttgctttctatatcactattccttcttcttaaagaagctaaacagcttagatcagtgtatattccaatagcctttatcccctctccatggtttgggtagttaggcctctaatttttgaggcagaatccaagaagctagtctcatatttgatgtgtcctaggttattgggtgacttttaccaagtcatcatgttaggagtaacaaacatgataaaaaaaaaagtcataggccgggcgcggtggctcacgcctgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaagaaaaaaaaaaaagtcatgagagtctctaatccacaggaatggattttactttgtggaaccaaagcatatcattataatgggagcatctagcaattcccagtggtgggtgcacatttgggactttgggcccctactgtgggaaggcataacaggtaaagaaagcgatatttaccaaacatcctctaggtgccagatgcttcacgtatgccatatcttttcattttcacaagcctaagaagtagacatcatcttgtttcatcaatttcagaatatatctatttcagccttggtatacatggaacccattactagagcaagaactggagcattttagtatttctgaaatgaggatgaatcttgaaatcaatatgtatattttattttcttttgcctcaaattttaatttgcctcaaaatttgagaattaacactgcatctaacaaccaatggcttcttttaatctagagaatacaaacttggtcacatttagcagataggaaagcaggggctttaaaaaggtgggaacatggacttgaacccaggtcagtctgactctgagacacagtcctgggtaggcttaggagctaaattaaataggcttggcccagtgcagcatatactttatgctaaccccttgtctgtttcctgccccttctaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccaggttggtgcaggaatgcccagcagcaggcgttttgtgaaaacatctcttgagtccagctgggggttgaggacaggagcagtcccatctataaacttgaccagagtctgcagtgtgaacagtgtattgggaattcttttacagtcttgagcgtagaaagcaggctcttccccatcctgttttaaacattaatacagtcataatattaataatggtaatagtagttaaaacctattatgtaccaagctctatggtaagactacactcacaatctcatttatttctcctaacaactttatgagtgaggcactcttatcagcatttacatattaagcaactgaaggtcagagaagctaaatcatttgcctaagttcaaatagttggtcatgatgacaatcaaaattatagggagactcctttgttgctgccctctgcagacatataggatcatgacattgctcatttgagtacattttattttgctacaaaagagatgagctaatcccaccccctcactttctagatggggtaactgagcccagggaggggaagaaactcatccaagctcatatatctagtaagagatagaggaggcattccaaacccaaatagtcagagtgcaaaccctcacagtaaacacaagactctaagctcccagtgtgcctccagccatctcccctgttcatgtggagcttttctcctttgccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggtaaggcatggaggtcatgggagggtggccagagccaaaacatccatgggccagatcagaacctcctgccaccagttgggctggtgacactgcgagtgcagatgggatctcgtacttgctgagatgtctctggaaccatgtggctctggcagtgtggaaaatttccttctagtgtgatgaatcctaaggcctagcattctgaaggaggcttccttatctagactgttaggactaggaaccagacatgcaactccttcatctgagtgtacgaatagcctgtacttaaaataatagtgagttaattctttttgtttggatagttttatgacttcttttgaaagaactggatataatcctttgaaatgataagcaatgagtctgtgtctagaccaaagtcatcttgcttatcaaggacgccctgtactgagggcatgtggtcattcaggcgatacaagtgattgtctctaaatgtcttctggcaagtggcctgttttattttccttgttcacatcacaaggactgacgaaagaaatagccattcaaattaagactctttcaaagattttagtaaaatcaataattatctcattattaagttgattactgctctatgtttcatttcaaaaatcctaaaaacattcttatcaaagttatgtatactaaagcctcattaatctacacagtgtaatttcactgagttttctttttcttctttgctcccaggaagctcagagctaggttttaaactcaattctttccgtaaagaggctttttggtttgaaaagagggaaaatataaatattgttgtctgttctctcacatagtgtttcctttttcatatactgcagagcagtacgtatgtatttatcctggcactatttggaatagttccaagataatatatatttttaaattaccaacatgacacatgctcagtaaagaatatttggaaactacagacaagcacacacttgaaagaaaacaaaaatatctcaattccacaacccagggaacccattgttatcatttgggtgaggttcttttgtatttattctatgcatacaacatatgcaaacacaaatacatatctaaaggatgggattataatcacatttgtttttactgtgaactctccataatcctttttgaaattagaagaagaaaatgagtaagtaaatgtaagaacatatagaaaaaaatgcatacttcggggcagtaacttctatcttaaaccatgtgtttgaccattttacctgagtagtcacaacagcccagctaattcgagcttgctgagtgaggttctgtagctcaccagcttttcaggtggctcctttttgtatttctatgcctttgtgggttgtctttctctgagttcagaagccctgaattgatatatatgtagctatagatatagatataatttcttatatttcaataggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgtaaggcccgctctggtgggagtggagtagaatggagaatgcatgcaaggaacttggtcaggagaaatgtgtttatgtggtgtgccagggtagttagactaggacgggttgcaataataatccatcccctaaatctcagtggctcaaaacctcaactgtgtttctcctgctttccaaagcagatgggctctgcccattccagtcactcagggacagaggccaatagaggcttcctctctacatatgttttcatgattgctgagacaggggaacatgacctggtgaatggtctactggctctgaaagcttcccctagacgtggtgtacgtcactgcctctcacatggcactagtcttagccagtcctgtggctatacctaacttccggaagtcagggcgtgcaatgatcctttgtgcctggaaagggaaagaataggaaataactggtaaacagcagtgatgacttcttcacgatgagtttcacatggaggatgataattaaagtgcagtacctaacagaaacgggctcgacactgttgttaaaaatagttaatatttttaagcacttatgtttcaggcactgtgctttgaattcactggatttccatagtagtcttctacaggtagggactattatcctccgttttatagattaaaaattggaggtacagaaaaattaaataatttgtgcagcaagcgaatggtgaagctagcattgaaacccagacaagctgactctaaactgatgttcttaattattggcagtacagtaatgcctcttgctggttgagtaaatgaaggaggtagggagaaatcccatttttggtggcaatggcctttgcttaaatattgtgtcatctcatgttatttaatttggagctagagggacctaaaggccacataacctctctgcccacctgctcaatacaagacagtgatgtacagcatcctggatagttatccagcttctctttgaacactacccaagacaaaagttgacttccacttgaggaccttattaaagaccggacacttctgtttgctaggaagtttagtcttgtcttagtaaatctgtctccggtgccttctacccactggatgcttgcagatgcatggtgagcttttcctggcttacctggtgaatcagcagcaaatgacactgaaggtctcaaggagagaaggtacgttcctctttctcctctttctatacccttactgtggctttgcttctcacccctgcctctaggcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaaggtaaaaagcattggagctctgaggtggtgcaggagctttgtgttccactcacgctcagagatagtaaccatgaacacagggcactgtgatctctagactctcacagagaaattcagtgacagtcttgtccccaagaacaactacacagacttaatgtactattaaagagggtgttgaaaatttttgttcaaagagagctttttttcccaaatgacttttcccacatttttatagtactttattaaaaataatttaaattcgaataattcaaaataaggccagtgtatttttttaaaaaataaatgactcttcaagtctgaaggtgagaaccgagaatccacaccgacacatccctgtgtcattctgtccagtgctgctccacaggggcaaacacttataacattttagctactgtattttcaataaaactttatttctctgattttatatataaacacacacagagatatgtgtgtatatatatatatataggtctatagatacatacatgtgtgcaaatgtatgcatgcgtataaaaaatggaggtgcagagaaattaaatatatatttacaatatatgtattatatttatatatacttaatatataaatatagaataatatataaatatataaataaacatttatatatttatattgtattgtgtattgtattataacaatacaataaatataattaaaaacaaaaatgcgtataaataaatatattcacatatttatatttattgtatttattgtattatactttctatacacacactatatatatatatatatatacacacatatacagatatacgtatatatatgtgtttgtatatatatgtgtattagccctaccctaggattgtggaatttgagctccacactccagtttgggcctaatagagaaggagacttccccaatattgaccctttatttctatgagtgtgatttagattctgaaaccagggaagtgttgatgatgtagagttcttggttttggggagtacagatacagtcatcacatcactagaatcattagcatctgcacatttgatgggctcggcttctgtgctggcatttgagtcactaacagggaaggaggctctgacaggacttcttgtgatgatccatcctgcacggtcaggctcctctggcagcgcgtcctcattgcctcccctctggccaaagttaagaaatgggtggaggttgtgtgccgctgccatgggtggtcttgcagtgtttgtccagttgactgtaagcccctttgcaggaggtaccgtgtttcccatggccaaaggccctagtgcctggcacaaggcctagcagagcatgtgctgggtggaagttgctggctggctccacagtcccagggcaagttcacagccacagacagaggtcagtgggtcagaccacagacactcacttcaaggcctgcccaccctggtgtgtgctgaagagtgtgagggtggagctcccatgtgatcccatcctggccaggacctgcgacctcgtgtcatgacctacccttcctatccctctgctccagctgtactgctgttcttctatttcataatcactcccacttcagctgtctgcccttgctcttctctttgctggcttctctgtcatccacaccactccccggtatccctccaacctcctccctctggcaaccccaaccccatagcaacgtcctttgatccttctgatcgaagctcatctatttagaagggccttcactgaccacatccattgtcactctatcatcacatcctcctttatttattttatactacttctcccttcctcaaattatctttattattgttaattcctagctcccaccacacactgtattcactaatatatttatgatacctagaacagaccctaaaatgctgaatgaatgaatggtgacatgctcttctctggctgcagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggtgagtgggacaggctcatcaaaagataagagaagggggaaggggaagatcaatgttctgaggccacagggtgttcctcagaactcaacctgaaggagttttccagcctagcactggtgtcaactttagggagaaggttactggggcaagcaggaagggtccctgaattgacaaggggtcctggtaagaaagtaagacaaggcagtcaggccgaagaccaggtttaagtggtaactgattctgcctagagatcagccctggttgggggcagggtcggggagctggtcccctctatgaattgatagtgatttccagcattagcctatgagcgctatgcaacatagtatgttttctttatttgtccagattaaaagatagcttaaattatttttatgctcaaattgcagtagcgtcttctaacctaggatttttattatattctcccattcctagtaattataataatgctaacactagctaccactgattgaacatctactatgtgttagccatgtgattagtcttacctattctttacgaactctctgatataattagaaaataatcattcagttgctccataaccagtagtcttaaaatggagaaaaataaatgtagattcgcattcctataatgaataatttaaatgtgaaggaagtaagataacaagaaaagaaagacatttaaaggtaaaattacagcatatgaggaaagggtatggaatgggagaaacagaaacatgggagaaagaggtaagggagacctaggggaagaaagacaaaggaaaagagtttaaagtttggaggtaactttgccagaggtcacattctgctagtcataagcaatttttttcaaagtttttgcctttttttttttgttgttgttgttctctggctaccttaattcttaagcttttagaggctcctttctgaatagacccaagcacacattgaaatttctttttgtgctgttgtcacaaagacctgaccatcactgctttgcactgtgggatcttgggcaagtgacctaacctttcagaacctcagttatctcctctgtaaaacagataagggcacctctctcaaaccatggtggtgaggattaaaggagataatggttaagcacggaaaacattgcctgccacaatgagtgtcacgtctttgtcattgttcttcttcccagtattattatcatgctctgggtcagatgaaatctagataagaacttggcttttcctaccagaggctagttttcggggccataagaaaagtctagaagacctgatagactggaatggaagtttcttgggaggtgaggccagcaaggcacttcatatcttgcactcttaaaattaacccagtttctctcttgcccacatccccctacccgccactctgttttttttttccccctgggaatttatttccaactgtaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaacattgttctccagtcttcttctttgtgtgatgtgcattttcacctataatattaaaattgcccagtagaactgaaagggttagtaagaggggcaggcagatctgctgataacagagttgtctggagaaaaattgggggcttctatttttgaaattgagttgttagttttgaccaccaagcttgatggccattttgaaactttggagaatgagtaagtttttttcttctgtggatcatcaaatttagtattatatgccatttgggataaatctagctaagtccagaacagagccataaagctttttgttttgggttttttttttttttttggtctttcccctaaagccttgctatttgattgttttggaagcattttctgcttctttttaatagcctagacttgaagaaaaactcaaattacacccataccaaagtatattctttatcaaatggatcccaaggagtaaaatcagtgtacggaagcattatttgctatatctgctcttcttagagctttcaggtacatatcggcaacttgaagactctgagaaatcccgtgataaaggtctttcaaagtttgcctaattcagggttctcaagcttttgactactgaacccttctatcccatcccatcttttagcatcccaccaaacctattatactacacccttttgagggaaacactgctgaatccagttgtaatttgttgtgcagatcatattttcattgcaaaagttaaactagtttaccagggggaaattggaaagtggaattttaaagtctggtgcaactataaagttcagtcaggcagactcaagtgtagttggatctaagtgctagaccctgacatcagagcgttgcttctttccacttcggccctgtgtgccttcagtaagtgcttccttcttaggaaagctctttttttattattttatttgagatgagtgtccctctgttgcccaggctggagtgcagtggcaccatctcagctcactacaacctccacttcctgggttgaagcgattctcctgtctcagtctcctgagtagctgggactacaggcacgcgccaccacaacccggctaattttttgtattttcagtagagacagggtttcaccatgttggccaggctggtcttgaactcctgacctcaagtaatccacccgcctcggcctctcaaagtgctgggattacacctggccaggaaagctctttttatgtgggacaaagttggttgtcagcatctccaggttttcatttcacctgcttagtaacctcagaagagggagagagtccctcaatagttcccgctaaaaagactgattcagtctggcttggggcatgtactcatcattgacctagtcactgtggccagaagagcacgtgggaccaattggccacaccggataacatacctggcccctgagccacctgaaccacatggactcccaataactccacaaagaaaatcaatttgtgataactgaagagggatggatgcaaggaaggcaaaaagagccgtggctgtggcaccattcgcaagcttgcagggcatgaatgttttgcctggtgatgtggaagttgggacgggtggggaggagatgggataccaggggatggccatttctgattaattgcttttatatgtgatgaccccctgttggtctgatagaacaatgcccttgatacaggagcatagagtgattataccttttaacacagaagctcagaatcccagtcacaagctactctaagtgcataaagaattaattattttacagttgaagttcgagttttgatgtttaataagctttggtttatagccccattttatggctctaactcaggattggtgaagtgcctctccctgctcatgaccgaggcagcagctgagctctgtttaggatttgagtgggtttaaaggcaatagtcagcacttaaactcaggatgcagcagtctgaaaggcatgaagtggttttcttcttaaatggtga

SEQ ID NO: 16064 - DNA, 70131 bp, Human
gccccacccacccagcagcgacaacccactcgggtccccttccgcgctgtggaagctttcttcttttgctcttcacaataaatgttgctaccactcattctttgggtccatgccatctttaagagctgtaacactcactgcaaaggtccgcggctccatttttgaagtcagcgaggccacaaacctaccggcaggaaccaactccggacacacttacctcctttggtctttgtatctcatgtcctcaatgagacctaccctgatgttacgggctgaatggtgctcctggcaaaattgacatgtcgaagtcctaaccccccagtatctcagaatgtgagtgcatttggaaatagggtctttaaaaagggaattaagttatgatgaggtcattctggtgggccccaatccaatctgactcctgtttttaaaagaagaagagattaggacacatatacacacagaggaaagaccatgtggagacacacagggaagattcattcatataaccaactgcttactttacatcctcacttgggcgtgaacagacatctcagactccatgagtctaaaattgaggtctgatgagatacaaagacaaaagctgagctctctgcaagccaatgagaggccttagaagaaaccaactctgacaacacctcgatctgggatttctaccctccagagcggtaaaatgagaaatgtctgttgttcaggccacccagtctgtggtactttgctatggcagccctagcagaggaatatgcctggtcacactgttgatgctgcatcttgccccttccctctggcccggatcctctcctgcttctaccttttttccatattgcactcagcatctctcacatacttatttgcttagatattatgtttgttgtttagagttctgatctctcttctgctccccttccaccccatgtgagctccataagggcagaatccttctttcgtttaactgaggtatcccaagcacctccaacagtgcagggcatacagcaggtgctcagtaaacagctgatggatgaatgagtgctaagactctcttgtactcgtagggatcgctggatgcattccttcagagggagagctttgaaggacagggtaaaaaatttcactgcgttgactccaggtttaataatataatattagaaggaagaaactactttcttagttttcttcttactctattcttcccatttaatggccctccaccccttactcccaattctccagtgttctctatgcaatggccaatagcagcatttatccatttagggtgaaaacctggagaacgctcctggatttctctcttcccctgcacaaaacccaaatctttctacagttctctccgtttccgatcccatgattctggccaggggccctcactaccagccttctcaagggccgctgaagcagcctcctgcgtgggctccctgcagctgcggagatatttcagctactctgaagggccacacgtgctctcacttccctgacacccctcccctttctccccgcccctccacggttaggcttgttgaccataacaagcagctcgcttgtattaggcgctcacgttctgcctcccctactgggcagtgcataacttgatgaggcttgagggcaggggtcgtgtccctagtgcccggctcaaagtggaagctccaaacttatttgtcggtcgtctcccttgttgctctgactttccactttgtataccctggggaactgagcacaggagggaggcgacgcggctggtgtcactttggggtaaagccccctctgctccccgccgtgtccccggccagctctggccccctgcatccgggctctctcaccttggcggagacctccctccagcggcagaaagcctcgtaggcagcgcgcacggcggcgcgggcctctcgcaccccgcagtcggctaccatgcccagagcggcgccgctggccgggtcttgcacggggaaggtggcggcggccgggagccagcggccgcccacgaagctgtcggtgcgcagcagcgccgcagagaggcccgccaggcgcccagcgtagcagcggagctgggccgggccgggcgcaggcccggaggcagggaccaggccgccggcgcgggggcggaggcggcagcctggaaacgtcgacccgaggcgccgggccccacagctccgcagccaaatgcaggtcgccatggcccgggcaacgacggcgacaggaaacaggcaagcgggcgcgcgcgcacgggaacgcaggggtcgcggggaagcaagaggagcgaggaggcgccggggacgcgcggggaaagcgtgggagctggcggaaggttgcagagccacagagcagcgccctctctccgcgtctttctcgctgcaccgccgcgccgccctctgcaccttgccctaagcgccgcgcggcttctctcctggcgcgaccttctcccgggggagggttgggttcggggatggagaaggctcgccagtagatgcacctgcggactgctgtcaccttttcacttttcgggtgctcatttgtcactaactgctcctgagcccccaatcgctgctagagacccactctctccccttagcatcccccaaattcggcatccccggaatttgtgcgcggtccatagatgcgctggtgcctgccctaaatgccaaggccgtgatcacgcttcttcagttgtagctcctgagcacgtagtattgattgggagcgatcgttctctgaggggtcgaagtgtgaccccgcgttctgctgcctggctgcttttttgggtgtgtgtctaggcattctcctagggttgctcccgataaataacagcgctttggaaataaacagactaggatccaaactcaagtctgttgccgacaagctgtgtgaccgacaggttaaccttcgtccagtcacttataaaatagaaccatatctaccccattttgttgtgagataacgtaaaatgctcattacagttgccacattaaattcaatatagcgttcaaagtcatactagctaccctagtcaagccactagtaagattaaagttgggtcaccaactagtaaatggaagcatttgtcaaaattgaatcaaccaaggtataaggattgagcatactatccaaccaaggtatttgagcacctttaaacagcattcttcatccgttaaaaaattagacttgggcttaagactctgaaagcagcagggaagcttaaaacctaatgaggataaaaataaaaatagcaggcgtatgctgggaatttgtgggtgcaaatgaagcccagccctatgcattgattttaggttacatatctccctttctcaactcctacagcgttgagagtatcttgctagctttcacctttttctaggacgttgaatttttttctaggacatttgcaaaatgccgaggcagtaactttaaattttgactttgtcttttgctgagtcagatccattgagttttgagccagtcacatatggcagaagtgataacagtagagtttaatcaatttcacactattttgctctgtattttattgcaggaactggggagaaccagggagtcctaatagggatgtgggccagtaggtatcacaggtggggctggggagctggcgtgtttacatctcctgcctgcggagggagtttttgtttttgttttgttttgtttttggtggtggtttttgttttttgtttgttttgttcttgtgagaccgacagactcattctgtcacccagggtggagtgcagtggtgcgatttcagctccctgcaacttccgcctcccgggttcaagcgattctcctgcctcagcctcccgagtagatggggctacaggtgtgtgccaccaagcccagctaatttttgtatttttagtagagacaggttttcaccgtgttggccaggctggtcttgaatgcctgacctcaagttatccgccctccttggcctcccaaagtgctgggattacagggctcatttctactggcctggggaaatcattcaattgaggcctcaatcaactgaggcccagaaaagccaagttaattgtggctgcctctcttgttcaaaaattaccctagcccacttacctttttaaggttctatttcaaacggtacccactccctttcccagatgacttatccattacgcacagtaggtacgatgccaagggcccataaaacttttaggagcactcacaaatgtttaatttattctaaaatctgaagaaaagaagttttaggtggcatattaatatgttaatcttacaccaatgcagatgtaaaatgtgatttctatttattgtttacttatttttgtgacaggaagtacttcacaaaggcaaaagcgcctggagcttagaaagttcacaatgtggccctccccttttccctcagttttgtgcccctcttcaagcccccattcagagtgtaaacaatttcctcctggctcctgtcttacttccagcctgtcctgatgccccctagcgcctggctgggtgtctgtccttaccagggcctacaaggacaagaccatcaggtgagagggacctcttccctcctttctcctttggctgcccttgtcctgggaacctccactccccagttcccacccttattcatcctctcccccattttctttttcttttttttctttcactttttttttttttttttttgagtcagggtcttactctgtcgcccaggctggagtgcaatggcacgatctcagctcattgcaacgtctgcctcctgggttcaagtgattctcctgcctcagcctccagagtagctgggagtacaggtgcgcgccaccatgcctggctaatttttgtattgtttagtagagatggggtttcaccatgttggccaggctggtcttgaactcctgacctcaggtgatctgcccacctcggcctcccaaagtgctgggattacaggcatgagacactgtgcccagcctcttctcccccattttctagactggcccacataaagcttgagaccctctggctttcaaacctgtattctccctactcactccttaatgtaactgtatgtttacttttcaccttgggtctctatttccagaagagttctaaatggtagaatcatgctgtcttgtttataacaaagccacctatattaggaaaggggggtgtggggcagaaagaaaaatatttccatatgcttattatttgtcagatagtaatattgtgagctacgttttaactttctttaaagtcatatctttgatgtttttattgttaccaaagtaatacaaacttcataaaactgcaagcaatattgtcatataaagaccatattcataactatcacactaagcaaataatttcctcttattttattacatttatacgtttatgtcattctgaatctcaaatacaaaaaaatgcataatgagaaattgagacatttgggattagtattgtttggtaactgaacccattccttttttttttttgaggtggggtcttgcccaggctggagtgcagtggtgtgatctcagctcactgcaaccttcacttcccaggtacaggcgatgttcccgcctcagcctcctgagtagcttggaccataagtgcatgccaccatgcccggctaatttttgtttttgtttttttcttggtagagacgggattttgccatgttgcacaggctggttttgaactcctggcctcaagccatctgcccgccttggcctcctaaagtgctgggattataggcgtgagccaccacacctgttctgaacccatttctttggtgctttttggatgggtttgttgtattatatatggttagatatcttttctagcagtatttttttcccctgtaaccattgattgactgctcttggatgttctgagagacaatatccaaagtcccaattaataattgtgactccctcacgcacagtctgtagaaggcccagagtgacagggaggcaaactcaaaggcctctggtggccagaaggggtgtggaaacctgcacacattgcatggatggtggggactggaggagcaggacatgctctatcagggggcagctggctctttggctgcagctggttgtcgtgtcacatgggagcgtcagttcatgatgccagttcttttgtttttaagagagccagaaatctagatttctacgtgaattttctcatttagaaaaagttcataaacttgatttaagtttataaaacatcctgttagccaaacaaaacacgtaggcatatggcctctggactaatcaggagtagctgggcctactgcccctcaggtctgggggtagctgcgggatttctttccttggggctgtgcacatggctgtgttaagcttacaggggaaactgttggggcgacaactgttgtcaaatcattccactttctttttttcttttctttttttttttttgagacagggtcttgctctgtcacccaggctagagtgcagtggtgcaatctcggctcaccgcaatctccacctcctgggttcaagagatcctcccacctcagcctccccagtagctgggactacagtcacgtgccaccacacctggctaatttttgtatttttagtagagacggggtcttcactatgttgatcacgctggtctcaaactcctgacctcaggtgatccaccagcctcagcctcccagagtgctgggattacaggtgtgggccgccacgcccagccaaatcatcccactttctattcatcctttcatttggcaaacctgaagtgaatactatttcctcccactcttttaggagcccatctcttgcttttaatgtaaaatatgcataatttgtgttttaagattaccatcagtttcatgaagagcttaatttttcccatggatgaagtgtaagtgggtacctgataatatatcgtgagcttaacattttccaaaccctgtttcttggccctaaatctgcccccttccttccacctcccaagtggaattgacatctttgcttcagctgcaggaatctgaccttgcaacaggctctggataagccctattagaacagccagaggtagagagaccaggagtggctgctcttgtgtaatcccatacaagtgtcagtatctgttgccaaatactgaaaaggaagccagttccagctgattaccataaaactttcccagcacttgtggcttgggaggcggaggaagcaggacagcctgataaatgtgtagaaaggatgcatgagagatccacccttgtaaggtgaggtggtctaatatgttgactatctgcacaggtgagcctttttatagaaagcaaaaaatatctggagacaactttgcttgcatctctacacaaatttcatgttaaaatgaaatccagaaaaaacctcggtcagaagatgcagtgcttctggcctaaggcttttcagatttcagtttatcctcccaaccccaccccccaggagcacagagtttgtttgctgttctggtgaagctaaacagtagttggacagttgacttcattggaaaacgatattattttgaaatgaggcttggtttcctcggtcagtgacctgcttagagagaagcggtgggtctgcacctggattttggagtcccagtgctgctgcagctctgagcattcccacgtcaccagagaagccggtgggcaatgagagcatgtctgctttcaggttgtggcctggcctgctgatcatgttgggttctctctgccatagaggttcaccgtgtggcctttcaacacacatagaaataggtaagtactggtgtcttgttatgttgttgagaggacaatacatctgtcaaagacattaaggaagagactgaaaatcccgctcgtggattgatacagtttcccctgggcactgagctgagtggcctgacagcagggaggagaagccggtgattgcagtcatccagggatagggattggcagcatgacttcagttaaggggcaaataagaaagagagctgatgccccattggtcatgggacccctgtgtgtttctctgggtggggaaatagtgagaggctcagtgaacgagaggttgcaacgtggcagcagaactgacagaatgggagaggaacaagatgggtggaatatggcaggagtgagaaatgtacttttgttgtttttacatgtccaaggacaggcatttccaagtatatgtaaagagccatatgtggccatgggagtgggtccctgagtcaaattgctgtaaaagtgcttggcttcaggaaggtcaagaaagtaagggagtttagttatccacatgcacggtgccaggaagatggcaggagttggagagcagaagggtacagcaagccagtgccaccgaccttaggggcaagggcagagtcatcctggatatagggagatggcaccacaaagagttatttaaaatttttatttttctagctttattgatgtataattgacaaaaattgtataaatttaagatatacaacatgatgtgttgatatatgtatgccttgtgaaatgattagcacaatcaagctaattaacacatccgccccccccacatagctaccatgttttttgcatatgggctgagaacacttaagatctttcttagcaaaaggatttggttcttgtatgaagtgtatttgtaacatgttttaacgcatggaaaacgtgagtcaatttgtaatagaattagctgtgataacattctacagcaattttcagattaatttcagatatacctgatgttctgagttttcttttttttttttttgagacggagtctcgctctgtccgccatgctggagtgcagtggcgcaatctcggctcactgcaagctccgcctcctgggttcacaccattctcctgcctcaacctcccgagtagctgggactacaggtgcccgccaccacgcctggctaatttttttgtatttttttttagtagagatggggtttcaccatgttagccaggatgatctcgatctcctgaccttgcgatccgcctgcctcggcctcccaaagtgctgggattacaggcgtgagccatcgcgcctggcctgagttttctttaatttagataaaaattataacagaattttatagttgtaccacctccagaagtttcaaagaataataagattataggcaaaaaatgaaaatttatcagtgcaaaatagacatatatactgagctacgatgggcaagaacctgttatcacagaatttgactatctgaaaggacactagaagtcaccgagtccagttctcttcttttacagatgaagaaactgatactagacagttttacagctaagttttcagtggcctggcctagaattacatgtcctgacagctggtccggcgttctttccattaaaaatgtactgctagaagggagtcaggaaacaatggaaaagaggatcagacttaggttctagttccagccatccagtaaagtagatgtgtgattctgagcaattcactttttacctacctctcaattctataaaatgagggggttgaacttcttaaagaattctaaagtgtcttgcagttctatgttctgtgaagttgaaattgccaaaactacagagtaagctgatgaggaacaaatataaatggaaatactccatttttaatccttagtgtttaaaaatttacaagacagattgcatctgaaattttaataaaaccagataattgcttgcccttcttcattaagtaccaaacaaaggtcctaatggacatttaaagaataatatttatgtgaacataattgaaggcatctcctgaaatagaatctgcacggattctgagaatttttttacatagaagaagaccaaaactccatcatttatttactaataaattagatgattttataaatattttggttcactttttcatttcttataaaggggcctgagtggaaggtcagcattatctgagtgagttaattagaaatggcttcattcagcgtaaatcactggaatcctgtacacaggttatttgtatttgtgggttgtgacttttatgatattaatgcttatagtagtggcaatagttttttgttatatgaattttaaaaattggaggtgattcacaacagaaataaggtatcacctttgaatgtcacttcccagggaatgttagtcctcttattgattcttgggagattcaggctgtgggtgggtgtggggtgtagttggtagctttctgagatgattttgtccttctggtccaatgatgaaaaacttttgaggatcattggttcagtccataggttaggtgttatattgtattttgtacttaggtttgtctgcctcagtactgaagcaaaatatgatgacagtttctttttttttttgagacagagcctcgctctgttgcccaggctggagtgcagtggcgtggtctcggctcactacaacctctgcctcctgggttcaagtgattcccctgcctcagcctcccaagtagctgggattacaggcatgcgccaccatgcctggctaattttttgtatttttagtagagacggggtttctccatgttgatcaggctggtcttgaattcctgacctcaggtgatccgccctcctcggcctcccaaagttcttggattacaggtgtgagccaccatgtgtggtctggcagtttctttttcttgagctcctaccaagtgtcagccactgtgcttgtcacttagcatttattatttcaaccaacctatacggtgggtattttttaaactcttttccataggagggaactgaggtctagagaggttgaatagcactaaagctcatagagttatttaatagttaagcagaaactttaaatcaccatctaaacttgctttgtactataacaatagaaatactgcacaagcctatacctaatgaaaattgccagtgagtgcaaactcatttcatttcctgcgtccttgacagttataaccacaaattgtgtatttttcttttaaaatcatctcgcctaagttatgttttcagtaatagttgaacttaattgatttatgtatttatttctctcaggacacagagctctggagtttcttcagcttcacaatgggcgtgttaactacagagaggtagaaatcttgatttttcttttcttctttgtgcattagttttcttttataggtgccaaacaaagatcctaacagatatttaaacagtaattttaagactcattttggctgggcgtggtggctcatgcctgtaatcccagcactttgggaggctgaggcaggtggatcacttgaggtcaggagttcgagaccagcctgactaatatggagaaaccccatctccactaaaaatccaaaattagccgggtgtggtggtgcatgcccgtaatcccagttattcgggaggctgaggcaggagaatggcttgaacccaggaggtggaggttgtggtgagctgagattgcaccactgcacttcagcctgggcaacaagagtgaaactccgtctcaaaaaaaaaaaaaagactcattatttatttctttatgttataatgttgtatattatgttattaatgttataagacattaatattatggttaaaaggtatatgtctcttccaagtgctacttgaacattttataggtatcttatatatatcacacttaaaatttaaagattttaatgatatgactcataatttgaaaaaatacttgagaaattttttaaacagtacatttttaaaaatgtgctaatcttctctgtatcattccaatattagtatatgtgctgctgagaagaacacatctttttgtttttattgtagagatgggggtctcgctatgttgcccaagctggtcttgaactcctgggctcaagcaatccttccaccttggcctcccaaagcactgggattataggcatgagccactatgcctggcccatcttttttgtttttattttaaaaagtcatacttgagagagatcatttattttccacttcttgttactgtgtgttgagcacaaattgcatcaccaggaggagaaggaagtatttattaagaaatacgcactgagattctccagagattcttcatccaactcctgctatattccatatcctggtaggactagctcatgactcacctttacccatcttcaaatgaacacattctgatcatatgcactatttgttctatggctaaataatactttgtgacgaaggtgtaattctttcatacttatatttgataagtggttagcattcccttctgacatcagaattggatcatttaataacattaagtcttcataatccatttgggaagcgggatggtaagataactgaaatttattgtaccctcaaaatacttttagtcgtaagattcagcttcctcacttgccaacctaacaggccgaatgaggaaaaacagcatttatatctgatagtcatcttcattgaccttgacggcaagtaggcaggaaagaggagtggaaacgagaatctgcctaattcatcacatgaacaatcaatccagagtgtgtgcagagtgatttctagtagaggtattctacaaggtattctagtagaggtattattaatttaaaacatgttaaatggacacagacgctccctttcaggatgcattctaatccaaatactaatgtcatcctcagaaataggccaggcgtgatggctcatgcctgtgatcccagcactttgggaggccaaggtgggtggatcacgtgaggtcaggagtttgagaacagcctggccaacatgatgaaaccttgtcgccactaaaaatacaaaaattagctggccgtggtggcagacacctatagtctagtcctagctacttgggaggctgaggcggggaatcgtttgaacccgggaggtagaggctgaagtgagctgagatcacaccactgcactccagcctaggtgacagagcaaggcctcatctcaaaaaacaaatggtgggccaggcacggtggctcacgtcagtaatcccagcactttgggaggccaaggcgggcagatcatgaggtcaggagatcaagaccatcctggctaacacggtgaaaccccgtctctactaaaaatacaaaaaattagccgggcatcgtggtgggcgcctgtaatcccagctacttgggaggctgaggcgggagaatggcgtgaacccgggaggcggagcttgcagggagcggagatcgcactgctgcgctccattccagcctgggagacagagtgagactccatctcaaaacaaaacaaaacaaaacaaaacaaagtggtggggcatgcctctaatcctagctacttggaaggctgaggcaggagaatcgcttgaaccccggaagcagaggctgcagtgagccaagatcacaccactgtactccagcctgggtgacagaacgagactctccataagttcacatgaaaataccaccaattctaatccgacaccgcaagatttactctagccttcaccatgtccatatctttaactcctttctctaatgctgagatggagtctcactctgtcacccaggctggagtgcagtggtgtgatctcacctccacctcccaggttcaagcgattctcctgcctcagcctcctggtagctgggaatacaggcgtgcaccaccatgcccggctaatttttatattttcagtagagtcgcagtttcaccatgtttcccaggctggtctcaaactcctgacctcaagtgatccacccgccgcagcctcccaacgtgctgggataataggggtgagccactgcacctggcctttctgtactctttattctatttcactggtctgtttcttttggtttcagtatcatagtacttttgtttctgtagcttaaaatatatatattttaagactggaatgcagtggcatgatctcagctcactgcaacctccacctcccaggctcaaattattcttgtgactcagcctcctgagtagctgggattacaggcaggcaccaccatgccccactaatttttgtattttcagtagagtggaagtttcaccatgtttcctaggctgatcttaaactcctgacctcgagtgatccgcccgcgtcagcctcccaaagtgctgggataacaggcataagctgctgcgtgcagcctttctgtattctttattctgtttcattgatctgttccttttggtttcagtatcatactatttttgttttgtttctatagcttaaaaatatgtattttttttgagatagggtctcactgtgtcacccaggctggagtgtactggtgtgatcatggctcactgcatcctcaacctcctatactcaattgatcctcccacctcagcctcccaagtagctgcaccaccatgtttggctaatttttaaattttttgtagaaacagagtcttgccatgtcacccaggctggtcttgaactcctgggctgaagagatccgctgacctcatcctcccaaagtgctggaattacaggtgtgcaccaccttgcccagccaaaaatatgtttttggcagatcacctgaggtcgggagttcaagaccagcctggccaacatggcaaaaccttgtctctactaaagaatacaaaaattatctgggcgcagtggctcatgtctgtaaatccagtactctggaaggccaaggcaggtggatcacctgaggtcaggagtttaagaccagcctggccaacctggtgaaaccctgtctctactaaaaatacaaaaattagctgggcgtggtgaccggtgcctgtaatcccagctactcaggaggctgaggcaggagaatcacttgaacctgggaggtagaggttgcagtgagccgagatcatgccattgcactctagcctgggtgacagagcgagattctgtctcaaaaaagaaaaaaagaaaaaaaatacaaaaattagccaggtgtggaggccagtgcctgtaatcccagctactcagaaggccgaggcaggaagaattgcttgaacccggaaggcagaggttacagtgagctgagatcacgccactgcactccagcccggtgacagtgtgagactccatctcaaaaaaaaaaaaaaaaaaaaatccaaaaatacattttaatatctgaaggatacatccttcgttagtactcttcttttttcctcaacagtttgctctttggcataatttttaaaatttacttcagattattttatcacattaaataacatgcctacctcactgggagatgcagattcaacaagtcttaatacatataaggagcttagaacagtgactggttaagtaaatagccagtaaagttaattactatttttaagtgaaaaaagtccaactcaagctatcttttggaaaaaagtggactttattggttcatgtaactgatatctgcagtgtggaactgggcccagagctctagatggtttctatatctctccacgtggggaatgctgacagcctagcactcagcgtcagagctcagcagccacaaggggaagagggcatcttcccagagctctagtggagaagtcttggggaaggtgtgaacggaactagctttgctcaaaggtccatttctgagccaaactctgtggtgagggtgggcatgctggccacagcattctggtcagccccacctgagcggtgtggaatgggctctcctcgggagagggtgattctgcctctagaaggaggagaatgggatactggttagaaaaacaaaaccaaaaaccagatgatactatctttctttgtgttttaatttcttgaagtacttctttgttgcacctatatatggtccacattattagtaagttcttatttaaaaaaaaaaaaaaaagggcgggatattgccaaacttttactttgcccagtgtgtccatcagagttcatttgcagataatggaaacccctctgctagtttaggcaaggaaaggattaataccaggaattagagaattcactgcttacaaactgtgggaactgcaggagcaggctctaggccaggtgtccagaaaggactcccaaaataatgcacagaactggcctgtcaaggagctgctactcctgccattgacaggcattcactgccccatttgctacaaattcaacggtctcatacacggtttgtaaaataagaagccaccacctcacctattggttctgggacctcatcaccacctcgggcacctgccttactaacaatatggttgtcctgtactctgcccataaacacgtgggaagccagagctgcaacacgaggggctgtgctacctctgctgtggaaaaaccaaatgcttccatgttagccgagggctccgtggtggaggctgggccatatcagactgtgagctgagacagcctgggaaatgtagtctgtgttttctagcctatagcatgcagctagacatcccataagggactcggaatggaaggaagtgagccagttgaccaaggaagaacatttagaagaaaaccgctaccatctactttcacatcatttaaaaagggaaagcactttttttagccctcccaaaacacaaaggacgtcatcttacactaaaacacaggtagcaactataaactgatatgcacatatgtgcgtgcttgtttgtgtgcgtgcgtacgtgcgtttgtgtgtccgtttttctcttttcactgtgaatcattgaaaattttataaaaaaccagctgtgggccaggtatggtggctcatgcctgtaatcccagcacattgggaggctgaggcaggagaatcgcttgaacctgggaggttgcagtgagctgagattgcgccactgcactccagcctgggtgacaagagcaaaactccatctcaaaacacaaacaaacaacaacagcaacaaaaacaacagctctgggtcagtaaaacaaccttaaggcctcagggaaatcctgctttactggattgacagagaaaatgaaagaagatgaaatttaaacaagtgttttctgctgtttctaaattagcctctctgtgtttggtagggaagaatctgaagttatatattgttgtgttttgtcttggattatgtgtgaattttaatcatttatttactttatgcctgctttccttcctttttccctttcattccatctatacccccatatttctagcatctcatcacagaaaattggtggggcctatactccccaggctgttgactcctgccccttaatctctgtattttcttgctctgcagctgttactagaacaccaggatgcgtatcaggctggaatcgtgtttcctgattgtttttaccctagcatctgcaaaggaggtaagatgaaagtttgcagactgaatgaagtcacttttacttggttaataggaatagctatgactttaaaaatatatatatgtgtgtacaatatatttttaattgcacagtatattttccattattgttgagaacaatttgtttcccaacaatattgttggttaatgacttagtttacatagttgcattttccatttagctataactgacctagttaagcatagaaattctgagaactattttttggtgaaaacctaagtggcatgatagaagacattttgcaagagatcaaaaggtctgagtttgtgttccttctatattagcatgtgatcttaaaaaagtcacttatccacagaatctcaattttcatgtcttggcaaagactggattgtcctgcctgccctgcctagactggattgtccttggcattaatgcacagtattttgtcaagtgttatgcaaatcgcagatactattatttgtaagagttaaagaaagaggaaagaaacatgaaaagcagcttaacagtcaaagacagatttattttggagaagtaaacctgagaggggcttctggccgatttcggtcaggaacactctctctcttacagactgagagtatttattggtgagagagtttggaatgtttctgtgtgggggagaagtttatggtgggattggaatgtctctagttggaggggaggttatcttggggttgacatctctctggctggaggggaggttatcttggggcttgcacgtctctggttggggaggggtttggaatgtttctgattggagatgttatctgtgatttatggttatgctgactgtacccattaggctgatgccctttggatttaggcaatttttggtcaaggtgaacttaaaatggcagttcttgtccaagatggcaatgcttctgctctgtcattatcagtaaacttgtctcatgagtcgtatcagtcagagccccagcaggacccagaagtcacactcaaactgagtaattggagaggagcttagtaagggcaccattttcaaagatatggacaggaggcgaggaattgcaaaagatagttcaagggagggagagattactggaaccgtggagagagagagctgcatgaagaggaccacttgagagctggaccttcagctaaggggcacagccagcccactgtgaccccacagaaggggagctgggagaatatataccccaacttctgtgtcttctttttctctgatctgtcagttctctttattggccaaacccaacccaatcaaagccagagagccacgaagctagttgaagcaggtgacctcagagtcaccctacaaggtagagaaggatggggagtgggtctggaaggacaaatggaggcccccagcacgctgggtacttgtataaactgcttctggggttttgggtcatctgctattatcccattcctttaattcagtgatgtctttgggactgaaatgaactatctggggctaatcactcctgcagttagaatcccaggcagctagcttttgtatttctcatatttataaggagttttgttctgtttccctcttagtctgttaactatcatttctcaatcctattattttgcctgcatgttatagttctcctttctaacctattatttctaatttagcacttcccaaactgtattcatgggagctctactgtcccttgatagcttctacaaaaaagaaagaagaaaggatatttttgtccattcaatttgagcaacattgcttaatgtacgccatttttagagacagacaaaacccacactaatcaaggttctgaggagagtggaaaaggaatgtaaagtatttacctagcattttccagttttttctgcagcaataaatagtcttgtgtgatgaaaagattgggactggtatatgactagttacagggaatttgcatacaaattccacttattccacttaggtttttttgcatttttccacattttaccttgtctcatacatacctaattcaactgtagttttccttttcttatttggtgatgattcactttcattgcatctttccaaagcacttagctttcttagatacttaattgccaaagaaaaaacaccttttttttaaagttatttttacattttttagagacagggtcttgctctgttgcccaggctggggtgcagtggtgcaatcacagctcattacagcctcaaactcctggcctcaagcaaccctcctgcctcagccttctgagtagctgagactataggtgtgtaccaccatacctggctacttttttattttatttttaaatttttgtagagatgtggtcttgctatgttgcccaggctagtctcaacctcctggcctcagggggtcctcccacttcagcctcccaaagtgctgggattataggcgtgcactactgcacccagcaaaactcttcatttgtattagtttacctaatactgaattagcctttataattacagtaacaaggacatctggtttaaacaggattagaagtgggtctgattgaccctttgtgagctatggtatagacaggtaagttcaagtctctgggcagtggcttgccagctgtcagcatctagtatgtcctgggggactttctgcttccagtctgttggatttacagagggatcagaaagcttcagttaatctgccaatttgtttaagttgaagttgttcaaaagagctactgccatatttaattctggagttttactgtattctggagaacaagaattgtttaaagctttatctctaggaaaactgtgggagcaaatcaaatgtcttgattctaactcctttgaaaatcattttgaaaaaaaaccaatgatttaaaactggttcggcaatttttactttaggaacggcatagaaaaattgaactgagggatctgaactcggcagttttgcttttagttaccctcgtaacatttggcactccatgaggcatttgtggctcttggaggtttagcacagaggccagttctgtctttcctacccctcttgtgggaataaagagctacatgggacacgcactggcccactcaaacgacacttgcataaaatgctcactggggcctgtgccattttgcaataattattataaaatcaaatgcttgaaagcatatgaaatatctgcttttatttcttgtactcttaaggaggctgactgtgagggacaaggaagatactttttaaaatcccaacaaataaacaaaaccaaagtacaacttgtttccttagttttagggcacagaaatggaaacaattctagcctctattctaaccaggtagccgggcttgcgattccgtgagccagtttaggctccgtccctcttactgtagggctctttttagtcatcaggcagacagtaccatgcgtattccaaaatctcagctggctcttccgttttagaggcttcttttgaaagtcgacagaagaaactgaggggcatggagggaaggaggagaagggacacagcagcgcagcgggtggtgtggaagatttgattgagactttccaacttttaagagagaatctagagccctgcttttgttttgtcaggaaaattccatgatgtgtctgagagcactcactggactccgtttcttaatgcaagcgttcattatatccgagagaactatccccttccctgggagaaggtaggcgtggtcctccaatccttaaaatatttagcaccaaacctgccatgcactgtgtttgcacccgcattgaccccatttgtaccgctctgtaagggctgcccaccattccaccttcagtgtcatgcacattgcttggacatagtagatggctagctaatacttgaattacttataaacacggtttgggatacatcacttcatcattttgctccaatagtaattaatctgaaagcacttccaacacatcgtaaaacgtttccaaaagtccttatggttttgtgtgtgtgtgtgtggttttgtttctgtttttgtgtttttcagacagagtgtcgctctgtcacccaggctggagtgcagtggcgcgatcttagctcactgcaagctccacctcccgggttcatgccattctcctgcctcagcctcccaagtaactgggactacaggcgcccgccaccacgcccggctaatttttttttttttttttttgtatttttagtagagacagggtttcaccatgttagccaggatggtctcgatttcctgacctcgtgatccacctgcataggcctcccaaagtgctgggattacaggggtgagccactgcgcccggcctgtgtgtggtttttttttttttgagacagagtcttgctctgtcgcccaggctggagtgcagtggtgcaatttcagctcactgcaacctccgcctcccaggttcaagcaattcttgtgtctcagcctcctgagtagctgggattacaggcaagagccactgcacctggcctcttatgtggtttttaataactagaaactgcaatttacttgcctgaaattttttgttaggtctcagtaacataaatgaatttatatttattaaaacttttaataggattgttattataaaatcacccaaacacacatgactctaatttgcttgtttggcaggacacagagaaactggtagctttcttgtttggaattacttctcacatggcggcagatgtcagctggcatagtctgggccttgaacaaggattccttaggaccatgggagctgtgagtacatccctttatggggaatgactttatgggagtgatactgtctcacctaagatcaaaacctgaccgttttaaaagaaaggaaaatgttaggttattcagacttctgcccaaagcagtgtttggttagagtcccatcttttccaatttgttccttttttttttttttttgagatggagtctcactctgttgccaggctggaatgcagtggtgcgaaggcgcgatcttggctcactgcaacctccaactccctggttcaagtgattctcctgcctcagcctcctgagtagctgggattacaggcacgtgccaccatgcttagctaatttttatatttttagtagagacggggtctcaccatgttggccagggtggtcttgatctcctgacctcatgatctgcctgccttggtctcccaaagtgctgggataacaggcataagccaccgcgcccggtccaattcattccttttattcttcttgccaactgggtagattcatccacaagagcagagtggctaatgtgtactgaaaacagtcatagatgtgatgttttgttttagtcacaaaaataattgataaatcttatgctttattcaagctgtatatcttaagaaggatatgaatacctgccacttggttctatttaaaagtaatacttctactttattggactttttctctctctttttaactttctatatgaaaatgccatgtcctcaaactgaaaattgtgatcttacctgatgacttagcctctggaaggccccctggtccttaatttatgttaattacattctgttagaagtttcaacttcaactcagagatttttatatatatcctataaggcagagttgtctgtagtagctttattgccagacatatgtatccaactcagctgcatatatatgtgtgtgtgtgtgtgtgtgtgtgtgtatgtgggtgtggttttttttgttgttgtttttttgtttgtttgtttttgagatggagtttcactcttgttgctcaggttggagttcagtggtgcaatctcggctcactgcaacctctgcctcccaggtgcaagtgattctcctgcctcagcctcccaagtagctgggattaccagaacccgccaccatgcccggccaattttttgtatttttagtagagatggggtttcactatgttggccaggctggtcttgaactcctgacctcaggtgatccacccgcctcaacctcccaaagtgctgggattacaggcgtgagctaccgcgccctgcctttttattattattatttttttactaataaaatgttagtgtgaaaattgagtctattatgcgtcctcagcagttcattgagttagctgtcatctcccaccacttgcttgactgtggaagtaagagttggggctacaatttgtaatacacaccagatggttctctttctttcttagattgattttcacggctcctattcagaggctcattcggctggtgattttggtactgtttatttacatttgctaaattttctcgtggtatagttcacttataatgacatcactactgtgctttaaatatgtgtgtctttaatattttgctggttgcatgtattttctatttaatgttgcagttcatttagagtagagatgtacctcatttaacatagagatgtatttctaaaaacttgtgtctatatgtatttttttgttaaaaaattctacactttgttgttgacatgtcataattttagaaaaactttacttatacattgggttaaaattcattagctagtgtctcctactttcctaatactttagctttaaactagtaaactccaccttttgcctgtagtagtaaattgcttttaaatatttaaactaggtggtgaatggtgtttattaaacccttatggtcgatatttccttaaagtaaaacaaaaaacacctttggttatatggccagttctttcttaatttatatgtttcactaactaagatttttaaaagataattttttcttaaaaaaaaaaaaaaaaaaaaggcggcctggcgtggtggctcacacctgtaatcccagcactttgggaggccaaggcaggtggatcacctgaggtcaggagttcaagaccagcctggccaacatggtgaaaccccacctctactaaaaatacaaaaattagctgggcgtggtggcgcatgcctgtaatcccagctacgagggaggctgaggcaggagaattgcttgaacccaggaggcggaggtttcagtgagccgagatcacgccattgcactccagcctgggcaataagagcaaaactccgtctaaaaaaaaaaaaaggcatgcctttacctaaaacaatgaacaaaaacatgtaataatgtgaaaaactaataatccaacttgtcagacctcatgttgaatagatgcatgctatgtttgtcactaatccaccaaatgtcaatatttttctcataccctaggaggagatgtgttgagccagtttgaatttaattttaattaccttgcacgacgctggtaagagcaatgtacatctaaatatgtggtatctaagtggcatttagagccttgactttttttcttagaaaatataactgacaatataattagaagtcttctgcactggtaaattttgaaaagtaaaattgcatattagcatagtttagattctttgagaaattgaattccactcaattttgaatggagtggagttgctgagtcatagtttactttttcaaaatgatcatcttaacttatgctcccattagctttgtataatcattctggttcttctgcattctccaatacttggtattgtccaactgttaaaatttccagcctgtttgtgtgtaatggtatctcattgaggttgcagtttgaatttcccagattgctaatgaggttacacttttcttctattttatggatcatttgtgtttgattttaagtgaaaactttttccagttttcagtctatttttctgttgggttgtttatcctttttatttatttgtgagtatttatatattctggcttctactctcttgtcagtttgtcacttagttattacaaatgtctttcacagtttgtggtatgtcctttcacttattgtgtatcttgacaaacaggatttgttaatattcatgtagttgaatagatcagtttttcctttgtaatgtgtacttctgatgtcttatttaagaaatccgttcttagctaggtgtggtggcacagcatctgtagtcccagctactcaggaggctgaggtgggaggatcacttgagcacaggagtttgaggcttcagtgagctatgatcgcgcctctgcactccagcctgggcaacacagtgagaccctgtctcttaaataaaaagaaagaaaacctttctaccttgagggcaaatggttattctcttacatggacttctaaagcttttatagttttatatcttagctttatgtctttgatttaactggagttaattttttgtatgttctgagatgtaaatctaattttattttttcctctggagataatggattgtcccagaatgatttatcaatagtctcccctttccttgctgatctacaataccttctctgttttggttttctgtttctttctgtctttttttttgagccagtctaactctgtggctcgggctggagtgcagtggtgtgtgatcttgggtcactgcaaactccaacttccaggcccaaatgatcctcccacctcagcctccacctggctaattttttaatgttttgtaagagatgaggtcttgccatgttgcccaggctggtctcgaactcctgggctcaagtgatccgcccaccttggcctcccaagtgttgggattataggtgtgagccactgcaccccctttgggttataaattaaaatgttatgtatatgtatgggtcagtttctgggctttctgatatgtccttttggtccctgaacaatattgattattttaattgctgtagctttataataagtcttgggctctgttagggcagatcttataactagtccttctttttcttcaaaagtaccttgcctattctttgcctttgttctttcaaataagatttaggctcaagttgtcatgttccaagaaaaactttgctggaattttgattaagtgtttattgaatctagagatgaattggaaaattaacaattttgaaatattgaggccaggcacggtggctcatgcctgtaatcccagcactttgggagggtgaggcaggtgaatcacctgaggtcaggagttcgagatcagcctggccaacatggttaaaccctgtctctactaaaactacaaaaattagcctggtacgatggcacgtgcctgtaatcccagcaacttgggaggctgaggcaggagaatcacttgaacctgggaggcggaggtttcagtgagctgagatcatgccattgcacttcagcctgagagacaagagcaaaactccgtctcaaaaaataaaaaaagaaaaaaaaatttaccattcaaataaaaagatttgtaagttataagtaagataacatcactatttatttctttactttttatcaggtttatctactgattattaagagagaaattagtttcaaagatctcccacatgagggtagatttttcaatttcttgtagttctgtcagagtttgctttgctatatagattttgaagatatattgttaggtacattcaatttcaaaaggataccttgtgaattgagctttttatcgtgaggcaaaatccctctttatctctaataatagttgctgcattaaagtctcctttatcagatgtgactggagttatactggtcatgtttggtgatattccatggtgctagaataagtaggctcaagttaagaactgccgagatcatgccactgcgctccagcttgggcgacagggtgagactccaactccatctcaaaaaaacaaacaaaaaaaaaaccgtccaggttccaaacctaacgtgtagggtgtggcacacgttctcagggcaaaagctggttgtcccatttgcttacctcccagggtttttttgtttctagttgtttttggcctttgaaaaatttctgctgtcctgctagcttggtgattcatttaaaaaaatattttttgttattttgtctgactttttaagctatttttattgggaatgccattccagtgctcttataaaataaaaaatgagtctctcaattgtttctttcttttacctactaaaagaaacctactaaagttagattttattggttgcgattttttatcttgtttattctgaggatttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacattggggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgacttttgaggatttttaaattaaaagatgattgagtataaatctggtttttaaatgctgctctttgcaatggaaataactaatatttgtgaaccaaaagcctgatttagaattcttttcattgctttatactgtaaaccaagaagtatctgagacaagtctcaatcaatttaggaagtttgttttgccaagattaaggacacacccatgatacagcctcaggaggtccggatgacaacatgtgcccaaggctgttggagcacatcttggttatctgtacattttagggagacttgggacatcaatcaataaatgcgaaatggctattggccagttagctcagttgtggtgctaatgacaccagggtcgcaggttcagtccccttacaggtcagttgttttggccaggcatggtggcgcacgcctgtagtctcagctgcttgggaggctgaggcaggagaattgcttgaacttggaaggcggaggttgcggtgaaccgatatcgcaccactgcactccagcctgggtgacagagtgagactccatctcaaaaaaaaaataaaaataaaaaaataagtaaaatgtccattggttcagtccagaaagatgggacaactcgaagcgaggaggaggcttccaggtcataggtagctatgagacatccttccgaatttccaattagcctttcactgaaaatgcagtttacagtaatagtgtcacttatgctgtagtctggtttagtgaaacaattaggcaaaggaagcaatcagatatacatttgtctcaggtgagcagagggatgatatttgagttctatctgtcctttgcccacatgaatttccttgtgggcaaattgtgagggaggtatgtagcttttaatctttgtagcaatctcacttagaaatagattgggagggccaggtgtggtggctcacgcctgtaatcccagcactttgggaggccgaggcaggtggatcacctgaggttgggagttcgagaccagcctgaccaacatggagaaaccccatgtctaccaaaaatataaaattagccgggcgtggtggcacacgcctgtaatcccagctgcttgggaggctgaggcaggagaattgcttgaacccgggaggcggaggttgcggtgaacggagattgcaccattgcactccagcctgggcaacaagagcgaagctccgtctccaaaaaaaaaacaaaaaacagaaaacaaaaacaaccacacagaaaccacacagaaatagattgggaggcaggtttgccctacacggttcccagcttgacttttccctttagtttagtgattttggggttctgagatttattttcctttacaatacttttatactttggtatacttttttgtatactttatatactctgaaattaagatgtcagggtgaggagacatttttataatagtgtttttaaaataattcttttcaattcaacttgaaacaatgaaaatactttaaattacttcttgaactctgaattcacaaaattaaccactctttttgtacgttatagttagtttccaatctgagtatacctacataaatatttgatttaagttaccagttgtttgctctgcatcattgggccaattatttaacttttctgtgccttaatcatttcttcttatgtaaaacgggaatatgatagtactaaccacctgaggtcattgctaggattaaataactagtgcatgtaaagacttttacatggtgcctggcacaaaataatcacggaataactggtagctgctgctgctgttgttactattttcagcttcagaatcaaaacaactcttactttattctgcatttttcaggtatgtgccagtcaaagatctactgggaatttatgagaaactgtatggtcgaaaagtcatcaccgaaaatgtaatcgttgattgttcacatatccagttcttagaaatgtaagcgtaactcagaggacaatttgcagctgattttgttgtgacttcctttgcacagtttttatgtttttgtttcctgagactggattttggatttatggattctgcttattcaaaggcagttgcatgacggtggaaaagggtggatggaactttttcttcattatttgcttcatttctctgttacaaactgcaactcacagccaaaattattgtttattttgcaggtatggtgagatgctagctgtttccaaggtaaaggcgtcattcttccaaatcttaaaggattataaagataccaggaatagtaccatattcattttattttttctttctctctgccatagttatatcccacttactctacaaagtccccgtttttggtggaacaattccaagagtattttcttggaggactggatgatatggcattttggtccactaatatttaccatctaacaagcttcatgttggagaatgggaccaggtgaattcatattgcatttctattaccaatcactctctgcctttttaccccatcccccaacataactctcaggtttttcaactgatcacataaaaacaaaacaaaacaatctcatgaagtgcttttctaacctattcaaagagggaaagaatggaaactcagtgatcttataaacttgactggttcccatccagttggcttggttgatgctgctcgtgttttagaaatagagagacagttattgcaatatttggggtctgtgagaaatggctcagccaggcaggaatcagcctccacaggtggtgctccatttgtttctttctttttattttgagacagagtcttgctctgttgctcaggctggagtacagtggcacgatctcggcttcactgcaacctctgcctcctgggttcaagggagtctcgtgcctcagcctcccaatcagctgggactacaggtgtgcaccaccatccctggctaatttttttgtatttttagtagagatgaggtttcgccatattggccaggctggcctgaaactcctggcctcaagtgatccacctgccttggtctcccaaagtgctgggattacaggcatgagccactgcacccagcctccatctgtttcttttgggaaaacccatgctgggggctggagtgccaggtctccacaggtcccagagtggctgtgttcttgctgtggtgacacacctctccaccctgactacactctcagggtttcagggtgtcaaaggatacctcacctaatactaaaaaaacagaagcaaatagagctatagctacatgccccgacacacactccaacgtaaaatgagaaataaatgcatttgtaaaacattctgttgaaatttgacatctagcccagatgggacagctgctgaacctccagttccttttcttctcctaagcatgctcaggacaagaattaatcagaaactcagccgaaatatagataaggtagactgtgattgtccccacttctagctgtagtagatcattagactctcacagagtcttacactacccctagatcagagggagccaaggcccttctgataacccatttctttctttttcttttttttttaagagcacatgtgtttttgttttttgtttttgagatggggtcttgttctgtcacccaggctggagggcagtggcattatctcagctcgctacaacctccacctcctgggctcaagtgattcttgtgcctcagtctcgagtacctgggaccacaggctcacaccactgcaccaggctaattgtttgtatttttggtagagatggggttttaccatgttgcccaggctggtctccacctcctgagatccaagtgatccacccgcctcagactcccaaagtgctgggattacaggcatgagccaccatgcgtggccggaaaacccatttctttttttttcttttcttttcttttcttttctttttttttttttttttgagacagagtcttgctctgttgcccaggctagagtgcagtggtgcgatctcggctcactgcaacctccacctcctgggttcaagcaattctcctgcctcagcttcccgagtagttatgactacaggtactcaccactacacctggctaatttttgtattttttgtagagacagagttttgccatgttggttggccaggctggtctcgatctcctgacctcaagtgatccacccacctctgtctcccaaagtgctgagattacaggcgtgagccaccatgcctggcccagagaacccatttctgatcatgctgttggacatgcagcctctccccactactgacctgaaccgggttgagatgtgggtgtggctaggaagcacagggcagcccccgaatcggggaaagggcagagcgggaagcttaggctgtaccaccagcagtgggaaagagggttctctgggcgggacctgtgcctgggagactgttccaggtcaggatcatagcagagttagctgttcataagttggaatggcctacagaatgtagatccagaatattatactgggtgatattcctttacccttataaacatttgctagtacccaaacagtgttaaccataattatatattgtgttgatttgaaacaaaattccctttgatgacaaattcgaccttagcttggtacataataaacttgtttttaacaatcggtgagtaacaatttggcagggatagcaatctcatatgaatgccacttttaatagtgaaataaacctcaactaaaatccccaagctctcccgtggacctgggtttttaggtgcatactgccgtggttgtacagaatttaagggatctgccactcactactgagttatctggaacaagttgctaaaccttccaaaatcttatttcctcacctataaaattgggacagcaatactatttttaccataggatttttgtgaggagtaaattagatcagtcatgtaaagggtttagaatagagtaagcacttactaagtattggttactattattattagaaggaagcaaagtttgtattggaaggactcataacataagggcatgtttgagtgattgacctgcacttacttgttttatataatccaaactggaaaacattttttggtgttcaattttggtttggttctccaaatagctaaggaaagatagctggaccttattctttcgttaggaaaagataattgagaaagaacatatttcttgtctcttgatccctgtcccaatttaccaaggtgtaaaattccatgagttgattgcttgtttgcatacatatacaaagaaagattcatcagaatttatgaaaatgtatgggaaattcagagaagtctccaaaaagagacaacacaaaaaaattcataacagaaaggaaaacataaatatgttcatagtaacaggcatttcccagcttactaacacaggttatcttccaaagctcacttatgttatttggtatattttccttaaaaaagcaatgaagtagtggtagttacattgccaagaactctactcacctcaaactctatttgaaagtatagtgctaatgctgtaaggctgccttttgtgtcctgtggtggacaagaaaaggtccaaagagagaaccttttcctcagctcaaacctggccagagaaatgttttggtaggaagagtctgccttcagctttttcccacctcctttttggaattcctttttcagcaactaattttcttcacccctacactccacattacttttgtattaccccagcctccctcagtgacctccatacaaatcttaagatagtcttcattccagaatactcttcttatattaatacctgcttcctcagtgcttctgttcagtgttgggggaaagcctctattgggaagagtttatctcttatgttctcagaggctttttcacttgtaaaaggggatccttcattagctatttaattattgaaattatggaattttttttaaagaaatgaaattgagaaattcagacacatttaggcataaatgtgtataattgggcagaaggtgacataattggtaaccagtgttgataacactctcaaattctgagacgtttcgtgttagcgtggaacagctcagcaggtggagcggggagggaagaggaaggctgagtctggggtgactggcagcatgagccttcctggattaccatgatagtgacaaccgtcagcctacccaccctctctgggagaacatgggctcttaattagtcctgtatggctaggtaataaacactttaagcctttgggagatgattgaagcgcactaccgattctcggtaaaattcatgcttgtgaagaagtagataaatggctaactcatttgactgtttcctcagtgactgcaacctgcctgagaaccctctgttcattgcatgtggcggccagcaaaaccacacccaggggtaagtggattccaaaattgttcatagaaaaagtacatctcacctggaggagatgccctatagaggttgagaacacgggatctgttgagagacagctgtaggttcaaattccagatttgtcacttgcagctgtgtgatttttaaacaagctgcttgatttttggagctatagcttcctccttttgcaaaatggaaaaagcacatcaacactcccagaattatggtgtggatgacatgcagtggtggatgtaaagcaattagcacatgttgagttgctcattaaacggtagttagtggctgggcacagtggctcatacgtgtaatcctagcactctgggaggctgaggcaggaggatcccttaagtccaggagttcaggaccagcctcagcaacatagtgagacccctatatctacaaaaaatgaacaaaattagccaggtatggtggtgtgtgcctgtagtcccagctacttgggaggctgaggcgggaggattgcttgagcctaggagttcgaggctgcagtgagctgagatcaggccagtacactccagtctaggcaacagagtgagatcctgtctcaaaaaaagaaagaagaaatgtagttagtattattgtaactatcaatattattgtcttactcataaacttcacccagattttacatgaaaatttatttattgatgagacagtgttgggagaagccctcagtgttaagggccagaagcctggtttgtattttaagaaatgatattttctgctggagtcaggtaccaaccgacagtcatttatgcattcatttaataagttattaatattacaaatatgtgtatatttattaataaaatagaacaaaataacacaaataataaaatatcatttattaatcagtacgtgccaggaactggttcaggcactagagatatcattgtgaacaagacagaaacagttcctgctctcaggtatatggcctggcaggtagctgggcactaaacaagtaattgtggacattgttaagtgttaggaagaaaaaatgcaaggtgctctggggatttgcaagcgtcctggcctgggcacaggagggttctccttgaagaagtgatggcttaacagatatttaagtgtcaggaattaaaaatgcagggtgttctggggatttgcaacagagcgtcctggccctgggcacaaaagagctctccttgaagaagtgatggcttaaccgggatatttaaggatgatcaagagtgagatatactcaaaagtagagtattgcaatgataaaggtactgagaggaatgatcttagcactttggaagaatgaaaattacacagaaagtgttcagtgaagtcgtcattgttgtatttgaattgggtaacttttttttttctttttctttttttcctagcaaaccattccttcaacatactttgttgttgtttaatcacattgagcaccttttgattaggcttgcaatctttcttggggttgccagaaccctgacactagttggtgtcatgcccagggccccgtcacttacggctgttgtccactccctacttcagtcatttctgaagcctctctggctccctgagtcatctgctttttggctggttgacatctttgaatgtgaaaatgtatttttattgtataattaattttagcatgtctttgaagataaatcagtatgctggctgggcgtgatggctcacacctgtaattccagcactttgggagaccgaggcaggtggatcacctgagctcaggagttcgagcccagcctggccaacatagtgaaactccatctctactaaaaatacaaaaaaatcagctgggtgtggtggtgcatgcctgtagttccaggctactcaggaggctgagacaggagaattgcttgaacccaggaggcgaaggttgcaatgagccgagatcgtgccactgcactgcagcctaggtgacagagcaagactccgtctcaaaaaaaaaaaaaaaatcagtatgcttgcaaagcagtttccccaccagctgatacctgttgctaaattttttcataatctggaaagaattgaagccttttactcctaccatagagctctgatattataggaaatatgttttataaggataggcttttaagccttagaaatgtgtttactaaaagattttgtgaaatgaaggttttctaaaactttctgtgttgctccttcagccttctgacgttaaaattttgtggtcttttaacctgtgattaacatgactatattcttcaactcagttttacggggggttgttttctcagtcgtaaccagtttattcctctttctcttcaacagctcaaaaatgcagaaaaatgattttcacagaaatttgactacatccctaactgaaagtgttgacaggaatataaactatactgaaagaggagtgttctttagtgtaaattcctggaccccggtaagaattttctgctctaagttgagaaagaggaatgctgcttcttgagataccttgtttcgctgagtccctgggtatttatttgtccattgaaatttacctgtggtgggatgtggtggctgggaggctgagttgagaggatcccttgagtccaggagtttgagacctgtctgggcaacatagcaagaccttgtctctataaaaaataaataaattagctgggtgtgatggctgtgcctgttgtcacagctacttgggaggctaaggcaggaggattgcttgagcccaggagttcaaggctacagtgagctatgatcatgccagtgcactccagcctgggtctaagcatgtgccaggccggcaaatactcttggcatccatatgtggtttgttctggagatgccctgagtctgcacctcagtggtctctgtcaagtcaagatgaccctgggcacccaggccaatccttctttggacttagtcccaaaggcgttcacaatgttgaaggctcactgtgcatagccccattgtgtatgaaattaatcaatgaagttagctgttaagtgaagacactctactgggggatataaaatgaaagacaaatgaactctgacccttaaaaaatttcagtctgaaaggagtgacaaatacaaaaataaccattatgtgagtagactgcaacacataccatggtgcggtaagtgcatcattagatagtagggagaatgggcgtggtggctcacgcctgtaatcccagcactttaagtggctgaggcaggtggattgcttgagctcaggagtttgagactagcctgggtaacataatgagaccctgtctctacaaaaaagtaacaaaaaatcagctgggcatggtagtgtgcacttgtagtcccagctattcgggaggctgaggtgggaggactacttgttcctggaaggcagaggttgcagtgagctgaggttgcaccactgcactccagcctgggtgctagagtgacaccctgtctcaaaaaacaaaacaaaaaaaaaatagcagggagaaaagcttcaccttggaggctatcagacagagaaggcttcctggaggaggggacattcaagttaggtcttggacagtagatagtatttcatcagtgagagtacatttctgttagtgggttgggaaagtttcaggtgttgggaaatctgagtagtcgtatttgcctggagcacaggacaaggaatatgagttactgtgagaggcttaggaagctaagtaggcattggattgtagtgggctcttaatgtcagaagggtttagacaactttgtgaatggggtctctgagaattgcggaagggcctagtttaggtttaatatactgctgtcactgccttaaaattcttaacaatttttttttttttgagacagagtcttgctctgtcacctgagctagagtgcagtggtaccacctcagctcactgtaacctctgcctcccgggttcaagcaattccctgcctcagcctcctgagtagctgggattacaggcacccgccaccatgcccagctactttttgtatttttagtagagatggggtttcaccatgttggccaggctggtcttgaactcctgaccttaggtaatccgcccacctgggcctcccaaagtgctgggattacaggcgtgagccaccacacccggctttaacaatttttttaacaaaaggctgcatgttttaattttgccctggcctccttaaattatgtagctggtcccggaccggggaggggaacctctatcaaagcacatgtcattttgtcttgccatatttggattttctcctttgcaaaaaaatgaattgtctaaggagggactttatgttcccagtgtctgctgtggtacctggcatatagtaggagctgattaattgcttcctggatgaatgagcaagtcagagctaggctttaggatgaagcaatctatgcatggcctgccagtgagattagaatgggcaaagcagaaggcatactcgtgcctgaaagatcctcagaccctgtgcttttgcagcgcctgagccatctgggctgccttcatgctctgagccaactgtgctctgctttggagcagacctaggaaatcttgtttggtctcatgtcacccttgggcagatttagagttgtgtccccttaacttggatggatctagtatctggccagcttgttcagggccactctcgtttgtgttttttgtctctgcagtaaccacattaagaacgattcagcatcccaagctgaggggcttgttgtcccccaaattctgtggtgtacggctcctagcattctgcatgtgacctctcgtgcctgcctggcagcaaatacaaccacatctcagcttgggtgtggtttggaggatatcgttttttttttttgagatggagtcttgctctgtcacccaggctagcgtgcagcggcacgatctcagctcactgcaacctccatctcccaggttcaagcgattttcctgcctcagcctcccaagtagctgggactacaggtgcccgccaccactcccagctaatttttagtagagacggggtttcactatattggccaggctggtctcgaactcctgaccttgtgatcctcccaccttgacctcccaaagtgctaggattataggcgtgagccaccgcgcctggccggtctggaggatatctttggcatcctgttgttccagtttatttgtttgttaatatatatacacatatacaaatacaattaaagttctgcattgaaaggacttgttctttttcttgttgttgagacagagtctcattctgttgctcaggctggagtgcaatggtgagatctcagctcattgcagcctcaacctcttggatgcaggtgatcctcccatttcagcctcccaagtagcagggattacaggcacgctccaccacactcggctaattttttgtattttttgttgagatggggtttctccatgttgcccaggctggtctcaaactcctgggttcaagtgatcctcctgtctcagcctcctaaagtgctaggattacaggtgtgagccactgcacatggacagacttggcttttaaaaaattttattcccctgggcatggtggcttacgcctgtaatcccagcactttgggggagccgaggcaggtagattgcttaaggtcaggaattcgagaccagcctggccaacatggtgagaccccatctctactaaaatacaaaaattagctgggtgtggtggcgagcacctgtaatcccagctactagggaggctaaggcaggagaattgcttgaacccagggggcggaggttgcagtgagttgagatcgtgccactgcactccagcctggtgacagagcgataactctttctacccatgctggtcccaacctcttgggctgtaactctgccatccctcagcataatttgggggtatgatttcactatcctaattgcctgtcctaagtgatcttacttgctgataggacctaatgttttattttattgtttagcacttctaaaaactcatttcctttacacaagtccaatactttggacaggaaacagtagctttgttgattatgctacgtgtctttactgtctataatgattcttttatttcaggattccatgtcctttatctacaaggctttggaaaggaacataaggacaatgttcataggtggctctcagttgtcacaaaagcacgtctccagccccttagcatcttacttcttgtcatttccttatgcgaggcttggctggtacgtataagtttatctaacttgtgaatgttttcttcagtattaattttattcaatcattctgcaactgttttttatttcattttattttattttatttttgagacagagtctcacttgtcacccaggctggagtacagtggcttgatcttggctcactgcaacctctgcctcccaggttcaagtgattctctgcctcagcttcccagtagctggggttacaggtgcgcgccaccatgcctggctaatttttatatttttagtagagacaaggtttcaccatgttgaccaggctgatctcgaacttctgggctcaagtgatcttcccgccttggcctcccaaagtcctgggattgcaggtgtgagccactgtgcccagccctctgcaactgttttaaatggtgcttgttagcaccttgcttgtcaatgaattcatcatcaacaaaagcattaatttatttgattaaaaaaatttttttttctgtactagagatggggtcttgctatgttgcccaggctggtctcaaactcctgggctcaagcgatccacctgcctcagccccccaaagtgctgggattacaagcatgagccactgcacctggccaaaagcattaatttaatggttaagttattgtaacaatgaaatgatctccttacacttggtcaaatatgtttaaatacaaggaactttcggtttactaaataatcacaacaataaaggattgtttcatggaatttttgtaaagctctgatgttcttggagataaattcttacagatttcttttgtaatctagtcacatcagaaggatataagcagatagctgttatagtgatttaaatattgtaacttcatatggtaaaagctggtataccatgacagttttataaagagaatgttaggaattcctctgattttaaaattcaaccaaaactaagcccccaaaataaataaaaaaataaaacaaaacaacaacaacatacaaaactaaccccaagtatataaaagtgactattttctggaagtttggatgaaggctttttaaaaaaatcatactccttaattccaaagggcattgcatttccttggcacaatttcctgacagtccttcctttcagggcttctgtgcattcagctctagtgcaggagatggggaggtgaatgctgtctttactggtcgttcacttgtgtgtatggctacctccctgaaagatccgaaaggcctcctgctgggctggcagctacataagcacagccagccacaggggcatccctagggccattactggccagcattgagcctccaaagtgcagagaacagcaacgggtccactggagtgtctgtccctcccaccaggtatcacagccttaaacaactgctcttgactttttcctttgttctgccgtttgttctgatttcggctcactgggttctctgcctcccgggttcaagtgattctcctgcctcagcctccaaagtagctgggattacaggcgcctgccaccatacccagctaatttttgtatttttagtagagacagcatttcactgtcttggccaggctggtatcgaactcctgatctcaggtgatccacctgccttggcctcccaaagtgctgggattacaggcgtgagccaccatgctcggcctgccatttgttctttatgtgatgataagcactagaataaacaaatgacttttggtctttccagcccctgtagtgacacttgaacctttgactcggtttatccagctctgtaactggtggctcttggaatctcatctaggagcctctactaaacatgtgggactcttgatttggcccactgccaggtgcctttgtggctgtggtaaaaacatagtctatttcacacaagctcgtctttgatcagataacacattgaaacgaattgagcagatcagaaagtggcctgcgccattggctagaggggcttggctggacatgaatttcctctctactctcaggcaagccctggttttgtgtataagacaagcttcatgagtatacttttcatcctctcaggttatgtagtccagaaatgcttagaggccttgatttgtccatttttattttatttttccccttgaagaatgagactgaatcacactaacaatacaacctgagaagtgaatattcacaacagtcacgcagggtggaaaagtcagtgagagaaagttaatggactgggctctagaaaggaaagaagcaggcgacagctttaaccctagtgctcagtgcataccatggtgggtcccttcacttccctaagggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccaggtgagacaccatctcatcctttctcttctagtggttagtagctactcttgcattttgtggcagattctccaggatgagtaactaataacaagaataattacagtaacaaacagctggtggtgtacatttgtgaagcactttttagttttagaagcatgtttacatcatttattttattctatcattagtctaataccttccaaaaacacacatgctattgagaactgctttgagtggccagttgggatgtgatttcttgataatataattgataatataaaacctctttatacacacacacacacacacacacacacgaaatgtatgtatttataaaactttgtaagtattttattttaattaatttatttatttatttgagatggagtctcttgctctgtcacccaggctggagtgcagtggtgcaatctctgctcactgcaacctctgcctcccgggttcaagcaattctcctgcctcagcctcctgagtagctggtactacaggtgcacaccaccaggcccggctaatttttttatttttagtagagatgcagttttgccatgttggccagtctggtctcaaactcctgaccttaggtgatccacccaccttggcctcccaaagtgctgggattacaggcgtgagccactgcatccgtccagaattttagattcacagaaaaggtataaagacagtacaaagagttcccatgtactgtttactcattttcccctatgttaacatcttacataattatggtatacttgtcaaaaattaagaataaaaacaacactctacatcactattaactaaacgccaggctttctttagatttccttcttttgtcctaagtggttattcatcacctgaaaaaacccgcagtgactacaaacgttcctcgtggagtccaagcattaattcctcccgagagcgctagggtcctggaaagtttttctaacatcagaggctttagtttttgtaacagcaataaggaggagcgtgggggggtggggtagacagagctctgctactagtcaccaatgagtgtggggcttttggtgatactggcctggcactgcattctctgagtgtcaagtgctagggggagaaccctagacttccagtcagatcgtcgtggttcttgttccaggcaaggcacttaccctttcgctgtgaagtgaatcctgtgaagagaaaataagatggcacacctgaacgtgcttgctttttttttttttttgagataaactctcactgttgcccagactggagtgcagtggcatgatcttggctcactgcaacctctgccttctgggtttaagttattctcccatctcaaggtcacaagtagctaggactacaggcatgcaccgccatgcccggctaatttttgtatttttagtagagacggggtttcaccatattggtaaggctggtcttgaactcttgacctcaggtggtccgtccgcctcagcctcccaaagtgccgggattgtaggtgtgagccaccacgcccagccatgaacacgctttcaaaaataagaagtacaatgatttatgatctagtttaggctctgatgaaaggagctctgaatccaacatgtacaaataaggtgactggtcagtgtgtaaggtcacagtcccagagggacagcatttttcagggccttctgacaccacatgaaaaatttccaaaataaatttatctaatcttgttgcttcttacttctctacaaagcctttccccgacagactgttgtgtaaagtgtaaacctttgggcacatatagacagggaataaagagaggcacctgcttcctgtggctgctaaactctctcaaagaccacttgggtgagaaaggaagtggctccatgccctcctcccctagtgacctttgatcatttcaaagatggcaagataaaggcatggacgaaggatggaaatcctgccctcaggccctgactgcagtgagcatctctgtgtcctcattgatacaatgaaggtttatgataggaaactcaaggcctggcctgctttaaagttctgtgctcctctcggaatgactggctggcccgtaggagggccggatggtgcagctgatagtgataaaatgaaccagtcctcagctggcagagccctgagttattggttcccaccctgccctagcgtgttttgtgtccccaggcaaccttatcttgtttatcaagtttctgccttacagaaaggggcagcacttatagatgccactgcacacgggtgtggagagattacctaataaataatggacgtgggtccttcagcatgtgtgttatgtggcaagcaccactgtgtgaaaggccattcgttgttatgtaagttgtgaaagaattggagaacctggccgggcgcggtggctcatgcctataatcccagcactttgggaggccaaggcgggcagatcctgaggtcaagagatcaagaccagcctgatcaacgtggtgaaaccccgtctctactaaaaatacaaaattagccagatgtggtggcatatgcctgtaatcccagctactcgggaggctgaggcaggagaatcgcttgaacccaggaggcggaggttgcggtgagccaagcactattgcactctagcctgggcaacaagagcgaaactccatctcaaaaacaaaaaacaaaaacaaaaaaaagagaaagaattggaaaacccagtgaattactttcaggtttaggctgattccagacggtaggataagaaagatctagaaagtccactttggaaaaaaaaagtctgaagagattgagttttccatctgtacactgttaaagtgaggatgctaacagttcctaccttaatccatttaaagtgcttagaacaatatctacaccgtcctacaggactttctgcactgataggaatgttccgtagctgtgctgtccagtgcgggagacataaaacacaggctttgaacatttgaaatgtggctattgcaactgaaaaactgaatttttatttatttatttatttattctgtttgtgtgtttgttttgagatggagtttcacttctgttgcccaggctggagtgcagtggcatgatctcggctcactgcaacctctgcctcccaggttcaagcgattctcctgcctcagcctcctgagtagctggaattacaggtgcccaccaccacacctggctaatttttgtatttttagtagacatgaggtttggccatgttggccaggctggtctcaaactcctcaggtgatctgctcgcctcggcctcccaaagtgctgggattacaggcataagccactgcgccagggtagaaactgaatttttgattctatttaatgttaattactttaaatttaaatgtaacagccctatttggctaggggctaccaccttggtcagcatggctctagaacatcctgagtattcaacaaatgttagctattgttgctgatgttatatgattattattttagatactttcttttttgtttgtttgtttttttgagatggagtctcgctgtgttgcctaggctggagtgcagtggcacgatcttggcttactgcaacctccgcctcccagattcaagggattctcctgcctcagtctccagagtagctgggattacaggcatgtgccaccacacccggctaattcttgtagttttagtacagatggggtttcactatgttggccaggctggttttgaactcctgacctcaggttcaggcctcccaaagtgctgggattacaggtgtgagccaccgtgcccggcctattttagatactttcgaagataagttttgtgcttaatgtgggtctgaacatacacgaggctattttctacaaatctagaactcataagaaccaaccctctactttctggcatctctgcttcccctcaaggcagacagacatgctgaaaatatacttagggcagagctacctaactgatgtgttgcagatatgttatagcttactgcaccttcggcttttgggtggcggggggcgggggttgtcccaggcctctctactccctgggggtcaggagtgctctttccgaggccgtggctcagcccaggggaagtaaacttgtgcctcttcagccctcaggtcggtttggctcggccttggctgtgttggactttaacgtggacggcgtgcctgacctggccgtgggagctccctcggtgggctccgagcagctcacctacaaagtaaggctgctgctggatagggttggaggagaatggggtggcagggaggggactctgagggaggccaacgctgggatgagcccctggagcaaagcagacagccagtgtgtgagacagagcatttgtgagcagataatctcaggcccctatggggttcttgccgtgaccttgagttaccttgtagcacctgctgctgcctccctggccttattttggccctatggtttcccaattccaccaggtacttagccctttttttcatcccccaccatgctgaatgccagtgaagggagacagaaatcccagctcatctgtagtttctggttatcacaacagcgaggtgacttccctgggcctctcctcaaatggtggatccccgcctgttgcctcctttcttactgagttagagatcctggaccctggcccacagggcttgcttgcttcccacagatgcttcctaccatagcagggaccacgcatccgggcaccatgtgtgactgtggaggtcgagggccctcccttgccagctgccctctgcagactcaactcttgccccttcctcctcacactccatttctagacatgccagcagtctgtcacgtcctgaactcatcaggctgtctcactttgcgacctttgctcgtacagtttcctctgcttgaaaagctttttctcccctgtctttctttaggagtgacatgtcacttcttgcagaaactattacctaactcctgggcgaggctgatacttccttgtccccacttagcatcctgtgcttgtacctgttatatccccttcttccctgggtgtcataatgacctgtgtgccagcctttcaggaggaaagagattggtcttatttgtcattgtgtacctagtacctggcttatgatggaaaagaagtgcttgtagaatgaatggggatggagacaggcaagttataagaggaactgattggtaacacagaataaaatagcacagtgtgtatcctcaggcaggtaagtggtacagatgtggtatgttggcattcagatgtgccatgggtacaacaggctgtggcccgggggcttcatggaagagcctgaaactgtgctggtccttgaagtgggcaaggagttgagtaagtcattctgcaagcacactgcacaattgtgtgtggaggatcttgagtaagacatcagggaggcaaagatataaatgacatcatttctgcattgtggactctcatagtctgatggaagtgacagactttaaaaaaattcctttcagcccagcagcaatgcacagaatggatttctgtctgtcattaagctcccaatcattgggggtggtgataatttgacaaggtctcgctttaattaaaagtttttttcgtggacacaggatctcactgtgttttcgaggctgctcttgaactcctggcctcaagcaatgttcccacttgggcctcccaaagcactgggattatagacatcagccaccatacctggacccagagtcagtcctttttatcttctgttatttaaggttcttgggtcaccaccagagcctcatgtctatctgctgtttgtccttatctagggtgccgtgtatgtctactttggttccaaacaaggaggaatgtcttcttcccctaacatcaccatttcttgccaggtatgtttaccactttagccaggtgcagaaacctagaactcgctgtatcctaactgccaccagggctgggtaaaatgtgctttcctggtttcttcttaaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaaggtagtgcctgagggggaatgggtgagaccatggctgctctgtgggtctacgacaacttatcctgcataggggtttatatcctttttccttattccatatcatttcaccaacattttctaacagtctgttactcttaaagatgtgttggcaagtgatgtgcatagattcactgaaaatacaaaaggtgacccacagtttctaggtagagagccaaagagggcaaatagactattcccatagtgtctccatgtaaaacagaaacactgaggaggctttgcaccggaggcatctcagtggtgctctcgactgtccatagctgttgttgttgttgttgttgttattgttgttttttctttttttttgagacagagtctccctgtgtcacccaggctggagtgcagtagcataatcttggctcactacaacctccacctcccaggtttaagcaattctgtctcagcctcctgagtagctgggactacaggtggggactacaggcgcatgccaccatgcccggctaatttttgtatttttagtagagacggggtttcatcatattggtcaggctggtcttgaactcctgacctctggtgatccacccacctcggcgtcccaaagtgctgggattacaggtgtgagccaccgcacctggcccagagcctttttaaatagcatcctctgctccacagaagtgagctctagaaatgtatttcttgtatgaagagtgagattcaatgacattggggtcctgggatcagcatggggacatataagacctctggcaaaaactcagcaaaatgaacccacttctattaggctacgagaaggaccctttcttttcatcccagtagtcctctcacttaaagtattagtaaaaaggatgagttgtcttctttagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggtgaggctgatgctgggggctgggaaccatgaacacaggggcaggtacctgctgctatggagcgcactgagcatgaggctgagggaaaagggctaggaaatgcttgacttttgaaggaaaagccaaggctctgggcaagattgcaaattctcctccttagaaatttaaaaatacaatagacaagtgtattattttctcacagttctggaagctagacgtccaagatcaaggttgaggtcagagggttggtttctcctgaggcctgtctccttggcttgcagatggctgtcttccctctctgtgtgtctgtgccccattcctcacttctgttttttcttttgggaggagggggtgagggttcactctgttgcaaagggcagagggcagtggtaactcactgcaggctcgaactcgtcctcctgcctcggcctcctgaatagctgggactacaagtcgtgtgtgcccatgcctagctaattttttttttttaatttaaaaacatttttatagggatgggtttttgcagtgttgcccaggctcgtctcaaactggcctcaagtgatcctcctgcctctcctcttctttgaaagacaccagtcctattggatcaggatccacccaaatgacctcatcgtaacttaatcacctctttaaagactctgtcttcaagtagtcacattcagagatactgggggttagggcttcagtgtagggatcggggggaccaccactgagcccataacagtaggtacccctatatctctatcccagagagtctgctgggaggcctgtcagttgggaggcaggatggtgggtgtggcacctggagagcctggatgttgcgattaactccaatagtccccacacttccaggcctggggtcacagagacagagcctgctgggaggcctggatggggggaggtgcatttcctttccttgctcctgagtacctggccagctgtcagtcttgtgccctggcagctaagcccagtgtgcttcattctaggctgggccatttgttacacatccgagatgagaaaaagagccttgggagggtgtatggctacttcccaccaaacggccaaagctggtttaccatttctggagacaaggtatgacaagccctccccacacaggagagtggacactccaaggaagttttctcacctatacaatattgatttattgtgtctcacaggcaatggggaaactgggtacttccctttccagtggccacgtactgatgaatgggactctgaaacaagtgctgctggttggagcccctacgtacggtaggtcacacactgtgaaactgtgcttcctttcagtcatgtggctgcttgtacacgtcgtattggaggaaagtgatgagatctggagctgaacagatctaggtttcaatatttccttttttcattaataacattctgtgtaactttggggaagttacttaacctctcagaacttttgtatcaccatctacaaaactgaaattgtaaatacctatttcaggccgggtgcggtggctcacacctgtaatcccagcactttgggaggccaaggtgagagaatcacttgaggtcaggagttggagaccagcctggcaacatggtgaaactttgcctctactaaaaatacaaaaattagccaggtgtggtggtgcatacctgtaatcccagctactcgggaggctgaggcaggagaatcgcttgaatctgggaggcagaagttgcagtaagccaagatcatgccactgcactccagcctgggcaacagagcaagacttcatctcaaaaataaaataaaaataaaataaaataagataaaataaaatttgtgtttcaaagctttgttgaaaatgacatatgaaagtaacttagtgtatttttaaagcccctatcccatggaacttggagccagagaaaaattgtataggtcagttcactaggaataggtccactatgaggacctatcttttatttttcttttttgagacagtcttgctgtgtcgcccaggctggagtgcagcggtgtgattatggcttatggcagccttgacctcctgggcaaagtgaaccttgcacctcagcctcctgagtagctgcgactacaggcagtcagccaccacattatctaattttttattttttgtagcgagagggtctcaacatgttggccagactggtctctaactcctgggctcaagtaatcctcccaccttggtctcccaaagtgctgggattacaggcatgatccactgcacccacccctgaaaacatactttatataaaccattattttgtttactttatgggaaagatagtctttaaaaaaataaataaataagaaccatttcctcccagattataaaggtgaattatgcttattgtggaaacttctgaaaatacaaggaaatatatagaaggaaaaaaaaaacaccccttacccagatatttaaaaactgaagcttatactatatatgatattgtcatgcctaatttttttacttatatcttaagcacattctcatgttagtaaatattcttctaaaacatgacttttgatatctgcattgcatttttttaatgccagcatttactaacatcatcctgttgctggaattgtaggctcgtttccagtttcacactattgtgaataagtaattattgaacactcatgtacctagtctttgactgcctttctgattagttttttggatagattcctggagatggaattactggagtagaggttctaatctttctaaaagctcttgttatatatcatcaaactatttttcagaaagattgttgtttcttgcaatatgggaaagatttgaataataagcagaagtgggtcagacaggcggggtgcagtggctcacgcctgtaatcctggcactttgggaggcagaggtgggtggatcagttgaggtcaggagttagagaccagcctggccaacatggtgaaacctgtctaaacctactaaaaatacacaaattagccaggcatagtggcacgctcctgtaatcccagctactcctgagcctgaaccacaacaattgcttgaaccctggaggcagaggttgcactgagccaagatgacaccactgcactccagcctgggtgacagagtgagactcagtctcaaaaacaaaaaaacaaaaaaacaagtggattaggcaaaggaatggctaaatttttcattaaatcgaagacacagcattataacaaaaaaaaagtgctgacttagctttggaatcatgttggaagccaaaagaatgagggtcgtgataactcagtataccactggaggctatttgagtaagcagcaaaactgtttctcataaatgcagaatgttggcaaactgacaaactgcatttgccacccagaaggaaagctgagggcagtcacgccccaagtgccgtgtttcttgtgattaggcacatctgaagcctgttaataataatatgaacctgtgatcaattaagcagctgaccaatcgttacctcctcctccctgcttttgctaaccaataaatgggaagggctgtggaagctcgggagctagctgcctttgctcactagaagccgggagctctcttcttcctcggttccccttcctttaaaacagtttcttttgcttcaagttttcatttctacgttcgtcctccttggttcagtcttgtaatgacgctctcaagcagtaacagtagtaattgctgtgatgacggtctcaagtagtaaccatagcagtcagccacagaatcatttttgcttttcagagtctagggaatgatttctaagctcttgcaacacacattattaactttattttcttcaccactctttctacccaagtgttgtgaattagagtttctcaaactttcttggttttggtgcccttactctcttgataattttttttcctatgataaagtccaatataaaatagaaggtcaggcatggtgggtcatgcctgtaatcgcagcactttgggaggctaaggcaggaggatcactggaggccaagagttcaagaccagcctgggcaacacagtgagaccctgtctctacaaaaaattttaaaaattgggccaggcgcagtggctcatgcctgtaatcttagcactttgggaggctgaggtgggtggatcatgaggtcaggtgatcgagaccatcctggctaacacggtgaaaccctgtctctactaaaaacacaaaaaattagctgggcgtggtggtgggcacctgtagtcccagctacttaggaggctgaggcaggagaatggcgtgaaccccggagccagagcttgcagtgagctgagattgcgccactgcactccagcctgggtgacagagtgaaactccatctcaaaaaaaaaaaaaaaaaaaaaaaaattagccagatgtggtggcatgcacctctggtcctagctactcagcagactaaggtgggaagattgcttgagcccaagaatttgaggccagcctggacaatatagggagaccccatctctacagaaaaagaaaaaaaggtaggcatagtgatgggcacatgtagttccacctactgaggaggctgaggtgggaagatcacttgagcccaggagttcaaggctgcagtgagctatgatcacacccactgcactccagcctgggcaacagagtgagaccctattttttaaaagataaataataatagaaaataagtttaattataacttttatgtatgtatataatatgctaatttataaagtgtatataagtatactaatatataatataaatgtatataatatgtatatattatatatacatgtatgtgtctatatataatgtatgaatgtatatataactatatattatatataaatatgaattaatgtcaccatcaggttattgttattgatatatttcacccaaattgttcagattttcccattattacttgtattttacttgtatttcacccacacagtttgcggggcccagttccaaataaaaatgcagggccccttgttaaaacattgttgacaatttcaagtcagagacaggacaacatgaagacaggcataggtcctttcgaaatgcagtgcctgtgtgaccacaggggcacatgccctgcatttatgtcctaaccacttagcttctctcggcactgtacagcttttcaagtcttggaatcaggttagacacaactttcctcatttcctaatccacagcaattttttcattagtgcctgctttttatcacaaccatccctgaatatgcagctttgcaaagatgtggcatcactgaaacgaatgcaggactctcgtgtcgtaactgtgaccggcctccacccagtagttcgtgtggtgtcagatgtcactgttatctttgaaatgtcaaaatatctacagcatctttgccagttcactgaagcgcttcagtgtgcagtttgggaatcacagctataaggcacagattaatctaaatttgagatttttgatatacttttttttttttttttgagatagagtctcgctctcttgcccaggctggaatgtagtggtgtgatctcaagctcactgcagcctctgcctcccaggttcaagcagttctcctgtttcattctcctgagtagctggaactacaggcacgcaccaccatgcccagctattttttttttttatttttagtagagatggagtttcaccatgttggccaggctggtctcaaactcccgatgtcaggtgatccgcccgcctcggcctcccacagtgctgggattacaggcgtgagccactgcgcccagtcactataccattttatatcaggggcttgaacatccgtggattttggtatctgtgagaggccctggaaccaatccttcgtggatactgagggatggctgtattgtttatagtagtaaaaagctagaaatagcctaaatgtgaaaagaatcagatttaaaattttataatccacaaaatctccattttgtttaaaatgtgtgtttatagatatctgcctacctacctacctatctcactttccagaaagaaatatatatagtatatacattttcttctttatgctttttttttttttttaatagttggagtcttgctatgttgccgaggctggccatgaacttctgggctcaagtgatcctcccatctcaggttcacaagtagccgggaccacaggcatgtgccacaacacctggattatgcttctttttttttttttttttgagtattttttacacttttgataatgatcaaatataaaagatcttcttgacatcttcatagttttgacttttgcagtaatcctgaaagctggtgacattaagtaacttacagttgataatttttctttttctttttaagccatagggtcttgctctgttgcccaggctggagttcaatggtgtgatcacagctcactgttaccttgaacacctgaggtcaagcgatcctgccgcctcaagcctcttgagtaggtcagactacaggcacatgccaccacaccctactttttgtagtgatggggtctcactgcatttcccaggctggtcttgaactcatgagctgaagtgatcctcctgcctcagcctcccaaagtgctgggattataggcatgagccaccatgcctggcaagtttatagtttttctgagacacaaatatgaaccacattacaagatgatatcctctttcctgtggttttcaagagagtagagttggtgagatgcacctgtgtttcacaatagctcttttgttttctgctccctccactggaagaaaagttccacatgagaagtaaaacacttgtgtgtgtatttaaaaaatacccaccacccctgcatcccaaacacaaccctagggactagtgctcgtggcagaaattaaggcaatatggaggtctaaaagataatggtccttaatcagagggtttaagcattacagaaggaattctatgttaactagaaggtataagcattacagaaggaattctgtgttatagtagcattctagaatttgggaattcataaaggcctctgcatgtagcccttttaaaagccaaagttcttcagaattattttcagtactgaaataatatagaaatgcctacaacattaccttgagttttttctccttgtctaaatgtgtatgataatccattgtttaatttgcatgattgagaaggtgaggtgttttgaatggctgaaatttccaagtgtctagattcttctgttttaattctgaagaattaaaaaaacactttgatgaaattattttaaattatatgcttctcttctttaacagactgtgatgcgtgttagagatttgggagtattgattaattacaattcttcctcatccttgtgcatttcaaatcatttctgaaatagattcatgaatcattcagagggatatcaaaatatgtacttttgaagagctgacatagttggattagagaacacagtctcaatgggcagccctattcaggctttctaattcttgctccgaaagctagaccttggggtgacttctctgagattctcccacatgcactggggccagtgttcatcctgtgggcggcagagccagagggagaagcctcaggtatcctcttgccatggaaggactgaagcagggagtagacagagagctggaagtgttactggattcctgggcgctccagggagctcatggttcctttaggaggcacgaaaagaaagggaatgtggctgggcttggtggcttgcacctgtaatcccagcacttttgggagactgaggcaggcagatcacgaggtcaggagatcaagaccatcctggctaacacggtgaaaccctgtctctgctaaaaatacaaaaaattaggcgtggtggcgcgtgcctgtagtcccagctactcgggaggctgaggcaggagaatcgcttgaacccaggaagcggaggttgcagtgagccgagatcgcgccgctgtactccagcctgggtgacagagtgagactccatctcaataataaaaaaaaaaaaaggaatgaagattttctcttatttcaacttttcttgatattttgggctttcactctgaatattaactgttgtgctggcacattgttctcttaggagacattgtgttaggtcatgttgtttgccctgtatcagaaagctccagattgctgagcttttaaaatactctttcttatttcctactgttttctagctgttatatctgactgttgttgccgactctgctttgagccctcagtggcttctagtggacagtttcccataaacaaggcacaagtttgtccgaaaaaacaggtcagattagctcagttttacacacaaaactcagtggacgctgacgtgagattgtatccacgcactgacactttgccagcatacggcaaacttctcagagggccactagccccatcaacccacaggtgccatttatatttctgaaatcaaagctgtgttccaaataataaagtttacagcgaaattccaacaactagctttgagtttgttcaaaattcattaattcaaaaaacactttattgaatacttgtacagaaccaagcaccatgctaggtacagtggatagagagacagagacgtgaccgcatttcttgtggaatgggcgcctgatgcaggagacacagaagtgaatgcagagcgatgctgccctgccgtgggtattcagaaggcactgggcacagctcatgtcccctgtaaaatgcttacctgaactcagaggtcctggggtcaggacacaatcacttgcccatgttttgtgggccccagctgtctgcagttcttgcagttctgtagcgtttgtgcccagagctaaagtcccactggactcggtgttattatgtatgggagcacatggaagcggcctcttctctagaccagcgagattaggaaaggcttcccagaggaggggacacctgagccaaattctgcagggtgacaggagtagccagcagagggatgtggacaggggagcacgcggagcatatgcctctattccaggcagagagcacatcatgtccaaaggcccaaatttaagacatagattgggctgtggtttaagttcattttggtgaagtgtgggtgaaaaggttaatggcgctagatccccaagtgggagtcagattctgtaaggccttgtgaagagtttggactccatccagagtccacttgcgtttggatgtgtcagtcatgggggtgacctagtttgtgatacgagaaaataaaaaggtggctgtgtggagactgtattatggggataagactggaaaaaagaatacctgcctggagggaaatcactgaagctctctggtgtttgtgccttggtgcccaagctggttgtacctccctgactgccggagatgaccagcaccgaaaccgactgtcctgtaggatcccgagtgatcagtgtcacttgaggatggggtgctattccgtgttctgtaatgccttcctttctgtgaggccagcaggaactgtggttcgtttcagatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttaggtaagaaaggaacaggaccctttgacaagaattgagtccctttgcccagggggtgggtcccctaattgggtcatctgggctctgcccttataattgacagcccagtggcccaaggacctttagacagatcttgaatgaggcaagaccagagagggagttgcacttcttgaagctggtaatatgagaatcacctgtagtaattgctattgatgaatgaagtaggaaacaaaagcctttgccaggatgaaatcacagccgactaaaggagatactaatattatttgtaagaggttgggttaggatccagtagcggaacaaggaaaagatgacagtgaggagtcaaatacttccttctgtcggtttttattgttttcagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggtaagtgttctacaaaattctataacttattgggaaaggatcactaattgctgattccttgttaactcatgtccactataaagtgcttacctgaattcatacctcctagggtcaggacaccatcatctgtccatgttttgtgggccccagctgcctgcagttcttacagttctgcaacatttgtgcccagagctaaagtcccactggacttggtgttatgtaggtccctggtcacacagcctgccactgcttggttaggcacccacagcacagaagaaagaaaacaggccatggccattggagtttctctttttaaaatagagacgggttcctgttccattgcccaggctggagtgcagtggtgtgatcatggcccactgcagcctcaaactcctgggctcaggtgattctcttgtctcagcctcccgagtagctaggactacaggcatgtgccaccacacccggctaatctttttattatttgtagagatggggcctcactatgttgcccaggctggtattgaactcttgggctcaagcagttcttctacctggcctcacaaagtgctgggattacaggcatgagccaccatgctcggccagccactggagtttcattaaaacgtcctctcttttgctttttgtttcatttctttgtttattccttttttgggtgagtttccttaagttacatttcctgggcctaaagcatttggccattatttaactttttttttttttttttttttttgagacagagtctggctctattgcccaggctggagtgcagtggcacggtctcggctcactgcaacctcctcctcccaggttcaagccattttcctgcttcagcctcccgaatagctgggactacaggcatgcaccaccacgcctggctaattttttgtatttttagtagagacagggtttcaccatgtcggccaggctgggattacagcccaaagtgctgggataacaggcatgagccaccgtaccccacctattttaaaaaatttaaaattattttttaaattgcaaaattagtgaaagtttattatggaaattttagaaaatacaaaaatgtacaaagagaattaaaaattatctacctaaaattccactctgcagagctaatacctgcttacctttagagcggatcctgctagtatttttcctatgaatttaattactaccatttattgtgcatttagtatgcatatgctaagaactatgtatcatttaatccccataaaagctatgaaattggccgggcgcagtggctcacgcctgtaatcccagcactttgggaggctgaggcgggcggatcacaaggtcagaagatcgagaccatcctggctaacactgtgaaaccctgtccctactaaagatacaaaaaattagccgggcttggtggcgggcgcctgtagtcccagctactcaggaggctgaggcaggagaatggcgtgaacccgggaggcggagcttgcagtgagtcgagatcatgccactgcactccaacctgggcaacagcaagactctgtctcaaaaaaaaaaaaaaagaaattaatattatgcccatttacagattaaaaaaattaaagatctcagctgagtgtggtggcttatgcttgtaatcccagcactttgggaggctgaggcaggaggatcccttgagctcaggagttcagcaccagcttgggcaacatagggagaccctgtcttttttttttttttttttgagacggagtctcgctctgtcgcccaggctggagtgcagtggcgtgatctcggctcactgcaacctccacctcccaggttcatgccattctcctgcctcagcctcccaagtagctggggctacaggtgcccactaccacgcctggctaatttttttgtatttttagtagaaacggggtttcaccgtgttagccacgatggtcttgatctcctgacctcgtgatccgcccaagaccctgtcttaaaataaaaaaattaaagatcagcgaggaagtttattcaaggttacactgccaggaaggcagggcacaacagagatttgaaccaagatctgattctaaagcctacccttaagtattacactatgtgcgtgcatattttggttaacaattgtgatcctattgtgcataatttgtgcataattttgtaacttttttttttttaatggagtctcactctgtcatccaggctggagtgcagtggcatgatctcggctcagtaaaacctccacctcccaggttcaagcgattctcctgcctcagcttcctgagtagctgggactacaggcgcacaccaccgtgcctggctaatttttgtgtttttagtagagacggggtttcaccacgttggccaagctggtctcgaactcctgacctccagtgatccgcctgcctcagcctcccaaagtgctgggattataggtgtgagccactgtgcctggccgtaacttgatttttctttctacctaacaatataccgagaacattttcttatgttatctgatattcttatataatatgatatttaccggccgatgagtattttatctacagacaaaccatagtttatttacccattattcaggcaaccattgttagtcaattgtgccatttccaattttcattgttttaaataatatggtaaatagtcacataaatgtttttatacatctggttatttttctgacctgtatttctataagtagaatttctggggtcaaagggcatgcacatttgtaaggctaatcaagaaatgtagaaatgaggctgggcgtggtggctcatgcctgtaatcccagcactttgggaggctgaggtgggtggatcacctgaggtgaggagttcgagaccggcctggccaacgtggtgaaaccgcctctctactaaaaatacaaaaaaattaaccgggcgtggtggtgggcgcctgtaattccatcaactcacgaggctgaagcgggagacttgcttgaacctgggaggcagaggttgcagtgagctgagatcacgccactgcactccagcctgggcgacagagcaagactccttctcaaaaaaaaaaaaaaaaaaaaaagtagaaatgagggtataagggtataattaaaattgattttaaaaagccacacaaacagtaataacattgtctctctcctcaatttttttcttcaggcccaatatgtattgatttctcctgaagtaagtatcccttgaaagactgaagaaagaaaaattaccaaaacaatgccccttggtttattttaaacggataaagtattacactatgttcttcaaagcccattaacagacggcatgttttacaggccagctcaaggtttgggagctccctcatcaccgtgaggtccaaggcaaaggtgagcccaaggactgaacttcattgatgtttatgttagtactacgggtgggatttggtggtctcacttgttaggtttatttcagattttatttttatttgaaaaggagaggaacacacagaaagtaacattcacatataatctcatcacttccttggtggaaagtttccctttttactcttcctattttatcctctacagcaggggttggggccaagtcgtctgccacctaattttgtaaagccatgaactaaaaaagtcagctcatgttgagatggttgaaaagaaatcaaaacagaatgttttgtaacatatgaagtttaaacggcagtgcagtttcagcgcccacacagctgtagtggaacatagccgggctcgtctgctgtggactgcgcgtggctgccgtcgcgctgccgtggcagaactgactggttgctttggagactgatgccccacaaagcctaagtattattatctgcctgttctccaaaattgtttgctggcccttgccttagaaaataaccattattagtattttgctattttcttccagactttcagagttttttctttctttattattttttatacagaaccttgctctgtcgcccatgctggagtgcagtggtgcaaatttggctcaccgcaacctccacctcccaggttcaagtgattttcctgcctcagcctcccaagtagctgggattacaggtgcccaccaccaggcccagctattttttcaaaaactttttgtagacatggggttttgccacgttgtcaaggctggtctcaaactcctggcctcaaatgatctgcctgcctctgccttccaaagtgctgggattataagcatgcaccactgcacccggcccagagtttttctgtttttctatggcttcagagatacacacacacaccttttttttttttttttttttttaagacagagtctggctcttgtcacctaggccggagtgcaatggtgtggtcttggctcactgcaacctctgtctcctggactcaagtgatcctccaacctcagcctcctgagtagctgagaccacaggtgtgtgacaccattccatgctagtttttgtatttttaggagacaagagtttcaccatgttgcccaggctggtcttgaactcctgggctcaagagatccacccaccttggccccccattttttttggctattacagacaaggccatagtgagcattcttgtacgtatgtgtagctttttataattgagcaagtatccccacaggtgagaatcttaaaagtaggattgctagatctaaaagtgtacacagtttaaatttcgatatggcagattaaaaagtttaaccttggctgggtgcggtgggtcacacctgtaatcccagcactttgagaagccgaggtcggtggatcgcctgaggtcaggagttcaagaccagcctggtcaacatggtgaaaccccggctctactaaaaatacaaaaaatagcccggcgtggtggtgcatgcctatagtctcagctattcgggagactgaggcaggagaatcgcttgaacctgggaggtggaggttgccgtgagcctagatggtgccactgtactccagcctgggtgatggagcaagactctgtctcaaaaaaaaaaaaaaaaagtttaaccttaaaatatacctgtaaaccactgattgcattcatccactgtataggctataagaaataaaaacagagagggcagagtccctgttcttgaaaataagattcatatacatggaaagtcaaataaaatgcaaattagtataggattaaatgctaatgagtagtctgaagaataagtctttacagtgggttgaagggctgcagaagccttcatagatttatatatataaccaggtctgtaagacttgttaagtgctgtggaccaggttcctgtggaccagggtggaaggtgggaggaggaagaggattaggaaaaattgtggtgaaactgccctctagtggccagtaatttaagtgacccatttacaggcaggtctaaaaatgtaggattaaccacataacaaaaatatggttattaactttatgggaagattctcggaaggtctgatcacagggatcctttatatgacaagcttggcttatatctaaaattttatttgtttcaaaaattaggcattgtcaagaacccatgtattatataaaactatacatatatcaactatagcttacatcagttgagagtagtggtatatataatctaaaagtaacttatattttattcctttttgtaaaacactgcaaatgtaccttcctaattattgtttacctgggttagtgttaaaattacttcacttttccagaacatacctgagcttgggggcattgaacgctctgggtgtaaagataaatcagatgttatgtttcaaaaatgggtattgacaatcagaggatgatcagagtggcctttttctgagatttgggtacaagttatgttctgaagattccttcctttctgtggcataagagcattcagtaatgaaattagtcgtaacaaactagaattaggatccggcgtctacttaagtagtgctctcactgtctctgtatttcagaaacttctcatggggctgccttccatcagctcaggagcctcagcagagcagtaacttagtgtatagtgagcagtgttgtatcaagcacctgtgagatagacaaagaaacctgagacatggtcccagccccaggtgcttgtagtctaggtgggaaaatacagcaggcccacaagaccatccaggttggtgtatgatgaccaagagccaaacgaggtcagacagcaactgcagcagaagtctttgctggtggagtcagggaagggcctgcagagatcatgggcccggagctgcatctggaaagatgactagactctgacaaaacagagagaagccgaaggccaggcaaatttagtaaatgagtaattccataaattgggaaagagagggagaataaagtaccatttgatgctgttttcttaagtgtagattttccctattaattgacactgggtattaagggataagataagcacagggctaagcatagtgtctgacccatgatacaacctcaacaaattttagctattattattatttctagatttcatcagtagttttcaaaattaaataagaaactgtcatatcctgctctgaccaaaatactgtcagccagtttgatcacccgtacctcatgtgccagctttggttcagaataacttttgtcagtttccacaaatcaaatccgacctcggagtatgaagatttgccaccactgaaaatatttaaagaccaggcatggtggctcacatctgtaatttcagcactttgggaagccgaggcgggtggatcacttgaggtcgggagttcgagaccagcctggccaacatggtgagagcttgtctctactaaaaatacaaaaattagccagatgtggtggcacatgcctgtaatccccgctactcgggaggctgagacatgagaatcacttgaaactaggaagcagaagttgcagtgagctgagatcacatcactgcactccagcctgggtgacagggcaagactctgtttcaaaaaagaagaaaatgttttaaaaacttgcagcaggttttgaaggcaattctgaaagatgggtcctaaaatgttttaagcagcagggtaggtgggaggtacgctaaacacattgacaaagccagcttctaggggaagtccttactattcaagatatgttttccacattgtaccagaactaagcatgcactgccctacttctcctttatgatttatgtgccagaatagggattggggtgagcatccttagctgcggttttcagaacttatagatgtgagaaagcggtctgtaaacaaagggaaagtggcatttgagttcaagccaggggatctggccagtgtcttattcatctttatatttctagagcatagcatgatgcctggactaccataggaactcaatagatgttatgaatgagccatgaattctgtcttgtgtcccttacagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatgtgaaatagcagacattctgcttactcatgtctccttccacagtttacttcctcgctccctttgcatctaaacctttcttctttcccaacttattgcctgtagtcagacctgctgtacaacctatttcctcttcctcttgaatgtctttccagtggctggaaaggtccctctgtggttatctgttagaacagtctctgtacacaattcctcctaaaaacatccttttttaaaaaaagaattgttcagccataaagaaagaacaagatcatgccctttgcagggacatggatggagctggaggccattatccttcataaactattgcaggaacagaaaaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattggcccatgccaatcaaagtataatagaaagcatagtatacagaaaaaaaaaaaaaaagaaactgagggaggaaaaatagtacagagtaaagcatgggggtgagggataacctcacattccaaatcacttgtgacttagtcctttttaacttttattttaggttcagtggtacatgtgaaggttttatcttttctgttcctcccaccttccccactcaagtagaccccagtgtgtgttgttttgtgttcataagttcttttaacttagcacccacttgtgagaacatgctatacttggtatttggttttctgttcctggtcgtgtgttagtttgctaaggatgatagtccttttttttttttttttttttttgagacggagtcttgctctgttgcccaggctggagtgcagtgatgtgatctcagctcactgcaacctccgcctcccaggttcaagtgattctcctgtctcagcctcccaggcagctgggactacaggtgcacaatactacgcccggctaatttttgtatttttagtagagacagggtttcaccatgttggccaggctggtctcgaactcctgatctcaggtgatccacccaccttgacctcccaaagtgctgggattacatgtgtaagccacaggacctggccgataatcctttcttaatgaggattaataccttttcaatgtttatatagtgaaggacaaatataaaaaccaagactatcacccttctgtgccctccaatacttttgtagagttggctgttctaacacctaaagagcctagcgacactgctagttttaagccatctcatgagggacctttgtcgcattaggttacaacttgtgccaaaagaactagagggaaaagatgcggcctgagccacacgctactgtaagggccggagaggaaagcaggccttggcctcgcttgttcctgggctgtttttcgtaggatggatttcatttgtcagtcctgcagcgtggcacacttaagggaatggaatgtatcatagggtttcagtttcagtaaacattagcgggcattatctgtaaacagtaactagtttattttgtgttaaattgggaagaacctctttcttctgccacgggtgagatgatactaaaagcaggagaaaataacaaatgagaagagcccttctcttctcagcttctc

SEQ ID NO: 16065 - DNA, 212139 bp, Human
atagagctggaaagtttttttttcctttctggtcagaaatcagggtagctgtaaaaatgttggtggggtggggtcaattccatagtctatgacctgattcggtaggcgactgaaaaacattgtacaactcttaaaaaaagggaggaagaactcacacttaaccaagcaaagcaaggacaccgtgttgacatacacaagtttcggttaacatggtatcaaggaaagcgaggactgcctgtacttaaaatgatcattaagactaatgattctagttttggcattgaggatgaatgcagatatatagacataatgtatagcaaagaatatttacagtcacatttcatggaccaataaataacgcatttacttctcaaaatgcccaagaaaatgtgggagagaaaatgttcatttatattcaagattaaactttctaactttaaatcatcagacttcagctgtaaatttatttcagttgaaaggtttgaagacattattaatgaatattctaaaattccggaaggtgtttaaaagataattttaacctaataaaaaaatcctgccatagaagtgacaaaaattataagcataaatttattgagcacctactatgtgtcattgtgctaggtgatgtactacgttatttccaatactccggtcacgtttcagttttctcaatttctctatcaataactgctacattgttaatttataactatattacttgaaatacagctcagcttatttattccataaagttggtcccaaagacgtttccttattcgaaggaggtgggaagcaggaaggaaacctaaatctaaattctacttaatactgaagacgactttcttgatatttgtggttatctgtatggtcttttcagaaatcccaaaacttgtaccaagtcaaggataaaataagataaaatcagcaatctatcaggttcagagatcacatctgtcagccgatgcttcttgccttaaggtcctgcacggcgatgaccgctcatttaggaaggaattcatggcctgtggataccttagctctgagtcctgccacctaggatcccacggttctacgcgaggaagagggcggggagcgcggaccgggtgtgggaggccgaggtgacagcaggtgagggccgggtgcggatggggaagtgagacaagcaccgtgtgggtattactcattccgctctactaaggaggctgctggcaagcggaacttctagcctctctttcaatccagctgaagttcaatctcattgaagtcacttcccatcccggttcgcttggggggaaaccaggcgtccctggaagggaagggaagggagtccgggctgcgcgggtcaggtagcctctctccggtcgccgcgtgtcctcgccgtccccaaacctgcccttcccctcatcaagggaactccccggggagtccagaccgcgatccctttccttggccccggggtgcggggggcggacacgcgaggcgtgggactgatggtagccctgcctccaggaagcaggcaggcggggacctctgggcgctcggaggggcagctccgagggcacagggtacagggagaatcagccagatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcaggcgaacccgcggcgcaataacggtgagtggcggaggggaccggggagcggcggagtcagggggagctgggcagccggggcgcccccgggggtgaggggggcgagccgggctgggggcagccggggcagggacggcaaagtggagtgggaaagtagaaagtagtgctctctgcccccctccgctgccgccgctgccggagccgcgccgcggccgctcgctctccctgaaccgttatgtctcttacctggtctctctccgcctagcggctcccgccgcccctgccgcctccctggaccgttagccggcgccgacgccgccgcatccccggcgcagggcgggcggccgggacgcactggccacttttctggtcccgggtggagcggctgttgcttctttccgcacttttccccactcttgtgcccttcggcgcctccctctccccctcctcctggccccctcagcgcgattctccctcagcgcccaggcccccgggagccgcggaacaaacttgtgcccggcgctgaccgtgcaaagtggcttccgcgcgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaaggtacccacttaacgccgccgggagccgcgcggatgggggcgagctgggcggcgggtgtgtttgcggagttgttacctgggcttagagaccgggaagcaccacagacagatccccctcccggggcagacgaggtctctgcgccgggatgggccggtgtgcgtgcgcctcgcgcttttctctttcggtttttggggaagttgttacctgggccggacgcacggagcgctgaagccggataatggggcttggatggcgctctgggtctcgggtggaaggagggtgggggagggggcggacggaccgacggacgcgcggggctgctacttgcaccgcagctgcagtgtttattgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttgtaagttgattgtatttctggttatctcggggcgatgctatgctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctttctccctcccctctgggatgcgaaacgcgaggttttgtaacctttcctggcaattttagattttgtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaaggtaagttggttcggaaagagctgttcgctttttaccttatttaaaatgttgatcgccagagaaaggggcttttcttgttgctgacgacatgtgtgtgacatgtgagtctgaaccacccagcgtctgtgcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcaggtagaaaaaaagatggtgtttagttttctcctgcatgtatgtcagccccctcctgtctgctgctttcattctcaagggagggatttatttaccacgcttgctgtcagtgtttttcctttgtgtttaatattagaaaaacagatttgcgtctgtttagcacaaaacgtcttgtctgcagtatgcattactctcagaaaacaaaaggtgtttaagatagcactgtactactacaggtatcttccattttcatcacttttggctctgtccttgtatttctttttgttctcaaatgcatttcatccattgctggtgattatagccatgctatttgatttagccttatattttgcaaattaaaaatgaagttatattccattgtgttgtgaaacctcagtatatgtgctggttaatatttcttagcagtgcagtcatatttaagttgcagatgtttattggagaaaattgcctggcaaaacgttaactctcaaatctttttaatgaagaaatatgtgatatatacagtggaagattgtcgtagagatagtttatgttgttatatatgtaaataatgttttattcattttgaaataagatacgtggattttgctgctaagccttctgtaaaatattttaatttcctttctggaatatgtctgaaggtaggatattaaaaggagtatcaggtaatgtaactgacaggggtaaaccaattgagtaaggtttggccaaagcatcaaaccttgtgtggtaacttaatgatgttagtcatccgtaaaggagtgacattagaattgcttgaattagtttttaccatttataatttcatgctttgttgcattttaaaaaatctgtctttttctttttctgctttcttctatgtggttttcttcttgttctaccttttttttttttgagagagagatgtactctactaatgaccacatgctgattaattctctttagatggaatagaaggtacatatccttctgtcatcagcaccatttccccttgctgtcattggaaaccaccagtagaggatgctaacaaaaatgattattggtgtggtagcatcataagtctctctatcgactgtgctgattgggaccttcagtataattctgagtcttattgttacttaaaactagccttggttaaattaggcataagcattttctagtttgccgaaactagaaagaagcaggactgttttaacttgaataattttataaatttgagttatttaagtctctaattgagattgctgttaattcattcttgttttagagcagttgtattactccttattttaaaaagattttgttttatgttcttaggtttggagaagaatatgtaataattgacccatatttatgttgcatatttagaatactttttaatcacccctttttaaaattcatagtaagatcccttaaaatatatattttagatgttaaaatacatctaaaatggtcaaagtttaagagtagcaaggaaaattacaattgattgataatactgtgtaattatttttatataacttatgtagacttagactatggatgggttggcagagagctactaacggaggtggtaactagcagtcacttagatgttagtgatttttagattttatcttttccttccccttcaggtcttttcctactggtagccctcccccacctttttagttaagaatcagtgagtgcatacgttttaaatttgtcagttgtaattaaggaatataagtttgctttgagatcttatatgcagtaaaactctgtagttcgtacgttgctgtatgcttgtatttaaataattcctttcaagaaactatataaattgcatataaataattgcatgagactgtatttagttatgtcttttcattttgtgttcttataggtatattaatataactgtaaattttaagcctctcattaggtagaacattagaagtatttatttccttaattatttttagtggtgtttttataaatgcatcaatatcagtaccgtaatggaatagccatactgtttatcttgaactaagtaggtattgaattgccaggtaagcctgtgttaatttcttattttaggatgtcatggttcttcgtgtgtgtgtgtgtgtgtgtgtgtgtgtgtaaatagtttttcatttcctgacaggtatttcttgaatttagtattctaattcctgagggctcagtagtgaataggtgtgattcacttaaatgtttatgaactcagaaactttgccacaaagtcacgagatacattgtagcatggagcaaaacttaaagtatcttataaattgaaaatattaatcgtttatgaagatgaccctgatataaaaagcatgtgaaatatttgtttaatactgttttcttcctttctctagtctctagtatgtttgaaatggcatacctcctatgtagtagcttttgaagcatgtgctgagaaacttctgttaaattgagaatgatatttttaaaataagagcataatgatttctcatagttgtgtttttcttttgctttatcctcttgtggatttacctgtataaatcacttttaagcatgtggttagagccagatgtaaacacagatgcagtatcatgtggaattatattgttagctactcttaactacctgtattgaattgcagcagaggaggagaaaaatcatgcagatgttggaagaagatatgcattagtgtgcaagagtacagcgagaggttagaaaacttgaagctgtagaaataggattgaaaaaggtttctttgcagtacagtcactaatttatgtggaaatgcatgctctttatttctaattgagatataagctaaaataaaagtccattgttgaaagaaaactcaaaaaattttaaactagaaaaagtgtcctgattaggaaatatgataaaatgattttttaaactactttttaaagggtagatgttgtacatattactggctaaataatcattcaactagatatgaactaaaagtagtaagcaagtagaaatatatgtagtagagaaagttttgtagcaaccctagttaaaattaaatttgatctattatgtaggcattgccatataaactaatcattcttttgcatggggcagtgttttgagtattatgtcactaaaggaaacatctttaggacattagttttactaaataaaaatttcaatatgttatgagcatgtctggattttagccttgatggaggtgggttacgctgttaacttaaaactgggttgcttaaaaagatggcaatataatacagtacttaagtagcaaaatgctctctaataagtaaaatttgctttatgattgttttcagagaaaacaacttaatttttagaacttcattaattttgttaaagcatatttttggattatataatatggatgtagataaatggaaagattatgaaaggaaaagcaaaaaattgaattcaagtgtctatttgtattatagctgtgaaactttaagcttttttcattctctacaaagttacttttctctttcttcaaacagctccctgttgtttaatacacgttccctctatacatagggattgcatttatctgtccatatgcacatttctcctcctaatcaacattatgtatttattgagacttggtacatggaggttgaggtatgaactatgtttgtagaaaaccttacagtatggcaacctgggaaaaccttcatctcttttgcagtaacaactacatctgtgctgaaattattcataacagatgttttgtgatctcttaattccctccctctcccttcccctcccccattcagatttaaaattaaatgtgaatggaagataaatttataaattatgttaatttctttttattgttttattctatattgaaagtcctctgttttctctttttaaaatattctaattttaaatgtttaagatattttaagtactctgatttcaattatcttttaataaaatatgacaccattatttatatatctgttactattcatgctcacggcctaaaatatattctgatttcccttactcttaaggtctttgtattcatttaatccacaattctagcagagtgtttggttttgggtttttttttttttttttaagtagatagtgctgagtgtaactagtttgctgatgaaaaaaactcattttcttggaatcatatatttttaatatggaagattcatcttttccaaaataactttttatctgaaaactgacacagataagctgaaatttagggtctttaagtagaaactctagaagagactttaatgtgtgttttaagaaggggtaatgccaggcagatacagtgacatatggaataacatgtagtgaaatccttcaaggagtagattttctgaacctgggctcagggtaaccttgctctgccttgaatacttgaaaaggctgtcaaaatcactgtatctctttaacgttttctcctttctaccctaaagttaagttgctatttgctcctattgctacatcacttttctgaatctcttttgatacacttggcttttgctttatttgggagggagaaagtaaaggaaggaggaattggagtagacaaaaaataactttatatgaataaatattcattaagaaaatgaagtggaataattttggactggagagatttgggagaatcatccaaagccattttgcagtaaagcagacagtcaaagagataagatgactttgccaagtttatgttactagttagcttggactaggtcacagctttttgggttcctagttcggtattcttttcattaggtcatttgagcatatttatctaagacggtaacaagcaagaactagataccatgaattttcaaatttattatacttaaaaccaaaatgtgtagaatgcttcatcatctcaaaggcaagttctaatacatatgcatacatctgtcaaatttagtagttgatgtagttatatcacttaaaatatttcagatgcagagcattagtattatttagaggcatcctctcatttggattatacttttggtcactattcccaatttcagctcccattcactctatccttcctaccttggacccaatctaatatgttttttatatgctgttggttttgtagctagccttgtaaaattttgtacctcttttgtgtgttttgtatttacataagtgctataagtgctactttgctctatcatttactttctttttcttttcttttcttttttttttttttttttttttgagacagtttgacagtttgactcttgtcacccaggctggagtgtaaaggcgcgatatcagctcactgcaacctctgtctcccaggttcaagtgattctcccgcttcagcctcccaagtagctgggattacaggcacacaccgccatgcctggctgatttttgtatttttagtaaagatggggttttgccatgttagccaggctggtctcaaactcctgacctcagctgatccacctgcctcagcctcccaaagtgctgggattacaggtgtgagccactgcacctgacatataatttactttctttacttagcattgtttgatagctagatatgttgctatatgtacagctagttcattgcttttaaccttgcagtagttcatttatgtagtaagcacaaattacctatcaattcccctaatggcagattcccagattgactccaattcttagataccaataattctgtaataaacatcctcctacgtgttgctaatggctgtggaagagtttctcagcactaccatatctagggacatggtattgtccagacatagtattgctgagtataggtcaatcacatatttaataattactaaattctgtcagattattttaaaaacagcaacaccattttttacgctcaccaacaatgtaaaagaactattttctcacgtttttgccagccttcggtattgtacaacattctacattttgctaatttttcagttgctaaatataatctgatagttgctttaatttatgtttctctgtttattagggaggttgatcatttcttcatatccttgctagctgtttgggtttccctttccatatctggcctattcataccctttacccctctttttggatagatttccatttctcttgtgtatttaagatgataatccccaacgtttcagtcatttgactttggtacaggaatccttaattttaatgtcaaaattttgactttatgggtagtaagaagtccttcctaatctatagattataaagatattttcctggattttcttctattagtttcttagttgtattttttgtatttatatgtctaatgcatcaggagttcaccttttgaatacaccctttcttaagaggaacaagtatagcagttaagagtttgggttgatcctgtaacttactacctatcaccctggccaggttacttagtctttttatgcttgagtttctctgcatgtaaattggacatgacagtctaagaattgggaaagtttaaatgaagcatatgacgcattgtgcctaatacatgttttaagttttcaacacatgttcatttaaaattttacttatttattttaaatatatcttggatcagctgacaattttttatccttttgaccagtattaactccagctaatgtaactaccatctgaaagggggttgctgtaaaatttgtacattgtttgtgtaactttgacatttaacattgcttagttcagaccttggacaaagctgttaaatgatcaatagacactgaagcttcatcttaatgctacttttggtatgtctttcagctttaggaaggattccttggatctttttaagggccattatatgagagagaccttaccatatcacttttatgtataacattgacatgaacttcaaggataatgtcccattgttattctgttacataaatcaaagaactcaagtccaaggaataaaagctgtgcattctatatttgaatagtctaagcaacatggagtctgcaccttctcatatatccatttggctgggaatgtatttaagaagatggctgtcttactgtgttcctatggtatagatcaggactattctaagccaaaagttaaaaccataccctggtgtgtgtgtgtgtgtgtgcgtgtgaacttaattgaggtataatttatatacaataagatataccactatgcatgtacattttgatagagttttgacatacttgcatacatgtgtaactgctaccacagtcaagatgtaatagaacattatttccatcatcctaaagagttcttgtgtacttaatctcagccaatcttccccacctattgccccctagcaatgatctgcttttggtcactagaggttagatttaatgtttctagagtttcatataaaccgaatcatgcagtatgtcctttctgtgcaccttcttttgcacaggatattatcaaaattaataagtatcagtagctcattccttttgtattgctgagtagtattccattgtatgaatgttatatcaccaaatacacaatttgtgtcgccattcacctgcagtggaactattaacttgggttgtttctggttctttgctctaatgaataaagctactgtgaacatttacataaaatttatatgcatatatatcttacatttttcttgagtcaatacttaagagtacagttatagtacaggtaactgtacttctaagtacatatagtaagtatatgtttaacttggtaagaagctgcaaaattgcaaactgcttgtaacaaacatttttacatttccaccagccatgtatgagagttctggttgttccacatccttgcaaacaattgtccatgtttttaattttaaccattctagtagatgagtggtagtatcattttggttttgattggatttcaccggtgactaatgatgtttgaagatcttttggtgtatgtattggccacttgtatattttcctttgtgaactgtctgttcaaataatttgtccatttttaattggattgtttgtctttttattattcagttgtaagagttctttgtatattctggaccaaaattttttgttggatacaagtattaaagatatttctctctttctgttggcttatcagttttcttaatggtaccattgaagtgccaaagctttaaattttgatggagtttaattcataattttattcatttaagctttgtgtcctttctgagaaatctttgcctattccagatcttcaggatttctcccatgtatttttagaagcttatagctttaccatttaggtctgtaatccatttcaggttaatgtttggtcttaactcaccagaatttggcataagaatttttatttgaaatttttaaaaatgtttctcagggcccaactaatacccaaagctcaggattatagaggaacacaagtcctacttccctggttttgaacatttttaactgagagtgagtacattgtgcctagttggggttttcaaggttcttcatgtccttgacacattttaattcactgaaatatactttattgaggatacagtttcagagaaagatgcctaaggagagtggccctagttaggggaatgcgagtgttgtcttcaaggtttcttatttcctacaaggttttaaggaatttagcactataccaattcattttcatgttccgtagcttttatctttagatggggagtttgtttaaacctaacatttatcttgagtttttaagggatgtagttttctccttgagataaatgcttgatcttactgatttttggctacatattttacctcctcactttgttatagctaaagaaaaagtttttagttacttttaactttgataagttgattacagatgggtttattatatttatttctttcatttcttagaaaatatagatgttacttattcctatgtaattcttattttaagatagttttttaacttttctgttttattttatcacctattcctattccttgaaaattcgttataagtaacctgtgccttatttttgtttttacagatctcgctttttaatactccttttagctctgtgtctgtcttgaacgttctgtatattaatgcataattccttctgagctggtatccttaggtgcatttatagaaaaagcattgaactgggaaggagtcttaaatttcattttcttttcttttttctttctttcttttttttttttttttttttttttttgagacggagtcttgctgtgttgcccaggctggaatgcagtggcatctcggttcactgcaacctccgcctcctgggttcaagtgattctcctgcctcaacctcctgagtagctgggattacaggcgcgtgccaccatgcccgactaattttttgtatttttagtagagatggggtttcaccgtgttagccaggatggtctccatctcctgacatcgtgatctgcctgcctcagcctcccaaagtgctgggattacaggcgtgagccaccacgcctggcccgaagtgttaaattctaatattgaatctgccattatttggcctctgaaattgagaaaataattccatttatctgggcctatgtttgttcatctgtgggatgaatatgatggattattgtatgcaaggtaatgagaccctgaagatgagagatgtagtaccttgccctaaggagattatagtgtggtagggaagaaaaatgaggaaagaaacctttagaatacagtttggtaactgatgtgatattctgtcttatatgcatagaggggatggtgcttaaaccaagtcttaaagtatgtgtgtgggttatcctagtaaaatatcctagtggaaaataatattccatacagggggaatattatgtgcaaaggcataacacacatgcacacacatattgtgggactcaagtcacgtttggtaaaactgtagggtgagcggaagaatggctagagatgaggctggagaattggatagtaagcaaatgaagaaaaaatgctttatattgctttcctgaatttagattttatcttggacatgatgggaaattaccacaggtcttgaagcaaagagtgacatgattacatttatatacagtaatttataatattatgtttctttatatactcagtgttaatatgattaaaaatttaagaatatatatgcttgctttactaaaagtgaaaaaagttgtaaaacctgatgtatcctgctttcctgagtttttgcttatctattctgataatactaatagatttgcatagtaattgcttcgaaatggtgctgccactaccacttctaccaccaccataaattagtagaagacttacgctactagaagcataagcagccttacgttatagtggctggtatctgtgcaccaagtttggctgtgcatttctagtccctgcactgttagggggaattgtatatttttttttccttttctcaaatcagtaaatcagtgcaaacaaatgtgttgtggatttacaaacctatggaataaaatgtttttacttctatcaattatggctctccaaagacataaaatactcttcattcactattactagttaattttctagattatttctggcatttattaatggttctgcatagagctccaccttgtgaacatgttattgtactttgatatcagttctgtgtcatagatatttaataaataaaataaaactttatttacctgaatgtttctcattcagaatagctgtaattcaggcctggtatatgtttttatttgaatagaaacagttcactgtttttttggaggttatgctgtatactacaagatagattaaaaccagtgcctttttttagaccagctgctgaggaaatacctttatcatgtttcaacctcttaagtttaataattctcatgtaaaaattagtgcttgatttatgcatcaattttctaaacatttcacatgtgatctactttgtatattcagggacttttgtgttctatgttattatatagcgtattttttaaccaaaactttaaaaattaacctcatttcattagtatttgtttatactttactataccttgtttacatgcttaacctgcctatgtattatctgtgacagtaatgaaactgaatggttataaaatgctatataattttatcaagttaagctgacttttttggtggggaacatcatcttcctcttgctaatagataaaggagttttactgtactaatttcaaaaatggtataaagcagtaaggcagatcttcacagcctattctttgacagtatattaagcatgtggagaggaaagcaaggtgttagctattttaaggtttcacagcaacactcccatcttgttcattttcacctgagttgtatagagcctgggaattgctatatatctttaatgtaaagtcagcagtgcaagtaacagtattggatcatacttccaccattacattctctgagtttctgatcaccacattctcacagataaggaaaatagttgtagatggatggtctgaaatgtaaaaaggataaagaacacaagaagtggtaaatatgtttagtttcagacagacattatataaaacttgggaggagggtaaaattattgattagctacgggtaggcttggtaagttttaacgcatgttaaaatttctaagataaggaataaaaatctagaaggtatgtgtaccttacaaactagtagagaagggaagtagaacaagaaacaatattcaatctgaaaaaaaggtaaagaagctgaagaaagaaaacatggaaaagagaagacaagtagcacaaaagtacatagcagcaataagtgcaaatatattagtaattacagtgcatatgagttgaaaaaatcctccacttaacagaaactggttattagatgggataaaataacaaaatatatttatatgctgtttacaagcaataccttaaaaagcatattctcgcttgaaagtaaaaaggatttaaaaagatattcctgacactactaaccaatagaaatgttgtatggctatatatatcatgtaaagttgactttgaggcagaaaacctgtccgagagagtgagggtcactcaatagttataaaaggaaggtataattttaaataagtgactacctgataatacactttcaaaatacattaagcagaaactaggactgcagaagaaataggtaaatttatcattattatagcttatttaaaataatctctgttaatgtgagaacaagcagaaaaaaattaagaaaaatatagatgattttaataacaggacttacaagcctgctgtaatggacacgtatggaacattgtattccacaactaaagtagaggaggaacacttagaaaaactgatcacattctggtcaaatacagccagctttaacaaatttcagtggattggcatcacattacactttctgtttacaattccattaacttaaatagaaattttgtgtgtgtgtgttttggaaattaacatgtttatttcaaaataacttgtggatcaaagaaaaacttgtaatgatagcagtaaattattgtacacgacaacttatgtatagctaaaatgggaatttatagattttaatgcttatattatgggactaaaggttgaggaataataaacatgcaattttaagaattagaaaaaaagcatactccccgattgaaataacaggggaataattaatgaactagagaaagtaaaagtaattcaaaaaggaaacaatgcaactaaaaatagattatttgagaagagtaacaaaattagcaaaccactggcaagattaataggtggggaaagaagtcataaagcagtatctggaatgaaaatgggaatgttactacaggtgtttcatgaatgatcaactttattttaatgcagttgaaagattaagtggaccaattcctaaaaaaaaatgtagctcatgctggcccaagaagtaatagaaaatggaatacccttaaaacaaaaaggaaaaatattcttacaaagaaaaaaataccaattctagacaggtttactggcaaattctacaaaacattcaaggaacaataattccagttgtacagagagtatttcatggtttggaaaaagaaatgactgtccccaacttttttttacgaagctctaagtataaaaaatgatgattgtctttaactcagacctatgtacaaaaattcatagattagatatcatcacatggtagtacccccttatccatctgtaggtggttacctatgctcaatcacagtccgaaaatattaaatggaaaattcaagaaataaaaattcatatgttttaaattgtacgcccaggatgtggatcctccctttgtccagcatatccacactgtatatgctacctgcccattagttaccattggtagccgtcttggtcatcagataataaaaaaaaacatagtatttatagggcttccatgctatccatggtttcaggcatcctcagggggtcttgaaacgtatgccctgttgataaaggggaattactgtacttgaccaataatgtgtaagaaagtaacccatcataaccaagttgggtttactctagaatttcaaagttggttttatattagaaagtcacttaatagaatttaccacatcatctgtttaaaggaaaagaatcatgtgagcatctcaatagatccatctgtgataaaactcttagcaagtcagtaaatgagaaggcccctttcttaacctgataaaggcatttttttccaaagaaaatttccagccctaccttctttccacttcatggtaaagtattgaaggcattggttccctttgatatcaaaggacaagtgtgcctgctaatgccacttttagtcaacattgtactagaagtatagctagtacagtaaacaaacaaagatacaatgattagaaagaaaaagctattattatttgcagattatatgattatctgtgtaacccagaaaaattcacagatgaattactcaaagtttaaatttggatgcagaattattatacaaattcaattatttttcagactttttgctggcatagaaatgcaattaagaggtagcattatatcatcataaaagtataaaacactgtgagtaaatctaacaacgtgctcaatatctttatggagaaattatgaaacattggcagacataaagatctaattaaatagcataatgtaccatgtttataaaaggagacttgaacattgtaatggtgccatttctccccaattttatctgtaagttctgtgccatctgatcaaaatattgacaggtttttgttgaatttgacacgctaatccaaaaacttacatggaagaactaagagataatagcaagatactcattcatgaaatggatctgtgatggcactgggattgccaatgagtgaaataggatgaccctttcaataattggggttgttggttaattaaatggaaaaaattggggttggactgctgcctcacactatttagagaaaccagtggaaggattatagatctaaatctgtaggtaaggtaaaggtataggtaaagtaaaatggtaacactttataaagatgataggctagaatatctctatgactttgagtaaagataaaaaggcataaaacacagagcaaaagattggcaaatatgactacatcaaaattaagaattttgtttcactaatagatactgtagagtgcctaatcccgtatttagcacatatcaaaatctaccacccagggaaataaagatgaacaatctgatagaaaactgggcttgaataggcacttcacaaaagaataaactcgtttggccaaggagtgtattataagatattcaacctcattaggaatcagggaaatgcaaattaaaaccacgttaagaaggcatttcatgtctcctagattctcaaaacttagaagccagctaatactgctgttggtatagacatggaacaactgaacacttaggcgttgcagatgctaatgtaagtaggtacattcactttgggaaataatttcacattattaaagttgaagatacacataacactatgacccagtattcctatgtcttagagaaatctctatacagacataccaggtaatgtatgtagttgtttatacagtactgatcacaataacaaaacaaaaaaataaataataggataagtaaattgtagtatatttatacaatggaatgcaacacaatactgaaaaatgaatgaattacacctgtgcttaacaacttggatcatcctaggaaaataatgttcgaacaaaacaaatcactgaagaatatagtgtgattccatttatatagaatcaaagaacacgcaaaattaagtaatatattgtttaaggataccaatacacataatacaagtctatgataaacataaaatttaggaatgagtgaatttggacacagagtagatatcacaggtcaggataatgtgtgtttaaaaaaaaacgatggtggaactcagatatttattgtattacttattataccttaaatttattttatagaattctttaatgtttgatattaataattactgatagtaatttatggctactgataatcaacatttaatctaaaatagtaactgaaaaaataaaagtgaatgatttttgggggaactcagtatttgccatgtatttcctatgtacgtatgtttaatttttgtgagttctcaaatgtaatcaatttcttttgagtatctttagtattttatactatctttgtatttaatatagcagataaagcttaataatttctttctgttttttttttttttttttttttgatggagtcttgctgtgtctcccaggctggagtgcaatggcgcaatctcggctcactgctgcctccgtctccccggtcaagcgattctcctgcctcagcctccccagtagctgggattacaggcacccaccaccacgctggctaatttgtgtatttttagtagagacagggtttcaccatcttggccaggcaggtcttgaactcctgaccctcatgatccacctgccttggcctcccatagtgttgggattacaggcatgagacaccgcgcccggcctaagcataataatttctaaccctggttgtgtgatactccaaaatgtattcatttatttttaggggtataggcatttttaattcttttatatttttgtagtcactaaatttacttggcttctacctttacatattttctgtttattgaccaccttttaggaagtttgagaaaggtattaccttattatatttttttctaacttaaaatatgtgtgttactattgcacttgtggatataacatttcattttagaatatttacattttattttgtttatcaaacaatagcatttttgtatcaggcactattctcaatatcgttaaaatattaatttatttagtattcattgcaaccctatgagaaagatcctgctatctttgataggtaaagggaaactgaggcacggaaagtgttgggtaaggtcacttagctagtaagtggagcctgtgttcaaacctaggcagtctggttccacagtctgtgcacttaaccactaagctgtaagagaccatatgaagtagatctctaagaggagtatgtcatctatttcaatgttctttaataaacagggtactatttttgagcggtgccagcatattgtcagattatgatgaaataattatattattccctttgtttgatctgagaatgtaaaaagcaatactggtaaattacacactgctggacattgcttagatttactcttcaatgaattttgtgtccgtacgttcatgagatgagaaaaatagataggcaaaagtacctgttagtctgattgcagatctacccgtaatgcacaaatggtgatagtgtactttcttcttccaaaggtgggttaatggagtcatgatttaaaataagagtttaacagtagcgtgtataaatttgatatttatacatcataaatgatgtataaatcatttatgggagagtgatatttgattcagggatgttgacatgatacctttgggaaattctcatagtaaaatagagttagactgtcaacagggaaaattctaagtaatttgtgaagaaactagtagtagtagtctaaagtgaggcaccaggcaaagagagaagaatcagacaaatcctttagagtaatagttctttacccattcagacccacactccatttagagcatttactgtagaagttcttgagagaagatctcatcctgtagccatatatgctcactatatatatagatataaaacatctctaagaatttcagcttctctttgtgctttttgttagctactttaaatagcttaactttcagtgacacatggttttaacaggcaaaacacatgactgttaatgatttttctttagagcagaaatggtttatatggcctaaattcacttttagagaatcttctgagagagagtatttcctgtctctttgcacatgtgtggcatattgtaaggacttatttacttttaaataaaaaggaaagctcttgcagtgaagtagacatttattttgttaagaacctatataaggccaggcgccgtggctcacatctgtagtcccagcactttgggaggctgaggtgggtggatcacaaggtcaggagttcgagaccagcctgaccaatgtggtgaaaccccttctctactaaaaatacaaaaaacttagccaggtgtggtggtgcacacctgtaatctcagctactcaggaggctgagacaggagaatcgcttgaaccggggaggcagaggttgcagtgaactgagattgcaccactcactccagcgacagagagagactctgtctcaaattaaaaaaaaaaaaaacctatataaaatagtttatagcagtttatagctgtgaccatcaagtcagataatttgggatgttcacagagagctctgggtgattatgacagtgtaccacccacatctcttatttgttttgcttcatttctctactagggagaggaggtcatataatatatggtatttttatgttattttagataaatccatatcaacacagcacaggagaacaaattatacccctggtagattttggggtataaacgtcatgaaatgtttctcagaaagtgagaaatatttcttgattgtatctttaaaattaatgcaaaattgttatgttactccataatttatttgtgtgcattactgtaaggttcatgtgtattcatattaaattttttcttttaaaaattgggttcaatgaattatctaggatgattgcattgtttgtggcatcaagtgttgtttctccctttccataccaagcatatcctgcttttggtacaggatatatttttttcagatgtcaaaacacctagggatacattttatgaattactaacttacttttttaggacagacttgaaatcatttagagggtaaactctagcaatatagaaatctgttttttgttgaatggagtagcagctaatctttaagacccattgatagcattttagtagtagcacttaacattcagaaaagaaaaacaaatcatccagcttctgatcttcagttttatgtaactttacaatttggtacttgatgacttggtattggtatgagactgaatagtgtgatgttacaaacatgtgatgtttgcctaccatgttctaggcactgtgccaagtgctagagatggaatggtaggtaaagctgtggtctatacttagggagttcacagtcaaatgaaggatacagtcacaaaacagacacttgtataaagcatggtcactataatacagagaaatggaaagaatggccagagaaagcttacttgaaaagataatgcctgaactgaatactaaagggaggtcagtgggagagacaaggaagggtagatattgattgtgagtgcatgagcattgaaatgagagggcccaggggaataggaagagaggaatagcctaaaggagaacaggagcaaaggcacatgggtgagaaacaacatggaatgttctggacatacaagcagatctctgttggaaggagtatgagataagggtaagagagtgattggagttgagtctggagagatacgaaaccaaatcatggaagctttttaaatgccatgtttaggagcttgaacttcatctttttgtgagttggacagtcattgaagggttttaagtaggggcccaatttgattgtattcaggttgagtagagtactctgatagctgatgtgaaggataaatttgaagggaaaaagattggaggcagagaggccatttgggaagtagttagcttgataagaggtgacgagggcttaaactgacacttaatagaaatggagaagagggagtagatttcagagtctgtactttttttgttgttgataaatagtaaatttagtaggactcgatgcttggaaatgaccagtgggagagaaaaaatggacgagattaactccaaagtttctagctgaggtgattccagggatagcgatgacaccaaacagagtgaatatatgaataatcagttgaggagacaaacggaagtcagttttggatattttgagtttaagatggttgtgacatcactaatggaggaaggctaacaaggcagttaacctttgaacttgatgctgtgggatatagatgggggtcctgggctggaaatacagcttgaagagttcatcagtttgcaggaggtgattgaaagcataagaccatcaagggaaggtgtgtgggctgaagagaaaaaaaggtcagaagacaggagcttggagaacagaagtgtttcagagtcaagtagagaaaaagaagccccacaaagataagaaaaggaactgaaaaaaatgaaataatcagtgggccaacctgaagatccaagcaagactagaaaccacacatttttaatggaacaaatctatatcgttgtgatttccttagaagccttaaattggtgggggagatcagaatgtaacattagtctaggattgaggttttaccagatggtacagtaaaagttgtgagtttagggaaaccaagttgtttgaagttagagcagtttagatgatcagctgtgccaaatattgcaaattatgtgctgtacattattctttacgtatattaactcttaaccctcaccacaaccatagttgttacagaagattctagaatgtaagttccataagagcaaggtgggtatgctttgttgtctgtgctattctcagtgcctgacatacagaataggctcaaatacttgttgaataaatgagagaatatgagatacatactattattcccattttacagatatggaaaccgggtaagaagagattaagtaacttacattcacaatttttagtggtagagccagtaggaaaggaattgagcccaggattagggagctgatggaaaatagagaaattttaggtctggagatctctctgaggatagtggaaataaaggcatgagagatgtagaaggggagaaagttatcatcagagagtaaaatggtggaggttatgattttttgagatagggttgttcagtgttatgacaaagggtcaagtcttagcagtggagtaaaggatgtttattattgaatctctgtaggcgtcgatgtagatgttgaaggctcctaaggttatactagaagtttgaatagagaggaacattatgataccatcctcataaatgaagtggtataattggagatctatagataagaagcagcagagagtggaatagataagctttcttatttcaattctagctttttaaacgtagattgaggttagatctggtttgctgaaaagacaggaataaattgggcttgctgcatataatttatttcccccatatggataagctcgttggaaagctccagaaatattcagaatataaatacaaaagtttcaaattttacctgacatgccagctctacttaaggtatgaattctaaatcttgtatctctcccctgcaagaaaagctacctcctcctttttatatagtagtagaacaaaatttttgtttgtgtttgtggcagcacatctcacctctttgtttcatagctgttgggtacacattccaaggacggtaaaaacaaaatgcacttgctcttctaaatctttagccactggctagtggattgcatttattctcagtttccttgccgatccttttacccttcccctcccccatttttctttttgaatggttttgtttcatgaagctcttgagagctttctatgttatattgtggcacaggaaaaagtttattcattttagcactaaactgtagttaacattttaagttaatcatttttagaatgttttgatgagcaatcctgtttcatttttagagatgattcaatctgatatttcatttgcttttaaagtctctaatttcttttcatctatttccatagcattgtaatttgtatcctgaacgtttctcttcagagaaatataaaaatccagcaatccattatagtattgtattaagcctaagatttcattatttatcatacacatttatttatttatttttattttttatcatacacatttaaagtacggcctttgatttatagaatttttcattttgtggttgtgcctgcttatctttgtttttgtgtgtgtatgtctttcacagaaattagtatcattctgtcatagctcttaggaaattcagagttaatcaaatatgttataaaatgtgtttgtataatgaaaaggttggaggagatgattctgaaggtgccatttagagcaggtgtgctatggtttggtggctctctattctctgcccgctttaaatcttagtaggcagcagatgaaatactactaagtgacctttgacacagaacccatgaatgctccaagtatgatttcattttaccgtgttctttgtaaactcaaatgcctgtcaaatcagatgtgtgtttcgatgtttttactgaatgcgccttgaggaggagactaaagcttggggtcaatttggcataatccccacgtttttctttttctattatagaggtttcttggggaaggggtgacatttctttctgaggaaaaggtgcaggctaagtgtaggtggactttctgtcttctccatactttttctgacagcctcactggatcctggtgatatcatacataaatgcagagcagactagatgggttgctggttggtatttttggttaccatttgatctggtgtctttggttatgtaataggcacattaactgacaaattatattaagtaaatatatagccatgggctttttaaaatctcactttttaaagtcaataattagattagattgtctcccagtaattaagtttttcatatgttcatggatatatgtagtatatattaaaagattatttgtgtattttttacattaatttggtaattttgacaatttgtcaactcaagtataaaatacttacatataaatatacttaaataagtatttaagatttaatgtcaactttacagtaatgaaatagaaaattcttgaatgttactcatttaaattttctgatttgagttctgataatctgttagaaaattagtaatatgcttaggctcacttcaatttccccagcagaaactattgtatccttactggttagaagctgccaatagtcattaattgttaaaatataagaaggttgtaggggaccatatgacaaaagaactagttacctttacagtttgttcgctgtacctcatacactttgtgttagaagaaaagctctattcagtgccttgagtgaaaagatccttacctccttttagactccgattgtgggaattttcttgctatcctggacattttaacttgttctgggttattttgaacatattaaggtggactcctggaatagttgagaactaattcatgtttgtttgtttttctgaatcagcagtttagtgattaaagcttaagattcttttaatagatttaatgaaaaagaaatcttaacttgaaatttaaattaatgaaaaatattaccagaggagatgtctgatattttgatacgggaaaatacagaaaataaaaacatttaaaaatttatccagatgttaatgtttgactggaagttttctactggaagaattagtttggattttacaatttgggagaggcagaagggagttggggaggtggtcaagcccaaattagcatgttgaatatccagattcacagacatttcactaaaccatttatgtacttagcatttttgttgactagtcttttcatttatagtgctcttaaatcactccatttgtcagttactccatttacctgaagattaaagtatacactgtgatagaaaaaaatagattggcaggggcgggggttgtattatataatgtaataaatcctattaaacctgttaaagtagaaacattaattttacgttttagaattttcttaatgacaggaaagtaaactggtaactaaaattcattttgttctgtaggtttgtggcattttatgtggggaatgtagatgctaagtgttatgagttgtccacctgtataaaactacttcccagaagccttgatgttcccataaagagctaaagacaaaaccaaatcaactgctaacaccttttatgggagatcaacttgtgtgggttatgaggcccaccttgactaagcaggatatgtaggtaaacctgcccagttggaattagtagctgatactctaaaaggagaatggtgaacaggaggccattagcagaaacagcctcattcatttatagagatcatcttgttaaaagggaaatcagcttccctagatcccaagggggtattgaaaatgctaggagagagcctagaaaacttttctgtgcagattgtcagaaaaaggtgaaaatattttcttttactgtaaaaagaaagaaattcttttccttcttccaaagatgccttaccacctttgaaaaagatttttaaaagtctcagagaaaatgaaatatagattcttaaagtggaaagggaccttaaaaatccatctggtctggttcattttatagatagaactgagaacctcaaaaagttatgtaatttggcttacatcacaagagctagtttgaagcagaagctacgattttcttactgtgtccagttgtttggaagtatgaatagtcatcattaaaatgtagggagtttatagggaagcttatgacaactattagttaatttacaatttgttcactgtagctcatctgctttgtttcagaagaaaaattctatgtcttgtgtggaaaaactcttacctccctatgaacagaactataggaaatttcttgctaacttggatgtttcagctacttcagggttattttaagtaactggatagttggttttcagaattctagttacagaaactagtaaaagaatatgagttgttgatacgtggaaactttagacccaaaataaaggtaggatgatgtgagtttagtgcttacaaatttgaatgaaatagtacctttttgaggtgttttagtagttgcccttaatgatttattttaaattagatggctttgggagtaaaaatactgcttttagcaaaaaataaatataaaattgaaacttttgcacgtagagttttttttttctttttgagatagataaagccatctaatgtccttttctatcatgtcttgataagtcaagagcagaccacttgatgaagaaaaatgaaatatcatctaaaatagaaaaatatcctgttaggaaaaataccaccgttttttcgctgcctttagtctggttgttcttattgtgtgaagggaacttaaatcttgtcaaattacatacattgtaagtcccatttctgtcttaaaagtataaccatgcatgctcaattaagtcagttatcgtcttcagactgtacttttgctaattaagtcttttccttggggttaagataagacaagatttacagatttttaagtttaaggcctgtaactactgaggatggtttaaagctttgataagtgagatgtggtgctttaaaggaggactttcctttagtctcttaaaaacacttggaagatatttattacagttttccaaagtaagataaagctcagctttaataatgaggaccttgaagtttttttatgtggtggggaggtgttaggaaactcattttttaactaccttcaagtgattatcgaggcaggtttttcttccctatgaggaagaaaatgaattgtgcaatgccagtttaaagaaactaaagcaatgtatttcttacataaagtagatcattctctctccctgtgtaactgccacctgtttaaaataagattccagtcttgcctctgtcagtcttaatgtgatagactctcactcagtgaagatctatggatttattttattgaaaacatttgtttagcatatatctgtgttattttaattttaatgtttttagagatgaggtctagctattttgcccaggctggccttgaactcctgggttcaagtgatcctcctgtttggcctcctaggtagctgggactacaggcatgagccaccatgcctgggtaagatctaatgatttatttgattgaaaacacttatttagcatacattcatgtatttttgtaacttgttgcctcctgacaggtcactagacataggaaagtgcctcttttaacactttcataaacctttaacataaacattttaaatttcttcattatagtggaaatagcgtctccccttattattggacattttgaaaaattaaaaaaattttaaaacaatttttatcataaatactagatgggaataattatatatgaagcttgtctgacaagttggatttttatgataggatagaatcccaggagtagaattattgggcatacccttttaagcctcacagtaaattattactaaagtgtgttgcaaagattttatcagttgtatagactcccagatatgaattccagggcccttcaggggaattagtggggacattttgcaaagagcaacagatggtgtctggaaacatgttctttaatctttgctgtgccacatactagttgtagatatctgggttagtaacataggttgtgtgggccttactttcctcaccataactcaggtgaattttaactattctactggccttaattctcattctgtaaaatatgagtataatcaaggagaatcagtgcctatatattaccaagtgatttgtctgggaaaaaagcagaagcagggaatgtcagatgtacctagaaaaaggagcaagttaggggaaatgcacaaaacatgatttgctcttctggtttttttaagaatagagtctaggctgggtgcagtggctcacacctgtaatcccagcactttgggaggctgaggtgggtggatcacttgaggtcaggagtctgagaccagccttgccaacatagcgaaaccccatctctactaaaaatacaaaaattagccgggtgtggtggcgggctcctgtaatcccagctactcaggaggctgagacaggagaatcacttgcacctgggtggtggaggttgcagtgagctgagattgcaccattgcattccagcctgggtgacagagtgagactcggtctcaaaaaataaaaagaaaaaagaaaaaatagagtcccataaaattatgtcagatagacactcctcctgagacttagggattttcaaaccatttcaaatagaaaatgaaagtgtaaggagacaagtgtgtaactttccaaaagaagttgtgttctgtgtccgttttaggttacagaatgactcaagccaaaaaaaaagtatgttattcattcatttacacaaaatacaaaatattttcattatcttctgttatttgtttaaattgataaaattatatttatggtgtacaactttattttttgatatatgtacacattgtggaatggctaaatcaagctaattaacatatgcattacctcacatactttttgttgtgagaacacctaaaatctactcttcacaattttcaggtgtacagtatattaactgtaggcctatgatttaccatggatctcttgaatttattcctcctgtttagatgaaattttgtatcctttgaccaacatttccccaccccttctacaccccagcctctggttaccaccattctactctctgcttccatgatttagactgttttagattccacgtataagtgagatcattggcatttctctttctgtgccttagcttatttcacttattataatgtcctccaggttcatccgtgtcgttgcaactgacaggattttcttctctttgaaggaagaatagtattctgttgtgtgcgtatactacattctctctatcagttcatctgttgatggatacttaggttgattccatatcctggctcttacgaataatgctgaaatgaacaggggagtacagatacctcatcaacacactgatttcatttcttttgtatttataactattggtgagactggtggatcatatgatagctccaatgttagtttttgaggaccctccatactgttttccatagtggctgtaccaatttacattcccagcaacagcgtacaggggtttccttctctctgcatcctcatcagcacttgttctgtttcatctttttgataatcaccattctaacaggtgtgaggtagtctctcattgggttttaatttgcatttccctgatgattagtcatgctgagcactatttcatatacctgttggcaatttgtatgtcatcccttatgaaatgtctgcaccctttgctgtttttttattaggtttatttattttcttgctatttagttgctttagctttttacatgttttggatactaatgtcttatcagttgtatggtgtgttttcaaatattttctcccattctgcaggttgtctcttcactcttgattgttttatttgctgagcagaaatttttagtttgatgtaatcctatttgtctatttttgtttttgttgcctatacttttagggtcatatttagaaagtcattgcccataccagtgtcagagagctttttccctatgttttcttgtaggagttttatagtgtcgggtttcatgtttaagtatttaatcaattttgagttgattttcgtaaatgatgtgagatgagggtctaatttcattcttctgcatggggacattcagttttcccaacaccatttattgaggagactgttttttccccattgtgtgttcttggcatctttattgaaaatcaattgaccataaatgtgtggtctctctattatattcatattttttaagtaaattattttatgatgagaaaggtggcaaaaattctgcattatctttgatatgtaagaaaaggccatttgggcacagattggacctgattatttctcttttcaagaagcaagtaccttatctctattcttattccaaagtgatttaatctctattaataatttaggcaactaaacatcattactgattgtaggagaaatctgagtctagtctgtctatactgatcaagaaccaggactacctcatggagactttggtaaaataaatctcaacagcactcaccagatgaataaaggttttcttgaactagtttaagatacttggttatcagttgaacacaaatagtaataatttaaggtttcatgaattgacatgtctataattagcttcctaaactaagaataacaaaaaatgagtagtttgttaattcctaatagcctgtgatgaaagttattatctggggttttttttgggtctgttttaaaaattaacactttggctctgattataaaatttataaattggaaattgaaattactggataaaatacaatttatgttttaaaaacattttcaagtggaaaaaattacagcttggctgaatagtgataattttcaaactaagcctttgagttcactatttagagttctctgataaattgttagagttagaagtagtgagttcattgcttgactgaataaataattcatatggcacaaaagcagctttttctttctcttcagttcccttctcccccattatgttcactttctctcttgtaaaaggctcctttgcagccaaatagcaaccttgtgtgaatatgcagggacttgggcatagtttcaacctcagtgttagctgagtatctggagtcatggaagagaattaagaatctgtcttgaatgtatattttctagtagcaactgaaaagaaatatagtagttgtaaattgctagaccttactcttacggtacagttgctctggaaatctctttttagcaaaataggattttatttctggatatagaatctttcgtagtgtctgcgtcaaaacaaaattaagttttaaaattgagtaaatcatttattttttctagttttttcagaaatgcttttttactagactaaataacttttcagcatcagtctgataagcatagaattttcaaaattctttacttgctattttagaattctttattttctaagaattatgaagactgtattaggtatttatgtggacttcctttttttcctaccttttattatagcaccaaaattggaattacgctagattattttctctctgctgtttaaatcataagagactcttttattgggtcagggcaattgtctttctagcacaataatcttctttgataatgtcactactggaaattatgtttatccttcataaattaactaatccttatttttgtaataaattatctgatatccttcagaggttatctaaaaatattcctttaagtctgcatgtattcagcatatttcatggtataacaagacttttacagttgtataacagaaatttaaaataaggcaacggactgtaatccagacttctgtcaactggaaatttttatgaagtagtattttgctggtatactgatacttcaccaaatacaatgtttatctttaaagaagtttctaaataagacaaaacattatgtttagtaaaattcaatgtagtatgttttactgtatactaattctttatatagcccataatcataatacataggctatataatacatgtaaagcatataattcataatacataggatacaaatcaaatatatgagctttattttgatataatcagactttattctgttacctatttgcctttctttttcaaacttttaagcgttgcccttattttcataagacttagtgtttcactcagtattaaatttatccaaagtcattgtgattttatgaaacattgtgattttaagtgctgaaccatgttgtttttcaatgtaaaatgagtgtaacttttagtaattattgaaatttaagcgttactgtgattttccataattctatttcggtagtcacaaaaaaacaaaaatttggcttcttattggcccttctagtgccaacactggcattgttgaaatacatttctaaggaagatggtgagtgtttcacttcattagtagctgcatgacaagccaccccaaagtttaatggcttaaaacaacagtaattcattatttctcataattttgagagttgactgagtgagtcttctgctttgtgtggtcttggctggggtgctaggaaagagggcagtccacagtggcctcacttacatagctggcagtggatgcaggctgctggcgtggagcacagttgggggtggcctgggtgcctcagctctccttaagtgtgcctctctgtgaagttagttgggcttgcttacaacatggtagctggattccaaaaagaaatgttccaagggcaaagaagctgcagccttttaaagggccatatttagaagttacttagcattacttctgcccattctgttgatcaaaacaagtcacaaggccagcccagatcaacaggaagagaaataggcttcatttgttaaagatggagtagcaagattacactgtagaagagcaaatggtttgggatgtattgttgcagccatctatggaaatgcaaactaccacaaggaagtgcagtttttgctgagcatgggtatttgccattaccacatttcagaaactggtatagtcaagcacacatggatttgaccactggatttacactagggtcacttaagagctatcagccactgtcttctcatctgtatgacagtagtagtatcaacctcacaggattgacagttaagtgagataatttggaagtacacagcgtagtgctggaaattccattactcccatcctgtttcttttcccatgtccctcatgtttaatttttatatttgtgattataatacttaaaggtatgttttaaagataaatcataattcatctaaagtctttgtcttaccaagatagttcaatagttccaatctgaataaagtttataacattaacataatttatagatcttctaatacaagcatctgtctaatgctagaattctttataaaccactgtatataggctactcacaatgtaatgagctactaattggtagaaacaagtggctatttgccatagttctacattctgttctaccttctattttgcagaaaaatcttacagctttcctaagccatctttttaggtcaattccagaatttgtttatgatcaaattgacaagtacctagccaaagagattaagatactgaatcagagaaagaagtctaaagagataattttccaatgatcatttctaaagaaggaatagagataaaatattttaaaacaggtactgaatagtcacagtcaaaggtttgattatgagtcagctttgttggttttagtctcattagtcaccagcaccaccaacctgtcatattggcaatacatagttttggtcaccaggagaaggagtcacagaaaaccagtactactacttacagaagattaactgaaagcacatgtcctgatttgttcttgaagataagactgaggtgaatattgcttaaaacagtatcagcaaaatacaaaatcaagtgaaatattacattgaatataataattgaaagaatgaggatagacacaaagaacttttggatgctagtgattagatattagaattagtttctcagaatattttaaagaatttaacaaatgacagtgttatgaattatgtgggcagtgcttaaagtgggaacagagcaaaagaagtggatttagttttgtcaagtctgtctgttcagcgttagggggaacattttatttcttctgaaacaatgatattggaatcccatttcatcttttcattttcaaacactgactttataagtgactttgggagaagcttttaagttttatataaagcactttttttgtacttagcacaaagtgggcacctttaaaattacctgtttgtatagcagttaatttaaagaatatgttcatgcatattactatattttctcgattctaaaagctcatcaattgtaaggcacattctttgatttcataacaactttttaatgtctctttttggaaaaataaaacacttttcttgggggaggaggagaatttttctaaggattattctgaattcctttgggccataggcactgtagcaaatgctgctcttcctgatctttaacacttttaggattgatagtgtcgttctgagccatgtccaggaattactttggcgaggtttccatttcctatttaattaaaatttttttactaattatattacatttcactagaagttaaataacttctcttgaaagtcatccagaagactttaacagccagatatttggtatctgctcagaattatcacttgtgaaaccttcattaaacataattcagccacatgtcacagaaagttctgcatgtataataactttttgtttcaatgctgcattatagtgatctttaaaagacattttaagaggtaatttagggatttcaaattaagttaaaatttagctgtgcatagttctgttgatgctgataagtgaacagaaggtaaattcttagtcatgtctaagttcacacagagatacaataatacacgtgggtgtaatacaaagcattatagtattttgtatagtatctcctttgttattaaaagttcttttgatatctttggtaagactcctattgatttgaaaaatgttactgtgaaaaaaatgtgctttaagagttgagaaagtaaattattcctttttttctctcagcagctgtttaaggaagacagagcaggcattggataatattcttattaaggtaaagaatctgggtgtttgagccctaaagtcatacagcaagtagtccacctggaatcatgaaccaggtcttcaggacttccagatatttgtgctgtatactatgctgcattttcaacaataattcatttatctgtgggtttgatttaatgagactcatttattcaacaaatatttattaaatgctattcttgccagtcattgtgttaaatgatagtgtaacacagtaaacaagacagatatctttccatgtcctcacgaaaccagcagctttggaactaaacaaataattataactaagatgagcattaagggagaaattgtaagatgataggaaagaatataacaggcggacttaacctgctctgggatggtgggggagtgttgaatgtgaactgagggtaggacatgagaaataacttttgggctgagattggaagaatcagcatgagttagcttaagcctaggaattaggagaagggttaggatggaacattgcaggcaacagaaatagcatctacaaaagtaaaaggaagaactgaaaagattccagtgtgagcgttgaaaagaaggataagtaaatgtagagaagaatgtaggaaagagattatgcattcttcaggattttttgacctatatcctaagggatattgggaaaccatggaaaggttttaagcatcggggtatgccatgattaaatttttcatttgaaaatcatgagtctgactatagtatatatagaagcattgttgttagatgctatttcggtaggccaggttggagatgatggttacagcagtggagctggagagaagggaatagatttgaaatttgggatgtgaacaaagccttgtatttgacagaaatgtaaaactattaatagtattgttattgttccacctatagaatctgattataagattatctctaaaatactttcaggtaacttgtacttaatgttaggaggaagtgactatattataaatataatttagaaaacatcgttccttaaaaaataatttttgaattgtgctaattcttgttattgtttgacttcattaactaatatagggagtatagggagaacttagttttaaaagataatttgacttcctgatttatacataaaacacataagtaattttggacatatatgatgtgtatatatatatatatatagtgcaggtcatcttgtttacaccacttattaatgaatatcagatttggaaggtgactctttaggattttcctattggttgattgattgaaacttacatgaagaatttaacccttttgtttcaaatagctttctattaagaaacacttttttcatgattattcagagaatttattgctggatcattggctctagagatagactgctggttaaattaaaagatgccggaggaaacattttggaaacagacttcacagaattccttatgaacttctgtactttcttaaccaatcttatttctttcatgtacctatggctgttactagcctgttgtatcagggataccatagtcaactacctatacgggccttaactataaagaattaggccatttagggaaataataatgagactggggctttagagaatttgtgctcatctaactgagtagagggacagctaatattctgctccatctgatggtgatcatgggagtattcaggctgattgttacccaatatttcagtttttccaaaggatcctaaaatacagatttttatgtaaattagttggtaattaatttaggtgtttttaagatactctgtgacaataactctacagggcaaaatcgacctgttaaatatatttggcccataggctgttgttttatagccttgaccatatagaaatcttcaatatctatttaaaagtaagaggtcaaaagtatttctaggaaaagtgaatgccaaaagaagggaggaagggaaggcataaatgagatactttttaaaagaagtacaaaactagttatctaggttatatttttaaactaagttcaaaaagaaattcactgtcctgagaataattttcatatgcttcagaacatacttctagcaacttcagccatctgcgtgtgtataactgggaactcagagtaggatgagaatgcacagggcgtagagaaccaatgaactgtagatgagagtgtagtggttctctgaaactgttgtgagcagagtacagcaggaacaagagacagttgatattggagcaaaatcaggctataagaacatagcgatctgagtacatcatgggcccctgaaagcattactagactaaaagcataattttttatactgatgatcaagaagaggtcatattggtacactaagattgaataactctgctcccaatagcacatgtaatacacaatcactgtaggaaatcaggaaaatatacaaaaagtagcatatggtttttttttaaagctaggaatgggtaaaattctaaagttttctaaaagtaatgaaaatagaacttggcaattgttagtttcctaatagctaattagtttccaaattagtctaatttggcttaaataaaaagaatattggttagctcacataagaaaatacatatattaggattagttacgccagtggctcagtgatttttttcaaggactcagtttgtcgtctactctactctttatccataatatttcctttatcccaacactgtagttgccaaatggctgctggctgcaatcaggattgtgtgtttcctccttcagatccaaagagagaaataaacttctcttggcgttctcatgggcaatataggttcttttctctgagaagtccttatgcactcctgcccccaacttgctccttattgtcctaaattagcttaattctaaatatgccttaactaatcgttggcaaaagggatgagcttaccataatggattagattaattgtggtctacccttgcagctcaggacagtcagcttaccctgaggcgcattgaccactgggagagatgtggatatagaaatccaatcatggatcattaggaagaaggaagcgttggataggctctcagcatggtccaccacagttgcattaaggattgtgtattacgttttttacttatgtgaaacaccaccttcccccatcaagcctgtaagtatgaagtcgagtccctagtgaatctactctctgactcctgtgtttcaagcaccctcattagcagagcttatatagttcggagttgaagaatttttttttcccaaaaattctcttctcatttaatagacacctgtctgtagagtaaactatgcaggccataaatggaacaaagatagtttaggaaaatacagtttcttaaataaattacttttaaaaagtatattttctctcagctcttctctccaaaggagttttgtatcataacctctgtagtaaatagtgtcatctttattgtctgattataaaggtgaagtataatttatgggataatttacaaagcaaaaaagaaatacttatttttaaagtttaaaaattttctgtgtagaaaatactataataatgcatgattttaagaatctgttattttggctaaaatatttaaccagccaaccatatatcttatttctttcagttgctagatttctgaatgttagccaaatattttagtatctgggtcacatagtcattacaaacaaatgtaggccaaaatggtttatgcttctcagttgccagctcagttctctctttgactttttattatttgtttctctttgaactaaactttatttacttatattagcacagtactgtgttaattctttgtgtagaactggtcttcttgtgtcgttttgccccaaatcaaggtaacaaacaaataaatgactgtgctcttggctgttatttagaattgttactatacaaaaggtcacacatgttaaattacctactgcagtgctaattattgtgaaaccttgttcaaaatgctagagagactgtgttttggcacttctgctgtaacagtttttaaagatccaacctgtatgcattttggtattgaaatcctcaaaactcctaaagaccctatgttaatttaaaatgcaaagttgtctcacctttttatactagatgagatagcatttttcttaaagtaaaatgagaactcttatgtgttatgatatagaggtaagggcagggaaagagagggaaagaagaaaggagtacattggagtaacaaaaattccaccttcatttataaagtgctataggctctaaaactccattctgaaatactcttttaactttgaaaggggtatgtttactgccagcttctgttaacacaggaaccatggtttttctgttcttaaaattaagaaccttataccttttggaatttttaatatttttctctatgtttgtaatgcttttaattatgtttattactaactgatgttattaactatatttataatttgtacactctattctgtttggaaagtacaaaatgataccatagatacttcctgaatttttttagaaaaatcaaaattttattcatctttattcatagcatcattggacattcagttagtaaattttccagataacaaacacctatcttctttgattgctagaatagttaatctcaacccctcttgttataaaatatagtgactgtggattgttgatgaaaatttcttaagacagtgtattcaggaagacactgcctcagggctactgaggtatgtcatagggccatttgtcctttcaaaaataattctcagtagctattgttgctttgcatttgtataaagtgtctgttttttcaaagcttgatattaattctgatagctactagtgtacagagaagggtgtctgtgaataaagtaagagaaagaatgttcataatagatttgaagagcacttcaatgagtaaagtacttggactttacaatgtttgcttttacttcactaagtcctgccctgtgcccctgctcctgcccctttatgccatagtctcttttttaacatggtacttggcagtgttccaggtagttattgtaagaaggatgagcttagacttggagctagacaaacatgatgggaattaaaacaggataatttaatagctgtgagaccttaagcaagttcacaactgcaaaatgggtttgtatatactatctctcacggttgtaaggattaaatataatggatatagtttaggaggtattttaacaaatgctagttcctttccttatactttaagataaatgacccacttactttggaaatggtatttgcctattttagtatgatgctataaggtttaaagggtcagtatccctaaaatatgacagctgttaagatctctttaattattcagaaatgaatggtatgtgacaagatattattggttaattcagtggatcagatgaataaaatgtgctgaaatattttggagactgaaaatataaatttagatgcaagaaatatattttaaataaacatggaaaacagtttttttatccgagtctaatcacgttgaaatattttatgaatatccccagagagttcgtaaattagtgagtgatttttttaaatgcaaaggtaaatacctagaaatcatatatacacttaaagtaaaatctcacagagttctcaaggccattttgcatttactagtgccacagtagtggcgttacagtgagctgcagtaacctgaaacagtactgcatggatgctctaataaattgcatgtctggaggaagcagctaactatggcgaccgccacggagcagtgggttctggtggagatggtacaggcgctttacaaggctcctgcttaccatcttattttggaagggattctgatactctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggacgcagtcttgctctgtcaccaggctggagtgcagtggtgcgatctcggctcactgcaacctccacttcccgggttcaagccattctcctgcctcagcctcctgagtagctgggactacaggcacaagccaccatgcccgcctaatttttgtattttcagtagagacggagtttcaccatgttggccagaatgatcttgatctcctttttttaaattaaaaagtaaactttaatgtcgaaaatgcaaacctggggagggcagaaagatcacacacaaggctgtcacttcacacttggaaggttgcacagcagccaggcagagaccctcctcacttcccagatggtgagggggccgggtgggggcactcctcacttcccagacggtgcaggggctgggcagaggcactcctcccttacaaatggtgagggggctgggcagaggtgctcctcactttccagacagggcggcggctgggcaggggcgctcctcacttcccagatgggacggtggccgggcagaggcgctcctcatttcccagacggtgaggaggccaggcagaggcactcctcacttcacagacaggacggcagcagggcagaggcgctcctcatttcccagacggtgaggaggccgggcagaggcactcctcgcttcgcagacgggacggcggcaaggcaggggcactcctcatttcccagacggtgaggaggccgggcagaggcactcctcgcttcgcagacgggacggcggcagggcagaggcgctcctcatttcccagacggtgaggaggctgggcagaggcactcctcgcttcgcagacggggcggcggcggggcagaggcgctcctcatttcccacacggtgaggaggccgggcaggggcactccttacttcgcagacaggacggcggcggggcagaggcgctccttgtttcccagatggggcggcggctgggcagaggcgcttctcacttcccatactgtgaggcagctgggcagaggtgctcctcacttcccagatggggtggaggccaggcagaggcggcgctcctcctcaattcccagatagtgggcggctgggcagaggcgcgcctcacttcccggacggggcggtggccgagcagaggcgctcctcacttcccagagtgtaggggggccgggcagaggcactcctcgcttcccagagtgtaggggggccgggcagaggcactcctcgcttcgcagacgggacggtggctgggcagaggcgctcctcacttcccagacagggcggcggcctggcggaggcactcctcactgcccagacggggcagggcctgggcagaggcgctcctcacttcccagactgtgaggctgctgggcagaggctcttgtcgcttcccagacagggcgggggccgggcagaggcgctcctcactgcccagatggtgcggtggccgggcacaggcgctcctcacttcccagatggtggagcagcagggcagaggcgctcctcacttcccagatggtgcaggcagagatgctcctcaggtctcaatctcttgacctcctgatccgcccgcctgggcctcccaaagtgctggattacaggcgtgagccaccacgcctgccctgccgtctcttctttctcctcctaagcagctgtcttagtctcctgaattttgatgttctacttaacaccctcatgttcttacgcatgttgccctgctggaggcgtccttctctttgggaagcctgacccaccaacagtgcctcaggagatagacatggaagcttagccggtgggggcccctcgtctctatcccacctcagttgcaggggaggggtcggttgcagctgcagtggtggccccgacagttttcttttgtgggacctgtggccggcagctctgggtggagaagacctacttgatccaagagctgcaggatccttgggctgcatgtcctcccccaccatcagcaagcctggagagctgggcaggtggtctttacccagcaccttcaaggccgccttctctggccacagggagcagcccggaactggggcagggagcactgttggaagtgggtcaggcttcccaaagggaaggatgcctccaacagggctgtgtgaactggcgactccatggcccttggagtagaaactcactgcatgcacctgggccttgtcagtctggttgttttctgtcaagctcttgaggtggacatttccctccaagggcctgggattgtaccaggaggaagtgaggtttccctgagtctccaggggcctagaggtggaggctgcttccccattgctacaggggccccttttattgtcctcctgcccctgggtctctacctggtctttcacctccgttgcttctttgggctcttctgccctcacctccatcttcgggagcctggctgggatcacctgctcatctaatgaaggaagttgaaggttaaacttgcctctgagacaagggatccttacggggctgaggtgtccaaacatcatggagttgtgaggagacagcacgggtttcttccttgagggggggctccagaccacaggacgcaggaccctctgtggggtgcccgtgttccgagggataagacacagcctcataggggcgccgtcccacctgactggaaaagaaggcccaagatgtcgctgacggttgaagaggagtgggaaacggcccacaattccccgggcaggcacaggtgcaggagctgcagggtgagcccggccagctgggaaggcctcacggacaagacgagcaggttgccgatggcatggccaggacctgcggcagaaccaggaacaaaatacgcttagcgagttgcccattttgagcgagttgtgcacagacgaaactaagggtcagaagcggagaggatactcctaagtcacccacttctctgtggctgggtgcacactgggcatctgggagtttatgacatcactatggggctggtgacagagccagggtgtggaggagtgcttaggagcccagcgagggtgcctacaagaggagtcaaagggcaaagggtgagacccttccaccggtccagctggactctagcctcagggatatcctgctcctgggggcaagtgtgtggccctggatgggcccccctgtggggctgttgggggtgcgaggctgatccgccagagcccttccacctggcgcctggcccaggtgctggctagcacccagtggccctgttttggccggccctgtcccccaggttacagggccagaacctggaagcagagcgcaggaccagccagatcgcgccaggcttccccggggcctctccagtgcctctgtgccacctggagccaggcccgccttctccatggctgccgtggcctcaagggccaccagccttgctccgcaggtttccaaagagaggacgcagtgccctgacctgactggatgcacctcttaccacatgcctccctggcaggcagggtctccactttttacaaatttgcctgagaccattcctcaggtcattcaggtggtcatggcccagccaggctttgaacccaggctgtgcgattccacagctggcgctctggcctgtgtgcctcatgatcatggatacagcatctattcttattttttcctgtagtcctggggtacttagcaccgtggcatatctgtaataagcacatgcacacctcgaaggaggtcttcacttcaacatacaagttgaccatggcatgctctgggctccagtcctctacaaagatgtagggcaggaactaccagttgtcagcacagcaccatcccacattgctcttctaatggagcctttcaccccagatgttctttctcgtctgatgggaaggatccaagtatgtaaagattatgttctagatcagctttggtctgtcctaaaagaaatttgccagtggattattccatatggataaaagtcagtttctctggtcttcctggaatgtgtctagaaagcaaatacattatttacaagttcatagtagatcaatgtattggattaaaatatgacaaacataatttggtcattgtgagcatgccagcttggtcaactattcaccacacatgatgccctaaatataactctaggttttcttatgcccaagagagggacatactcttgggtgtctggactagggaaacatgtatgaaaaaccatttggccactctacatcttgttattggagaattgaaaccatctatattcaaagatattattaaaaggcaagaagttaaaaaataaaaaaataaattgcatgtctgttgttatggaattttataactgtacataccttttatttaatccattcacaggtcatattataggatatctttcatttaataagtatactaaatccataccttatactgttgagttttgatagtaccagagggaaaaaagaagaaaagcatggcctctatctttaaggagctatttaacagtcatatgaatcactcgattgagaagatccatatgtgtaatataatgaattccacaaaaattgcttattaaaattttttgaaaaagtaggggtgagattgaatatagcaaagctttattgttgatttttgttgttggccaggccaaatttgtgaacattttacatgatcagctatatcgaaatacatttgtatgctctactgaatatagggaacataatttaatatttaatttaaactccaggttaccatcatttacaggcattctgtgcattaaaccgttttgcctcttctttcttcctcagtaacacgtttagggccttttgatgcattggaaagaaaaggcagttgcgagctgctggctctagcaaatcagagctaatcaacctgagaataatgtttgcactttcccgctttcaagtctttgctcaaactgctctctacctttgctcccacaggttagtcctttcccccaatctaaaatctctctgactagccctgaacttactttttatagctctcactgtctaccatctccttcatcttgaatataccaggacagactgggaagttccagaaaaaaacagacataatacttaaatcatctttgatacctaatttgtcctcactgccaattaattaattttgttttgttttatttaattttgtaaagacagggtcttgctgtgtcacgcaggctcctctcaaactcctggactcaagtgatcctcccacctcagcctctcaaagtgctaggattagaagccgtgagccactgcgcctggccataatttaaataatcctttagattcctgtctctgtccattttcaaagccagggttacactatcataacataccccatgatgtacaccattgctaaaacaatcttcctgaagtactaattagatttttgagcagagaataaaaccatcctttccagtgttggcaaatattcaacgtactgtcctgaaatacctgtagtacttccaagtttctgctttgtgctcacactgttttctttgacctgaaatgcaatttctatctataaaaatcttagtcattatgaggtctagcaaagatctttttcttctatgaagccttcctatcgaccctaactaaaatctcttctctgagttcccagcgtatactgcttgagctggagcaagactccagtgatccttggaagaaagtgggaggttattttcccagtgcgattccaggaaagtttaatgtcttatagttcagtcccctttagcattccacatacagttagtgctcaaatatttgataattgctctactcacaaatatttttgtgtgaaattgctagctattctctatccaagaagtaatgaagtatataagcttcttcaactctttgttgagcccgggacctcttacttatttctgtatcctatctactcttgagtagtagggtcattggaaagcaaccactgggtttggggataagttgtgtgtattttagaggaggaagtaaaggtgttactggacttttaaaactgaagctttttctgttttaaagtattttgcttcccgttactgtatttataagatgatactggtatacgtagtgtcttggctatttatctattcccctttctctttaacacaatattccccaactttggtgtgatactgaattgaaatctctgggagtgtggcctaggactctacacttttactaacaatcagttgagatgcttatgaaggtggtggtagtagtgataatggtagtgatgatgatgatgattgtattagctctgctttcgaaggcttatgatgtacttactgcacttttctaggcagtttgcaactattaacctaatgttcacagcaagcctatgtggtaatacgctattatcttcattatacaaatggagaaactgtggcagatataaattaagtaacttgtcgccaaaatgactttcttataaataggtcaagaatccatgaaaaggatgaggcatatttttttggttgatagtttttaaactcactttctaaaggattgctttaagtgatgtgaatgatatgaatgtaaactggttcttatataaattgaagtatcaatatgctgactctatataggaatacttcaacaactagacctaaatatagatacttgctcttgcttttaggaagcctgtcacaattcttggtgaaaaagtaagcatgcacccaaaaacgtagaacattgaggaaaatttttaaataattacactttctaaaatacatgattttaggaagagtgctttattatatactatatatatatatatacacacacacatagacatacacacgtagatgcatatatatttactctatatggatgtgtgtctatatgtatagtcattcttcagtatcctcaggtggttggtgccaggacaccctcagataccaaaatccaaatactgtcccacagtatttgcatgtaagctatgcatatcctctcatgtactttatttatttatttatttattgagacatggtcttgctctgtcgcgcaggcttgagtgcgctggtacaatcatggcttactgcagcctcgacctcctgggctcaatcgatccccccacttcagcctcccaagttagctgggaccacaggcacgcaccaccatgcccagctaacttttgaacttttttgtagagatagagtttcattgtgtcgcccaggctggtcttaaactcctgggctcaagcgatcctcccaccttgacctctcaaagtgttgggattacaggcataagccactgcacccacccatcctcttgtatacgttaaatcatctctagcttacttataatacctaatacaatacaaatgctgtgtaaatagctattatattgatttttatttgtattattttttattgttttgttgttttttaaatttttttcctgaatattatgtgtgtgtgtattgagatgttactttgtgatttaatgtaattcaagtaaaactcgttaagcatttattttctgttttagtagcataagataaatttggttttatatgctaaaatattttatctttttaataataaatgataagaatattttgttcccttttagttcatagactatgggaagtggagtagggagtgaaagtggtggctgtggtggtggtatggtggaagtaatttgtttaccatcactgcctgtccaaaataattttgatgaatgattttaggtgttgcctaataagtgctctgacttttgaaaccagttgaactaacaagcatgttgtgctttgctagaaacatcttgtaagttctgactttgaacagacagtggaatctaaattgagttagtggaggacatatctttacaactaaatctaaagtgtttcaactatttctttttttaatctcctgtttatttttcttgtagaattaatatttttgattgaccaatcataattgcatacatttatggggtacaatgtgatgttttgatatatgtatacagtgtgatgtgcttatgctaattaacatatctgtcacctcacctataatatttcatattgagacatttgaaatttgcttttattattttgaaatacttaaaacgttattattgactctcgtcaacttgctacggaatagatctcaaacttattcttcctctctacctgaaacttcataccccttgatcaactccccccaccaccctcctaccctagcctctggtaaccattgttctattctctacttctatgaatttaatcttattagattccacatgcaagtgagatcatatggtatttgtttttctctgcctgacttatttcacttagcataatatcctccagattcatccatgttgttgcaaatgacagaattttcccctttttaaatgctgaatagtattccattgtctgtatataccacatttccttgattcatccattgatagacacttaggtgtttccgtatcctggctattgtaaataatgcaacaatgaacataggagtgcagatatccctttgacatactgactccagttcctttggctatataaccagaagtgggatcactagatcatacagtagttctatttttagtttttttgggggaaacttccatactatttaccataatggctgaactaatttgcattcccaccaacaatgtactgtataagagttatcatttctccacacactgtccaacatttacctttcatctttttgataaaagctactctaacaggtgtaaagtaataatgcattgtggttttaatttgtaattctctagtaattagtgatgccgagcattttttcttgtactagttggccatttgtgtgtcttctgagaaatgcctgtttaggttctttgcccatttttaaaaattgggttatttgttgttttgttattgagatgttggagttacttaaatattttagatattaaccccttattaaatgtatgatttgcagatatttctttttatatttcctgtttacaaatttcctgaacttctctggctgctcatttatatagaattgggatgagttatgtcacctgaagcagtcaagataagactgtttctactgatatccatatggcaggcttactttgttacccaatccaatgaaaaagggtgccaggatgtgaaagaaaaatagatgtgatggccgggcgcagtggttcacgcctgtaatcccagcactttgggaggccaagtcaggtggatcacgaggtcaggagatcgaaaaatagatgtgatgccatggaacattctagggaattaccatttttagagagagttttgataaaaattttacgtatttttaaaactcatattcttagtctgaagagttggaaataaggttgaatgtatgtcttaaagctaatagtataaaaagagaagtgtaaaatttaagttaatcatacaactttctttccctaactttatgaattgactttttgcaatttccggagctaatgaggtgaatgtctgaaattgagtatgtaggttaaaaagttgaaattttcctaataaaattgtatctctttctaaggtgtaactctttctttctttgattatagtaaaaggagcatctgtggttcttaagaggtcttgatttttctgccagctagttgtgtgactttgggtaaataatgtcatatgactggacctgtttctttatttgtaaaattgtgtgtggtgttaaattctaagactgtttttaaaaaaatttttgcggagactgggtgttgctttgttgccaaggctggtctgaactcctggtttcaagcagtcttccccaccttgacctcacaaactgctgggattacaggcgtgagcctccatgcctggccaaattgtaagactcttataatggatgagtagaatatatttaagattatataaaaacacaagtcacttcatgatcatcgtctgctggaacatgaaaccagctttcttgtgtagatgtgttatcagtaatgttattcacaccgagaggatcattctgtggtttttaattcatgattttgtaatctgatagtgacttttcattatgtctcctgatttataattacatcacagccattatgattggaatcattgggaagagttgaaatgagcaatttagaattgtttctgaaatacagaaagccttattttttggtgggggttgttggaggagatatctctgtgttctgtaatttcatttgactaaggaatttatctttggtcttctcccagagtgaggacatgaatacttccatagctatattccgtattaatcacagtttgctttgtgggtttcattaggctaaataagaaaaacgtcgttatgtattttctgctttaaaaaatgcttcttgatataaagtcttctcagatcagtcccacatgtgataaatctattcaaactattaaactgcctcaatgtgcttgtttctctcttggaaatctatccatttctgtgtctttatgtaccactcactctcccccatcatattttaggttataagctcctttcctttatatctcatagcacccaggaaagaactttgttagtctctgaatagtttataagtgttattgctattgagaattttggatttaaattattggaatgaatagaataatgctatttctagtatatctaactgagggtcagtgttattaactcaaagacatagcagttttattaagctctaggctttgtttctgaagtcagtttctcttaatcataagtggattattcactttatattctcttatataatgccttggtatcaggttattgataggtaaacatcagaaataggctggatagatatgcatgcatgtgtacacatgcacatgtatgtgagagagagagagaaggattgcacatagaatatatgagaatttgaggtgtgtgtaatgtttataactcatctgagtcttacatagctatctagttatgtacacttaattttgcaccttttatagttgaaattcagaaacattttttaaggaaaataaggacgtgtttttctttccttcatgttttcagtttagctttatttgattgtatttttgctaaagacttaaattgtcaataactattgaaatgggccaacttatagctgagcacaaagtatgttaggacactgagatatatcttaacatttgggaataatttaatgtgtctaatacttgagaaggatcaaaacagactgtacaacccaataatcataaagcctatggtcaaaaatcgtatataaatgacaggccctatgaagagtagccgtaagaatcaagagaaaaagaacctaaattggtacagaaaaggagctgagtcatttttatattataattagaagttggtaacgataaattttgtcttcccagtacaaaaagtatcatgatcaggcaggattacgctaaagtgtaacctctaacttcttgtggtatgtactattacaagtagttgatgatttaataaatataaatatagatgatactgtcagagtgtttccagacattacagttagcttttaggtgaaggcagtgcttgacagaacctaagtttgtgactcaataatttattatataatctaataccatttttatcttgtattaatttgggttataggataattggggtaactttttggtgagggattgaaattttcttaaaagcgttttcagaagatactagaattttatgggattcttttattatagcatgtcttctcaaatataatattaggactgcttgaacaggaggcaaatcatattcacgttattttccagtttagagttattgctcttatcagttggtgggtgtgggaacaacttaataaagtttgggtaatttagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggtaagagttttcatttaaattgtgtgtgtgtgtgtgtgtgtgtgtaaagcctaccaatgtattatatttgaattaaaattttagaacttttaaaatctaggacataatgacaagtgtttgaattttatatgtctgtcacttatattttaataaaatatatgcaaagaatggttttatagataagagattttacatacttaatgttgataaatagtataaaagtatggaaaatcaattatatagttcatgtctggtttaaaaattcaatttttgtagttttattgtagttatttaaaatagtatattataaaattgcttgactgaagtttaacttctaaaaaatttgtactaaactgagtttttctgttcagtttcataagtgcttcttaaaatagacatgcattttgtggtagtctgttgaatgctgtttggttttttactttcattataaaataggaaagaaaaaagtataatatcatatgacaaaatccatttagtttaacattagttctttaaaaatgtataattgctactatactttggcggaaactattaaatttgtaagataagacgtttatactctatacccaaaacaaagtgaagtagctgttcataatatggcgcagaatcaaattttggtgataaaatcagacatctctctcctgccttacacatactcccactgagaaaataatttctaaatttggttacattttcatatacttcagatgaccttaaatttatatttttctcctgaatatatttgattcctgcatatccctttttttgggcatctgtgtccaatcagatccatgattagtcatgttagctttggacaagagtggaggtaggatcttagcaagtttgaaatctttaagattgatgtttatctgagattattccagcatgtccacggacatagtagttttgtgataacaaggtaatggctgatgaagattagcatattaataatagattataattctgttaaccattctattgtcaaatacgtgatttttgcgattcacatagtttaagtaatttttcatgcccaattagagatgtcaaaattatgttaattgaatctggccatgttcttagctgttttctagagcttaataacaaacatatcaggaagagctcttgtgacaagcacccagcacagcatctgtcattatgtaatcattccaatgtttacagtgaactaagtacttgagatggcaacattcatactttagtccctctgtctagtaattcatacttgtatagtctgtctactatgtgtcacccatttaggtaggtgctgagaataaaatggtggggttaaaaacagatattccctgttattgaacttccagtgccaatggtaattacagtgtagataataattacacactgcaactggaaccaatactataaaatggcataagttcctataagggtaggaacaataaagttagtgtataaataaagcacagaacctacacatttatttattagattgaattgataacttgcttttgaacttttaaagttaattctattaatatctgctaagctaggcatcagaaagactaaattctaaccatagagaaatacattttttatgctgctattctattttcttagatttcttaagaatttacaacaaaaccctgtcaaagcagcattcttacgtgagaatttcacttacgggagagttcttacaggatttcaagaaggaaagccctgaagagggacactgatttcctcaactgaatttaaaattgttacatgcagacatttttaaaggtagtatgattttccttaatcaagtcaactttatatctttttatctttttaaagaagggaatgtgacatttatgtttttcatacacacacacacacacacacacacacacacacacacacacacacagagaagcatacatgttgattacgttttggaaaataaaatccaaagagcatttggatgtctgaatgtttatgcttcatctccgcagtgacttctaaatttagtttttttctggatatactcaaagtcaccaacctgagttcaagtattctgatttgaagatctcaacttagagatccaggcagtcccccttgtcagtgctaggagaaagatgtccttcccataccttccagaaagagtgtcttgaagaaatatattccttcctgggtaacgtgctttggaatgtacatgatattcatttttctttgacagctctttttggttctgtttagttggctttgatgggttcatgatgcccagtggagaatttggtatttagccacaaaaagatatttaagacacataattatgtaaatattgcagatggaggatgatacatagcatttcttttatcaaaatgaatttgaattgacttctttctaaaacaaaattctaccaatagtcatcagtttttaattatataacttctcaatataggaaataatcagtgtctgattggctgtgtatgttggagtgtaatggcttttgttttgaatttggcagtttctactctcagaagaaatgagttgcgaattacagtggtgttagaagaaatgaattggaagttcgaatgagaaaaatttaaataaaagttattgtttatagatatggaaaggaaaataatgtttttagttcaatatgagaaagaaccttttaaatgtagaaataaaatggggtgcctttctacatccattcttaagaatttggcagaagttatgaagaagttaaaaagaaggagttcctgctgatataagtcacgaggattatttgaaggaaatttatgtcacatctcgtaaaatcatcatattgacaattataaatatgtaaaactttatgtgcaatagttattactaaaaatactgagctactatttatagtgagatcattattaaataaatttaacagatagaatagcaaatcacatttattcattcagtatattcttaccaacaacctgctgtatgtcagtcattgcataagactgatgtgatgccataggtcttgcagggaatgtagacattaagcaagtaattacaataaagtatagtggcttatgatattataaaaacaaagcagtccttaagtataccttgcaattgatctgtagtatattaattttaatccgctcatactcctcatgaaatgaggttgttcattttgatgtaaaaattagactgacgttctttgcagttagtagagactgaaaaagttcttattatttgtataacttatttaaaatgagaaactgctgtggaaagatctgcaggtttctgagataccaagaaacgtgaatatgagcagaataaacacatgcatattatatacattataaacgtcatttaagacaattatatgaagcagttttacatttaaaactaccaagttgtaatagttaagaagttgggctccagagtcatactggttgggtgtgagtattaactctgacacttaccagctttgcagtcttaggaaacctgcataactctactgtgcttcagtttccttacctgtaaaatggggataataagagtatatatcttgtggaaaaatatattatttgatatatgaaaatgctagaagagtatctagcatatggaaagtgcatagaaagggctccatatgttgttttagttaataattacaataataatttcctcatcttaaaaatatcctgcttcattcataaagttgtgccaacggaaataattgcagatgatgcttaaaatacatacaatatatatttcagagtggtatgtaaagagcttttattattactgctaaacaaaaaaaaagtccgtgaaattctcatctaagctttggggcctctttagctgaatttcagcagtcactcaaaggctttctagagatgccatctagagatactttataacctagtgtctttttttttttttttttgcaatacagaatttttttttcattgtaagatgctgaatgagagaaaattatttcagtactacaagtatggtttcccatgaccacaattagttctaatgtaaccagtcaacagttgtctattgaaaaccactagctattaatatagtatcatggtagcctaaaagaattatgctatccttctacttaggctctagggagacaagagccatgtaaagaatacttaaagcacaaaatgtgagactgctctgccactagttcctgctctgccactaataaacagaggtatcttagatatatgaacctgttacaattatgaggccatcttagcatctcagtacccttattatatatatcgtgtgtatacacacatggccatccaatatttctttcccaaattgaaatgagaggaattcattaaggtggttttaatttccaaatttactgagtaaaagaattctattctaaaaattattttgtataatgcccttcaaattgagttttacatgtactatttcaaggcttctcagatattcccacataaattatctagtgtttctgcatcactttgcgatcttttcattaatgtcaagtgtaatgttttttaacttcacaagggaaacatgaaattcctttagtgtgcctcattttcagacattttcttgttgattaaaattcctttttaaataaagtttcaacatgtactaaataatttgtttacctttgaattaactttttataaatgaattttaaataatgacagcagtcattacaaactctgctgttggcaacactagagggcatttctagttcttcagacagtgtcatgagttctcagaataatttaccaattcattaaacagcagattagcattttaagggaaaggaactaaaacaagcacaatacatatatcatacatatatatagtatgtatatattatgcatagacagataatataaatatccatatataatatatacattatataatatatggataatacatatatattggatgtatgtatactcacgtctgctttaccaaatgttctcactgaatcactactcctaaaaaggcgggagagtatttgtgatctgctcactgaagcaccactatattatccagttgtttattagtgtcgtggaggtctatgctctgataggtttagcatcaagtgaacattgagtaaaaaagtatatgtatatactcatacatacatactcatcagaagttagttgctgtgcttattgaactactagatgctaacatagtcataattagaataatttttcagataaaaaatgagagttaaaatagatgccctttataggcttagtagaagatttaagactacctatattttgaattactgtattttagatgttaaaatattttcaagggttttgaatgcaaacatttttagggaaaagatacaattatgtaatattaaatatataatattaaatattaacatgcaatgatatgaaagaagacaagtttataagaaaattcaattagcgtaaagaaaaacttttttttcttgggaggatttgcttactgcggtgtattggggaaaaaatcttatatatcattaagtaatcattaacacggtaaaagtaaagtcaaggaccagcaaaaaataacctaattgttgtgaaaataaggtgacaaacagacaatcccatcttacactgtaacatactttgtataagaggggatacatgataaccactagaacagtggtggatgtgcaggtggtagatacacaagggatataagaaagtctttctagttcaaatgtatttctgccatgtactttacccagtagaaatgcatttacatttttaagaggagcgtataaatctctcaaatatttctgttgatacatatacctatcattcacttaaatacctgagtacctactaagtataaaataccccgttattttatgtttggcacagtgaggctgtaacagtttatactcctattatgtagctgagaccagttggtctcttttagagaggggagtatcagttagttacagaaggactcatttgaatcatgagataatttgtgagaatgcagacccaagtaatatgctctaataaaatcagaaggcagcatgcttttgttgagaaatggaggtaggaaggtaacaacataaaataacctactttgtactggttcagtataccccataaactgtcatctcttttgtttgtttgttttgagggtacaaattatttcattttctgatattctctttcctaaggtattgttggactgaaacttaaccaattctcctctttttctgtctctgtctgtctgtctctctctctgtgtgtgtatatatatatacatatatatacacatatattctttctacacacacacagtaacagtatgtgcaagtcaaatttaattttaaaataaatcttttaaagcgtgggtcaatctgtgccagtcacacacagggcagtctgccgtatcttttgcatccttgttttgtactgctcgtgaatgttcgttatatagtagagtaggtaattccatatttacttgtactagaatatatctggcttaatagatgatgttccaaaggcttgaattaaaaaaaaaaaaccttagtgtaaaaaatttcaggcatacacttaagagagactagtgtaataaaccccatggcctagatttaacaatcagcaaaattttgccacatttgcttcatctactctcttctttttcctcaactatttttaaagtagatcccagacttcaagtcttttcactcctgcattctttcatatgcatttctttaaaagaaggaatttttcttatataaccacaatacctttattacatccaacaaaattaacaataactactaaccacctcatattctctctgtattcagtttctctgcttttaactgaaaaatgtcctttttacgtttagattgttctttcagaatccaaccaagatctgtatagcatttggttgtttggactgctgtataattaaaaggtcttttctttcccaccacttgtttacctcactcacccccaaacccccttcttcctccttccctccccttttccctttaatgtgttaatgaaaaaactgggtaaactatcctgtagaatatcctccattctggatttctctgttgccttctaacttgttcctgtagcctctgaatttcctgcgaactaaaagttggcttgaaagacttaattagtttcaggttcagctttggttttggtgttgaggatggaaggcatgcaggaatactttgcacatggaactgtttcttcatactgcatcacatcaaggagcatataatgtctgcttgtcatactcttatcaatgctaaaattgggcagtggtgccaacccaatctctctattgagagttttctaccaatctttcctcccgtgggaaaagttgctgactgttctccaaatcaattctgtcattagggtttgcaagagaatgaatttttaaatctgccaccccttacacatttattagtggaaattcttctgtaagaagaagtttccttcataaattacacctttttgatttatctgaaacaatgtatactggaaagaagcctggtgtcttaaatatcatctgttaatacctagtgtaacattccaaaggtaacttgagatactgcaaggaccacatagcaccttgagtacctattttacatgtgactctgaggactttcacagaataaagatatttcttattttaatgaacgttgtcagtatcaggataattttatgtagtcaacatatatacagtgttggtcctataggagttggagaccttttgccagttttatttggtcaaatacattattttgtgatgaaataactgtgagtgatgagttgagcctcaaagaacatgatacttcattaaatcaacaagctgaacagtatcatctaaccaaagctgtagaataaatggtgataaacttaaattcaggaatgaaacaatcaccatttttgttacaaatttgtccacccgtcatcactaaccccatttttatttaatactggtaatgaacaaaacctgaagaagaaataaaactaaaatatttcatttgtagatgacatgattaattatctagaaaaatctacagcaatcagctctaaaatgatttattaaataataaaaatttaataaagtaccagatatactgtatctttataccatgtgaaaatcattctgggaaaatatcccattcagaattgcaacaaacgatgtaatatctagcaatacatttgagagagatgttagatctttggaaaataaattaacatccagtgtatttgaaacaattttaagattcaaataaaagcagagaaactgtttctaaatcaagaatattggcaaattatttgactaaaagtaagatttttgggtttaacctctaacttccaaaatttctagtgatttattttatagtgattctgtaatgagaagtctcgtcctactaaatatcaaaaggttttaaagcaagaatgtctaaaacagtgatgatgatgtaagaataggtgtgttacccagataccagaagagacttctctgtctgttggagatttaagtatacattttctggccaggcccagtggctcacgcttgtaatcccagcactttgggaggccaaggaggtcagatcacttgagatcaggagttcaagaccagcctggccaacatggtaaaaccccatctctactaaaaatagagaaattagctgggtgtggtggtgcacgcctgtagtctcagctactcgggaggctaaggcagaagagtcacttgaccccaggtggcaggggttgcagtgagatgagattgtgccactgcactccagactgggcgacagtgagactgtctcaaaaaaaaaaaaaaaaaaaaaaaaaaaacaaagtaaatttcccttgaagcccgacttcatggccggtgagagtcaagagacatggcctggatcccgtgacttacacaaatccctgtggctgactcagaccttagtttctctgcctctgcttgcatgccaccttggtttctgccagtgtcaatacatatgtgaaaccagcccctttactagtttcaaacatttaacattttgtgagttaagaaatcctgaataggtgatagaccagcaaatgattttcttaatttttgagtggaacatgctatctatgttcattcttttcttctactcatactttactgaattaatacagttgttttcttaagaggaatactgaacaaataagcttgttttcattttgtaaaacatagattactggagcactatgaggaatacaaaatttgtcccatctgttatcatatacagtaactaaatgtatgacaaaataatctttcctaagagaggggcacttaaaggatatttgttcagtggtgttggatagtactattcagtgatatgtcttaaaactaattagacaaaaatcatccgtatattacacaaccataggaataaaaaagaaaaggtaacagagagaatacctttacatctcatatttgaagaattagtagaactcacccagaagatacttgaatattaaaaatttttgttggaccaaaatattatgattaaaaggataatagaaaattgtggaaactacattaaaaattataaggaaagtgataataggtataagttatatattgttgtaaatatgcaagtttagatatcaagattataatacataagtgagaaatgaatatgacagattaagaatatgaaagtaaagacacatgaataataaagaaatatgaggtttttttcattgtattaaaggacataaatttttaaaaagagaaatctaatatttgcaagtaagcagtgctaacagacccttttgggaaataatgcagtaatacatgctgagagtcacaataatgtttagaaatttcataataacatattaggaaacactatgctaattattttacatatatatatatataaaatgcccagcttaaaaactaattatagaacagcaacataaaatattacatttaaatgattatttttggagactatagaacaacactgttcaggagagctttgtggtgatagaaatattctgtgattgcactatccaatatgtagccatttggcacatgtggctgctgagcccttaaaatgtggctagggcaactgagaaactgaatttttaatttaatgttaattatttaaatttaaatagataaatggggctagtggccacaattttagatagtgtagttccagaaataaagagaaatgtttggtataagtgaaaataaaatagtaaatttatatgccatgattacaagtatgtacataactaaatgtacgtatggaaagtgatagtcataattaaaatatttgtgttaggattgaaggaaataggtaatttttttaaaatgctaaatttttaaaaggttacatgacaataatgtaacacttcagcattgtactggtactgttcagtatggtagccaccagcctgatgtgcaatttaaacttacatctgtttaagtaaaattaaaaattcagtaccttaatcacactagccacattccaaatgagcagtagtcatatatggctaatgtttgccttttcgaacaatgaagctatagaacatttttgccattgccaaaagttctattgtacagtgttgtagaaagaactggtaaaaggaatatactggaatcagtcactgatagtttatttgtcagtagtttctaagggcacatgagaattaaaactggaaattggattcagtaaaaagtataaaggaagagtaacataagatcctactcctgtaacttagattagtgctttttttttttttttttttttttttgagatagagtctcactctgtcgcccagactggagtgcagtagtgtgatttcagctcactgcagcctcaccacctcctgtattcaagtgattgtcctgcctcagctacccaagtagctggaattacaggcatgttccaccactcctgactaatttttgtacttttagtagagacggggtttctccatgtttcccaggctggtctggagttcctgagctcaaataattcacttgccttggcctcccgaagtgctaggattacaggcttgagccactgcgcatgacctacaccagtgctccttgaagaatgggctatgaactggtgctggtttgttaatcaatccatgactaaatgcttactctcaatttctatattggtttagaaactcttacagccatgtgatatttgtgtcattcaggcacatcacctgtctccccggttgaagttcaggccagtagttttaacgcagttgcctggagagttttatgcaaagtgagctgagtatagtcatgacggtagtccatgaacctgggtccccaaaagggagaaaacagtctttcactacagattgcgtgagaaacattggccagcattaaagaaggaaagtagattgctcagggaagttttgtagggaacttaaaatgagatgttagtatggcttagtaatctgtatttgcaggtgaaatgaaaaattcagccctaaatctctgaatatggtaaacttagacttcatcttctgcaggtggaaatgaggcaagggatccattatccacagcatgagtaagtttctagtcagttcctctgtctagggagtttgttttcccttttcgcccttgttggcctgggagactcaaccagcttagtagtcttttcctttcagtaagatttccaactttgggttggtctttacccctttttagctctttttgtcgtattatctgcacttagtactttgtaactgttttcaccccttccccccaaagttagttcaaaggcttacagcatgttgaaaataggaaaattgtttttaaattaagtgagtttttgtgtacacttatttctttagtctaaagttttgttttaaatctctttttcacatttaaacctgattccctgagacaagatataaaattgaattatttgtgaaatgtggaaaggtttttattgcctgtaatcaaagcataatctgtccattaaagcattattttagtgatgaagggtggacatacatcccaagtttactacctgttttcttactgtggttttgaccatacagcaaatggtattttatactctgaaatgaaatgcaccatacacattgtccagtatgttttgagttttaattctacattttcagattttggggtcaaatgaaatcaagtactttataaatagttgtttcttctgattctactggccttacatgttagatttttttaaagtatacacattcagtcctttatcagtaccattaatcaaatgttgatttcagcatttcttcattttgttttcttttttcttttctttttttctttttcttttctttttttttttgagacggagtctagctctgtcacccaggctggagtgcagtggcacagtctcagctcactgcaacctccacctcccaggttcaagcagttctcctgccttagcccccccaagtaactgggattacaggcgcttgccaccacatccaactaatttttgtatttttagtagagatggggtttcaccatgttggccaagctggtctcgaactcctgacctcgtaatccgccagcctcagcctctcaaagtgctggaattacaggcatgagccaccacacctggccagcgtttcttctttttctctctaatttatcaaatttggaaacagttggaaaacatttaaaggaaataagtctctgtgtttttaataatagtttaaaagttaaaggaaaacaaatgaataatattctgtttattatagtcagacaaaatgtacatacgaaaatacataaggaaatatagaatggcatcttctgattttaatttaatattatggtaatgatttacttaggcagaattatagctatagacaaccattttatcactttatttatatcgatctactctctatggatgaaaacagttaatactaaagcattaagaaggtatattgcttttcatctgtattaatattcttcttctgatatttgatatttaataatatattttaaaatactctgcatgatttcctgatcttaaagcattccattcctttcaaggaatttggattataatgatttatttatagtatttttgtcattaatattttaggatatggcatcttaaaatattgtattcctaacagttatttaatatataattaaacatctatattagtattattttatataacatattttcaaactcctcagaacatttgtaggtttttgtttaattttatgtaagtttcaccttaagaatattgactaatcggttaatattcttcttaatcatcgcaattttttaaaatgctttctatgtaccaggacctatttaaggtactacagataatcagtgtgtcaaaaaacaaaaccaaaattcctttcctcatggagttttacattctagtagattgattctactgttgattcatactaaattaatttattaattatagtagattattctgtggcatttaacagaattcaaagggctacttttctgttgttaggaaatagcatatgccattatcttggaaatacaaagggaggacagaatttccgctggctctaacccattgctttttaatgagtttagctatgtatatatattttaaaatggaatttataattatgatcatttggcaacctacagtttttctgtattttttcaacttctcaacttcccagtgatgggggtggatgttgaactagtcacttaaggttttgggtctaaggagtaatatttgaaacatgcagtatttagaggagatatttttgtgaatgaagagaatgtgattttaagaatactcatgattttatctaatttctgttctcaaaacttcattttgtaatatagaagataagcttgatcaaaatagtttgatcccagtataatcttttactcttctctcctcccttaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaaggtaagcactgtgtagtgagtgcacactcgtgggcccaggctcctaacctaagactggttttggaatgctccattgagggtgtgagaccttcagacgttcgcacagaagggaggccctacctgtgggtaggacatcacacattcatcaagaggtgcttttcgttatttagaagtgaagcatgtcctggggatgtatggatatttttgttttgttttactttaaaaaaaatcccagtcatagtaaaaccttccagtttagtctgcatttattcagttaataactgctggagttaatcaaaaatttttcttgtatgtcttgagatatggattaagaattttgaaacaatgacaccatttaggcaatctagtgacataatagcttcagttgatagagccagctgtgaagaattacttttcatgatctttttgaagctgtatcttatctttacttcagggaaagcccctcaaaccattttgtattctgtattacacttcagaaagtgtggaagcaaaggtcatctaatctttaaaaggtatgtaatcataaaattttttatgtcagatcttaattgaaaaatattacttaaaacttgaaaaaattacttaaaattggcaatttctttttcgtcttacaacttcttcctgtcttcaggaaatgaagaataaatatgttggttctatcagggaaaccttatgaaggataagcaaattaatgtctgtgctttacttccaaattctgacatcagaaaaccttattgttaactaatataatctatagatgtctctcaaaatgaccagtcttaaattcaaatgtcatttggatatcattaattgactatggagaagagcagaagcatgctgatttcgaaaatgtcattaatattaggattaggtcagtcttaggcaagaatactttgaataacaagagactaaatgtctagtaaaacattttagattgtaattcccagtattctgtagtattaacaatgagacttaaagtactggtgaagaaattaaatttgtccctttcatttatcttttcttaaagctcttaaagtgatcctgaagactttagttctacaaaatgtgaacttcttatggaccattaaagtggggagtaatctgctgatttttgtctagcaaccctacctctgatgcaggataatttttcaaaaccgttgttcttcctatagctgtataatagaagatattaaagaggaaaaatacttgtgtgtttgctgttagaatgaggaaaaaatacaaattggacctttttgaaaaaccttgagaaccaatttactttttttgtatgtaaatggtcgaggagttagaactagtcttggttattataactgcaggtaaacttaaaagatttaaatcttcaaaacagatatcatgtaggttttattagaaaagaaatatagattattgggtgtatagagataatctatatatacgtacagttttttttaatttttatttgcaagagcatgctaaatatcttagcctttataatagcatagaatagaatggacaaatatgttatccctttttgccagttgagaaaacactttgaattaaatctccaacctaatgaaaattataaggtgggttatagaaataactaaacaggttattatttcttaaccaaactaaaggtttattctaactaaaatacttgtaatctaagaagtctccctaaacatacaccttttttaaagtgagttttgttttatgatagtacatattttagcaacatactttagaaaagaaaagtttatttcactatcctagaactcgtgttctaatttcagatcagttttgtaggatgtataaataaaatggggacctatgagatctatgagatcttgccgtctgtatctacagtatcaaaaataagatcatttccttaacaattcttattaataacttatccatctcaattcataggaggtgacaaaatcaactgttgttctatgattttgatcataggtaggagggaaaacccaaaataatggtaccgagggcttcttccattgaaactaatatctgggagaagatttgattttcatgtgtacatatacacatacctatattagtgtttatttcttttttctaatcatgtaagaatttgtcaaagatcaggtttctgatttgtctttcatcggtatctgtatgccacattttgtttttgtttttgaagtgttcctagccagttcatgctagtccctactataaattttgtttccctggcatgatcatgctctttacctactctggtagctggagggaggtgagagaagcagtcttatgtgtttaccgtactgatttttttttagagatgggacaacaaagaaattctagcctttggagacatctagaccagcactatatggtacaaagataattcgagccataaatagaagctacgtatgtaattttaagttcttaatggccatattaagaaaataaaaagaggcaaaattagttttcattacattttatttaacccaatatatacaaaaatattattccaacatataattaatagaatgttttatgagatttttttcatactcagcattcaaaatctgtgtattttatactcacagcacatcttatattggactagccacagttcaagtgctcaatagccgcacgtggctagtaggtaccatattccacagttcagatctagacaatgagtggaattctcattttagcctcatacatgccaaaatccactggatgaccctgcgaactccccttgtttagagtttccaaatttagcagaaggaaaaaacaaaacaaaacaggatgtccagtgtaatttgaatttcaagtaaataacaaataatggtttagtgtaattttgtcccatgctatatttgaggcaaacttttaccaaagaagttactgcttattcgaaattcaaatttgactgggtgtcctatattttatctgacaacccttctctggtttaacttgagaagaggacatcatcaggctgcctggaatcttggaggactagaaaatagagcatctctttctctgcgcaggattttaataatcctccaaaaatcagcctgtaaactagaagatatctctagcccatttcttcctaatgacctagtatgtttaagacagaagaggggctcaaatggcaaggatttagtccatacatatttaaacattttacatctaaattattacattaagatataaggtttacgaaattttacaatttttgaatgattacttgaatttataaaatgtagatcatctaacagcacaacgctgctatcatttctcttgaaaactaattctcctttgacagtaaccacagcagttttcagggtcttggccatttcaaggtattttcctaccattggtttccattgcatctgtcacataaacctctggtagtcaagcatgaacacaaaatacaaggctactgaatgcagggattaggcttacttcgttacaagtatttaagtacttgtaattcttagctctggtgttgaccattggatcctgaccagttcagcaatcagtctcctaagagcttcttttacagaggaacatctttccgttttcattctttaacatttttaatgtattgattttagtacatttttgaagcatacagtcacctccttagtagtgtggatctaccctcaagtgctatagaagagactgtttgtctcgaaagacagtcattgcaccacctctctccagagaatacttttccttcacaaggtgcatgactcaagatgacaggcttacattattatttatgtaggcaggtggatgccaactgccagtgcagggtggcataagttagcgttccaaagttaagctatggtgcattccaaatccattcacacttaggagaatgtacccaagagtgtggggatgttttcaattactgcatttccttcagagaacaagaaccacaggtaagtttgtgtgtgtgtgtgtgtgtgtgtgtgtgtgtgtgtgtgtgtgtgtgagatccaataattatttctaaataagaaatttcagaatttgaaaatattgcccctcccccaaaacagtcacctgaaaggtctcaaatatagctttcggtatatatttttcttcctcactctaagaaggaaggtattggagttggtggtgatggtggagttgggatgagggagacaatttactgtcatttgaaagctgtgaatgtcacacattttcatgtctagaaatatcctgggtttatgtaagaatctgattttgcctaacctctaatgtctcaggtatgaattattttgtcagattaacacatctatataagtaagatgttcagccttgcttagctaatgtcttcaacagcaatgagtaaactaatgagttgtgtctgcatttttcacttttattctcaagactgacttccttttgtttaaaggcttttgccttatttctgaaaccataatttaaagctacaaaagacctgaaatataatctagtaccctttttacctggggatccttggatggatttcagagattctgttgaatcccctaaaattacagtcatattttgtatatatgtgtttttactggggagaatgtccatattttcatcatattctcagaggatttcataacaaaaaatttggtcgacaaccactgtgatctagtctaatgtgatcattttactgataaactgaagttgaaagaatttaacttatcttcatttgaaatttaatacttgtgaaaattaaagtttatttctttaaaattcatactgatttttaaaagaaaaatacatttaacttcaactaattaaacttgaaaataccagcctaaatgggagcagttagtttgctaatgctttcttctgttctgccctttgagtggactctactagttaacattaaaatggccttccaataaagtatgaggctatgtgataagttcttgaagatagattaaaaagaaaaggaattatccattataatttaaatccctttttctctcttcaaattctgtctccaaaactaaaactcaagaaaataggtgaataatgttatttttatatttccagaatattaaaaaagtaggtaattgccttaataaacattacactgggcattattgggacagttttaggttctgaaccctagttaaagaaattcttcagtagcctatatacacttcctgttggttttcagtgataagggcattttaaggtctttttgatcataagatgcttttaatgttatagtaggactttagaaatggtaagtaagcaagttctgtattaattagggaaactaatacctttttctcaaaatgaaggaaatattattttttctttttcttggtactaaccagtaaagtctgcctagtttaagatctagtgcatttataccataaactgaatattagaataaaaagaaatatagaggatgttatataaaagacaattattttctgaaaggagtagaaaacaaggcaacttggaacactacatatatataaatgtaaaatatattaatatacttttatatagatgatattatatatccatatatatatttttttgtttgtttgagacaaggtctcactctgtcacccagcctagagtgcagtggcacaaccacagctcactggagcctcgacctctgaggctcaagccatcctcctgtttcagcctcctgagtagctggaaccacaggtgtgcaccaagatgctgagctaatttttctgtgttttttgttgagacgggggtctcatcatgttgcccaggctggtctcaaacccctgagctcaagcgatcctcccaccttggtctcccaaagagctgggactatcaggcatgagccaccatgcccagctgtactatttatattttttatttaaattaaattgtgcttaaagattctaaaatttatagtataaagctcattatagaaaatggtattgacttctgaaacattatagttttggttttgtttttattccttcggacattttcacttaaggtagttatcactcatgcttttctgctattataaaaagtgaccagattttgcttttttatccaggaagaacagtttgtgaatgccacttgataggccacctgtgttattttccatgggtatttctaacaaataaaaagttatatttttactttgtattcatcaaattattttatgtttaatttagaaaagcttaaattcttcttaggaatatttgcaaatatttgtaaatagtttttttcaaaaaagttgaggtagatagatattaaatatttttgtgacttctcattaaaagaaactgaagcaattagttgacctcactcaattcattaaaacagtgctaggttcctggttttcgtgacattaaaaacaattcaacatctgtgtgtagacaatgactaaaactttatgattttgtttcagagttttattaccatagatattgtttaaaatagaactttcaaatacatttaagaaccattaaaagtgacttctccctgtgcctgaaagatacatgcatggcttatatctttttgtgtataaacaatttaatgtttaacttttatttcctttaagtttgcatatcaaacactcttagcaatctcatcatttatactggagtacttagactttgaaactttgccacagctacctgccacgtccttgtataggatataagtaaatatattcagtcatcaaatctatagagaactgtgagaatagagtggtaaacaaaacacattgcctgccctcacagctaaagaggagtgatggtgggaaagtggaagtgatcagaacccaatctgaggtcagaaaacaaaactacaatctatttcaggttgcacaaatgaaattttaactgaatctgagggacattagatttaatcaaaccaaatgagaaggcaaggtggtgttttgagctaagggcacagcagatgtaagagtcataaaggaagaagaacaaaacacattcaagataaaagacacggagagagggaaagatgacactgtacggtgaaatatcttgcaagtcaatattagatactagcctttgggctttagcttgagaacagtgggaagacattgacgctcagatttttttttctaaagttttttattaatgcctaatacatatagaagcattagcatactgcttcgtgaattttcacagacttagcacacctatgtgatgaacacctagatgaagaaaaacaacaatatcagcatcctaaaagttccccttcattttccttccagtcagtcctgtctcttgcccaccaagggagacctcttgcctgacttctcactgtatatggaggatattgcctacattgtacttaatataaataggggcatacaatgtgtattcacttgggtgaagcattacgattatgagatttatccatattgttgactgtggttgctaattgttctcatagctgtataatgttccgtcatatgcatgtactacagatttgcatttttctgagattgctgaatctgcatcatgaaggatgggagggtgtgaatttagtaagcttcacagtaaatctaggaaagagatactggggcttgagctagtgtggtgacaatgaggatgaagagaggtgggtatatagagagatatttacaagttagaacttaattggatgaggggatgaagaatcatacaccagagataactcctgggtcctgacttgggcaggggttaatggcagtgcccttcattaagtccaaatactggagaggaagtgggttgttgcttgtgctttagtgatacaggggattaacgaattcaatttctgatacagttaaggcatctgtgaaacattgcatagatctgctttatacaactgttttattaactgaattaatgaataaccttaccttcattaacaacagtgtgctaacaaatagttctacatatggaaaactgcaaatcttgtctagtctcactgttcttcacctctgaatctcacgagatactcttttcctaaatgtgttaggagtggttttgttgcatctcatgcttttttttctttttatttatagaatatacttcatctaaactagtgctaactttatgcaagaagagtagcacttcctaggtatatgatatgaaaggcattggtgaaatgccttcatacttaaaggcattgtttttccaacattatggtctttcctttagcacaataaagacaccttaaaatgagtttgtttataggaaataacctacttatttagtaagactttaatggactgaagtaaatattcatgagatttgggcaggggaaagaaaagaaagatagggatgaggtctgacctgagcacaaacctaggcagggtgccacagggggaaccctgaacatcagagagcaggttgaatgcacctgattttaaaggaagattatgccaaaagagtgacgtaggagctgtaaaggagggacttcacctcttttcgatgctgcctgggactagttatacttgtggaaaattttatgtgaagataactaataattctagcactgaatgaaacaaatgcctgagacctactggaacattaaatagacttttatgccagccagttatgattcagtgctatatttagaccacaaaatttgaactaaaatcaaggcagtttattcttatcccatcatgtccatggggtggagaggaacaactaagtaatcatgatcatgcacttcagtttatagcgttttctctagctttgggcattgtcacttaacagacaatacaattttaaaaattaaatgctcaatttcatttcactgaggttttttgttgttgcacaacattgtaagtatacagtaagttgttttttcttttaaatttttgcctctaattcaggtttacattgagcaaccaaatcagtattttcagaaaccattgaagttaattcatttatttaataattacttatgaaatatgtcatgtataatagtgctatagcctaagatgatgatggtgagaagtactcctaccttttgttactggcacgatggtggcgatactcagaacaaacaaaaacagtgtgataacacaaattattatatgactcgctgttttaatagtgtttacaaaagcagtgaatcccaggaaaataaactattggctacaatatcaaaaaagaaatgatggaagtggtagaatttaatttgggtcctgacaaataggcaggatttgaacatgtatggcaagaacactgcaggcaagggtaacatctcatgagaactgatgcagaaaaaaatacagcatatattggcagagtgagaaactggccagactgtagcagaaatcacaagctggtgtgaggagagagagaaaagcttcattaaggaagttttgaattactgaaaaattcaccagtcataaggcatggattattgtcttgctgtttagattacctataaatgtaattttactttactcaccaccatgtgataattatgtagggttttatctttttagaaacctgatgtgaaattacctgaaggaatgaagttagtgtgcttttaagttaagaatatcttcactcagtatccatggataggcttcagggaatctggatctctttgaaattaaagcaaaagtttggatgtatttctttttctggaggaaggatccattgcctttatgagtatgtaacagtccagaagaagttaataaaatagctcgagctctcctaacttaaaacttttttattttttattattattatttttttttttgtagagatggagtctcgctctgtcacccaggctggagtgcagtggcatgatctcggctcactgcaacctccacctcccgggttcaagcaattctgcctcagcctcccgagaagcttcatcttgggttttttattattattattattattattattattattattattattatactttaagttctagggtacatgtgcacaacatcttggggtttttttaatgcagtaaattaaaatggggaaattaaaacacgttaaatactttccctttatttcactatttactgatacggtatttaagagataatcctgaaaagtatatcagttgggttgattatataaccagagatagtggctattttatcaattccgtggctttcagtaaaaggacagctcaattgcctttttagatacagaatgtttctgaatatgctatttcaagtagaaattccttcctatttttggacaggcatatgtctgctttctgcagaatacaaagaattttcaatgtgtccagcttcagtcctgaaatttgacttacctggatcatatttaatcttttgcacaactgtttaaagcaggagtcaacaaattatatatagcccatgggccaaatccagccctcaaacctatttttgtatggcctatgacctaagaattgtttttacattttaaaattgttaaatttaaaaaaggattgtaagggattaggattttaaaaaggagaatatgcaacagagattttatgtggccctcaaagtctatggtatttactaactggccctttttttaaatgccaatccgtggtttaaagtacagtttttaagttctcctagatgcatgtgttattctacaagcagatacaatgcttgtggatagatattatttttgaagttgggagtatatttatataattttagcaaagttgactgaataagataacctgttttctatactgaatattcagctaatagtttcgctttctaaagtctggatttgaaagtgtatgaacaaagtgtggacttagtaatctacttcaaagaactatgtgaatatgaaagtagattttgtttttcatggatatattacacagcaaccacaattcagatcaagaaaaatattaaaatataatctttgttttagaagacaccacttaaggcaaagaaggcaaaagaaaacatttgtacctgttaatgagttgggaagggcagctcttaaaaattatactattcattggtttattcaacatttatacttatttttagaaccattatatatattggcttctttgtattatattttattaatattattgtatgagatactatgattctaaattttggataaatattgaaattatttttaatgggggatatgtcataattagtgagtctcaaaaaattggggcaattctgccttctctctctgcatcattatttttccttcactactggatcttttccaccaacatacaaataatgttgagttttttcccccatcttaaaaaaaatcttactcccagttctcctttagttactaccccatgtctttcatgtaaagcctatatctctgaagtatgtagttgcctgtgctgtctgaattcagttcctataacccctgccatttcaccagaattgtacttcttaatgactgccatgctgccaatcagatggtcatctcagtcttcctcttatttgacctggcaacggtgtttaacactccttgtttggccttttagatactatactacactgtcctgtttttttttctcctacccctctggctgctgctttttcaatctcttgctgatttcttcttgcctccccatctccaaattgggaatgctccaacatttggaattttgaggcctttaaaactgcatgttcactcccttagtgacttcatatagtaccatggctttatatgatcatccatttgctaatgatcagaagtcctttagtctttttttttttttttttgatatggagttttgctctgtctcccaagctggagtgagtgcaatggcatgatctcagctcactgtgacctcctcctccggggttcaagcgattctcctgcctcagcctcccatgtagcggggattacaggcgtgtgccagcacacctggctaatttttgtaattttagtagaaatggggtttcaccatgtcggcccggctggttttgaactcctgacctcaggtgatctgcctgccacggcctcccaaagtgctgggattacagatgtgagcctccgtgcctggcccctgtagtcttcttagaatgtaatatagtaaactgaattcctcatctttcccccaccaaaacctcctccggcagtttttcccatctgagtaacagcacctgctgtcttttaatcagccttggtgtcaccaaggatgcctgtcctcctttcattccacatatgataattcttcacatttctgttaccaaaatattatcttgcttctgtcccaaaaatatttctgagattcagttattgcttaccatctctactcctacaaccctgatccaaatcaccttcatctcttacctgtattgatgcaaaaagcctcctgtaattggtcttcctgttttttcctgttgacttaacttcagtccattcttaatatagcaggtaaagtagttatatttaaatataagccatattatgtcactcttttgatgaaaatcctccattgacttttcatctcaaccagaataaaaactaaagttcttaaaatagcctaccaggctctgtgctctgggctgtcattcccagacagccactgccaaccactcctgcctgctcacacccactttgctctagtcatccacactggcttctttgctgttcttagaacatgccaggcaagttcttgctttagagcctttgcactggttgttctctgtaatactctttccctgtatatctacagggatcaatctctcattacttgagatttgtacttaaatgtcaatttaatgaagctttctttagccacttgatctaaaattgcagatttcccctacttcaccccaattctccttcctgctttatgtttcttttcttgaagacctgttaccatctaccatcccatatattttacctacttttttcatttattttttgccttcctccactagaatataaaggctttttgtttcctttgttcactggtctgtcctcagcacatagaaatatagtgtttggcccacgttatacacttagttaatattgatgaattaataaataagtggaatttaaaaatagccaacacaaaattttaacatagttcagggatttttgagagctcctgggatcattgaataagcattcaaatattccagtaaatgacatgcatggagctaaaggtattagaaatatgactgtatacattggtatcattatatatgtagaactttcttttttgcacagatccttagctttgaccatttattctatttttaaagtgtggaatactaaaaaaaaatattatttgaacttaaatatgattactatttgagtatgctatgatgtgaatactttttaaaagaatcttttatcattaaaagtagtcatttagtacagtaggaatttttttacaaaaaaacttataaaataatttaaatttccagaagagtttcaaaggcagtacagagactgaacttttcaggatccttgttctgtgtcttataagttttcatcttcaaaaagcatggaacaaatactaattcagcctaccaacatagcttttgttaaagtaactgctttttaaaataatttttaaatacataaagctaccaaataattagtttcaaatttcataattattttttcttgactatatgcataactgatttaaatagagtcataatccaaattttctcaattatgacatacatttcttcatgtttcattatagtctttttaaatgactaataatagaccatcttgctgatgtatcattattaataaattgttttcttcctgttggacatcttaaggctgttttgttttactgttattaataatatggtaggtgatatatttgtgcatataacttcttgcatttgcctaaattatttcctttagctaattacccagaattagattgggcaataaaaatcatagggcttatgaggaaaatggggttggagtacagcccacaataattttgtcagtgacacatttttaaaaagacagaaaactaataacaagtgcagcacagttttacatatgttaaatggttaagaaatacataattactattatacaagtgacactttttaccttgaacaaaccctgatgtttgcttgtggaagtaggtatggaattgtgatctccaagttaatgtgaagtggtagaaggaggattatctgaaatcagaaggaaagttgtaacattgcatgtgatgggtgtggctcgtaacagaagcacggtgaactgaagtggctggtaacttgagatgtgtgcaggtgtgctttttgtttattcttatgtgacttagttaagctggcagcaattttctgtgttcacttagtgtttctcgcagataaaatcatgcataagcaaaggtgacattctctttatgctcatgtagttctctaataaaccaactgcactgaaacaaatttgcattttcaaaataagtgttatggcagaagagactccactaatttgttatcccatcaattttactgcaattttaacatcgtgctaggtttttaagcttttatatggtaatttttctgatatatttttaaccagatgcctttagaatacagtttggtgcagtcttacagatataactccaaccataataggcagtggagatgttattttaaaataataataaagcttggttaattgcacagagacaagaaaaaatggaggacaggtttcttccaagaatgactgaagccagaatagaggttagagaaaacagaagaagaaaaaaaaaaccctaaaacctgcaaagggagtttgtacctaggtagagcagtaccttgaataccagattaaagtttcaacttccagaaggcaaccaaaagtcagtattttgttgttgttgttgttgctgttgttgttgttgttgttgttgttgttaacaggaaagatgaaagaccagataaggaagaaaggccaaggaggaggacataggaaaagtgtaggttggagatggtatggttaccatccaataagaacagaaaagaaagtataaatgtaagggttttgttagcagtactatttgccttctgattaaatgataaagaagatgtaaaataaatgtttgtctaagattactccaaagtattatcctgagtggctaaagaatagcgatcctagaaaaaaaaaattgatgatcaggaagaagagctgtatgagtgggaggagaaggtattcctgaaatgatgagtttagtttgaaaggaagcctgactgagtggacacagcccctgattgagcattaagaaaatttttgattaattactggtggggccctggacaatagtatacttctctggctttcagttttctcacctgtaaaataagtattgaactactagtgactgctgaagtttcttccagctttgaaacaattgctgtgtgttttttttttatttgaactttattactgtttcttcatgattgctgtctagtgaccttttatgaagactttggtttataatgaaacaaggataaagtgctcagtcttgagtctgttggagattaaactttcctgactcctgaaatgcttgacttgacaccggaagtgccacaactgccatctcactttatcttttttctgccaaaggaagcttcttgcagatcaaaattgggagcaaggagaattggatgtataaagccaaacttggaaaaagcattctgcaatttttcttaatacaatcttttggggctctatttgttattagctgttagaaatcccaataaattatttggaaagaaattcagtacaaatataataatgttatagaagtatatgtatatagtaaatataatctaggagaggcttaccatagaaaaggtgcaggctttggaattagcttgaattcaaatattagttttattactctactagctgtgtaaccttaggtaaacagaaatgaaaagctttattttggaggatgattttatttctttctgtgtaaaatggaaatagtaatactaagtttcagaattgttgtgaggattagagacaatgtttgtaaagaactgagtatacaacctgatacttaataaagagtaacctttatcagttaccaggtaatagttattgttgcagtatgaggacttggttaaaactttttcaaattcttacctgtattaaacacttaacctacattctcctcttgtaatcagaatctcgtgtgcatgtatgtaatgatgggttctctaatattcagttttctggcagattaaaacatctgacaaaactaaagaattattttaaaaatatttagagtgtcaacatattcaattcttagatggaataatgatctttaaagagatgagactagtatgtaaaaagttcatttttaaaagtaagaatcttcatcctaattatctgctagctaagacaaaataatagaatcaacattcttacagattttcgtttacactgcctcctttaaaagatgcccaatactgtggatattaaagagtgattactagtatattatgtatattatatattcagctttccttttgtaaattgattttaaacatttccaagaaatagtttcaaactaggtacttcttaacatctcttatacttttgccttaaataaaaacacattgataatgctaattatatggtaaaactgttaggtctgcagaagtcatattttatttctgaaataataaaaatacattttaaaacagatgcagaaaatgtgaaaggtagattgctgctggaaattcacatagtctttaaggaataaactatgtacgtgttgactatgaacagactagtctatatttactatattaaattttcaccaagttataaagattcagtatgttatccttttggaaatttaaaaaatagtaaaacacattctttttaagagcaggaacaatgtacttgaagcaacaaatttatgactgaagattatatatcagtataatccttgcttctctgattgctgtgtacccttttctgcagccgttttttttttaactcttaaagtctgtgctctattacagtgattctttttcttgtttctaaaagaataaatgaatagttttttgttaataattaatgtaggcctctgcttacctgctttatacattctttacctgcctgtacgtagcacttgcctatgcaagtattcatttactgaaaaagttaccaactttgtagccttgaaatcatttaaaaaatatgttaactgacttgaatactctggttagaagcaaaatgcataccttctacttgaaggaatttgttttcacctttactgaaaaaaatacatatttagttgtattttaaacactacttattttgacatagtaatcactttatagttttctaggaagttcatctttgtatgcattttatatctcctattcttttcttgtaaagattaggttacaattaaaataattcaaagatcattgggaggtactgcattaaactgtgggttggatcttgccttttgtcttgttcaaactgcacctctccttttatttttttcaatctgaagatagtagcatgcttagagcatgaatgtaagccatgtggtggctaagatagagaaggcagagatggatgacttcagaggaagtaagtgtttgacaggagactggactgggtgatggtgtgaaccaaagtcaaggtcacagggagaaaaagagcaggctggcttcatgggtgtgcaacctgtacagttacacaaggctcagcttttttaatgttctgctactgctatgttgaaattcttaatcaatttcacacaagaggccctgaatttttattttgcactgagtctcacaaattatctagcctgttctgcagatgagaaataacaggaagcagaaatttcttgtctttttagttattaattccttttcccagattagccaaaatgggaattattttttaaatgatgacttacggacatttaaaaaaatgtggaaaattaacctaatttgaaagcagttgtgtgtgtatgtatgttatttagtaatttacccaagtattggagaggggaaaaaggagcttgttaaattttcttatggaagtgtcaaaggtggtcaaacttccaatagactttaccaagtcagtatgtaatatacatagtttgagaagtaaaaacaattggtattacagaattgtatgtctgaattacctactacgtgctgggctttacccagaaaagtgtttctttacccataaagcctgatgctttatattcagtacagtactttattatttagtaattattctttcctagtattatttctaaagtggtaattgtttcttgcctttatagtgcttgtaaactttattttttaaagattttggaaattaaaatttagaaatttataagcccattgtggtttttacacagtcctgtcagtttactagttttatttgatagctatctaatacgcacctgtttaaagtggaacgtgtttctattacacctaggctctttttttttttaaaatttaagttctgggatacatctgcagtttgttacataggtatacatgtgtcatggtggtttgttgcacccatcaacccgtcatctacattaggtatttctcctaatgctatcccccacctagcctcccacacctcaacaggccccagtgtgtgatgttccctccctgtgtccatgtgttctcattgttcaactcccacttatgagtgagaacatgcggtgtttggttttctgttcctgcgttagtttgctgagaatgatggtttccaacttcatccatgtccctgcaaaggacatgaactcatcctttttatggctgcatagtattccatggtgtatatgtgccacattttctttatccagtctatcattgatggacatttgaattggttccaagtttttgctattgtgaacagtgctgcagtaaacatacatatgcgtgtgtctttataagtagaatgatttataatcctttgggtatatactcaataatgggattgctgggtcaaatggtatttctagttgtagatccttgaagaattgccacactgtcttccataatggttgaactaatttacactcccaccaacagtgtaaaagcattcttagttctgcacatcctctccagcatctgttgtttcctgactttttaatgatcgccattctaactagcatgatgatatctcattgtggctttgatttgcatttctctaatgaccagtgatgatgagttttttttttttcatatattttttggccgcataaatgtcttcttttgagaagtgtctgttaatatcctttgcccactttttgatggagttgtttttttcttgtaaatttgtttaagttccttgtagattctggatattagccttctgtcagatggataggttgcaaaaatcttctcccattctctcagttgcctgttcactctgatgatagtttcttttgctgtgcagaagctctttagtttaattacattcatttgtcaattttggcttttgttgccattgcttttggtgttttgttcatgaagtgtttgctcatgtctgtgtcctgaatggtattgcctagtttttcttctagagttttttatggttttaggtcttatgtttaagtgtttaatctatcttgagttaatttttgtatgaggtgtaaggaagggttccagtttcagttttctgcatatggctagccagttttcccaacaccatttattaaatagggaatcctttccccattgcttgttttttgtcaggtttgtcaaagatcagatggttgtagatgtgtggtgttatttctgaggcctctgttctgttccattagtctatatgttttgtttttttgtttatttttaacttcttatttatttatttatttattattattataccttaagttttagggtacatgtgcacaatgtgcaggttagttacatatgtatacatgtgccatgctggtgcactgcacccactaactcgtcatctagcattaggtatatctcccaatgctatccctcccccctccccccaccccaccacagtccccagagtgtgatgttccccttcctgtgtccatgtgttctcattcttcaattcccacctatgagtgagaacatgcggtgtttggttttttgttattgcgatagtttactgagaatgatgatttccaatttcatccatgtccctacaaaggacatgacctcatcattttttatggctgcatagtattccatggtgtatatgtgccacattttcttaatccagtctatcattgtaggacatttgggttggttccaagtctttgctattgtgaataatgccgcaataaacatacgtgtgcatgtgtctttatagcagcatgatttatagtcctttgggtatatacacagtaatgggatggctgggtcaaagacaaaaaccacatgattatctcaatagatgcagaaaaggcctttgacaaaattcaacaacacttcatgctaaaaattctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatatgccaacaacagacaaacagagagccaaatcatgagtgaactcccattcacaattgcttcaaagagaataaaatacctaggaatccaacttacaagggatgtgaaggacctcttcaaggagaactacaaaccactggtcaaggaaataaaagaggatacaaacaaatggaagaacattccatgctcatggctaggaagaatcaatatcgtgaaaatggccatactgcccaaggtaatttacagattcaatgccatccccatcaagctaccaatgactttcttcacagaattggaaaaaactactttaaagttcatatggaaccagaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaactgaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctagacattaccattcaagacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaataaatttacaagaaaaaaacatacaaccccatcaaaaagtgggcaaaggacatgaacagacacttctcaaaagaagacatttatgcagccaacaaacacatgaaaaaatgctcatgatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatggtctatatgttttgataccagtaccatgctgttttggttactgtagccttgtagtatagtttgaagtcaggtagcatgatgccttcagctttgttcttttggcttaggattgtcttggctatacgggctcttttttggttccgtatgaagtttaaagtggttttttctaattctgtgaagagagtcaatggtagcttgatggggataacattcaatttgtaaattaccttgggcagtatggccattttcacgatactgattcttcctatccatgagcatggaatgtttttccatttgtttgtgtcctctcttatttccttgaacagtggtttttagttctccttgaagaggtccttcacatcccttgtaagttgtattcctaagtactttattctctttgtagcagttgtaaatgggagttcactcatgatttggctctgtttgtttattattagtgtataggaatgcttgtgatttttgcacattgattttgtatcctgagactttgctgaagttgcttatcagcttaaggagatttggggctgagacaatgaggttttctaaatatgcaatcatgtcatctgcaaacagagacaatttgacttcccctcttcctatttgaataccttttatttctttctcttgcgtgattgcccaagccagacttccaatactatgttgaataggagtggtgagagagggcatccttgtcttgtgccggttttcaaagggaatgcttctagcttttgcccattcagcatgatattggctgtgggtttgtcataaatggctgttactgttttgagttacgttccatcaatacctagttcctggagagtttttggcatgaacgggtgttgaattttatcaaaagccttttctgcatctattgagataattatgtcgtttttgtcattggttctgtttatgtgatggattatgttgattgatttgcatgtgttgcagcttcatcccaggtatgaagctgacctaatcgtggtggataagctttttgatacactgccggattcagtttgccaatattttattgaggatttttgccccaatgttcatcagggatattggcctgaaattctctttttttgttgtgtatctaccaggttttggtatcaggatgatgctggcctcataaaatgagttagggaggagtccctctttttctgttgttcgagatagtttcagaaggaatggtagcagctcctttttgtacctctggtagaattcagctgtgaatccatctggtcctgggctttttttggttggtaggctattaattactgcctcagtttcagaacttgttattggtctattcagggatttgacatcttcctggtttagtcttgggagggtatatgtgtccaggaatttattcattttttcctagattttctagtttatttgcatagaggtgtttatagtattctctgatggtagtttgtatttctgtgggatcagtggtgatatcccctttatcattttttattgtgtctgtttgattcttctctattagtctggctagcagtctatctattttgttaatcttttcaaaaaaccagcttctggattcattgattattttaaagggtttttcgtgtctctatctttttcagttgtgctctgatcttagttatttcttgtcgtctgctagcttttgaatttgtttgctcttgcttctctagttcttttaattgtgatgcacttattctaaaatcaaccacatagttggaagtaaaacactcctcagcaaatgcaaaagaacggaaatcataacagtatatcagaccacagtgcaatcaaattagaactcaggattaagaaactcactcacaacctcacaactgcatggaaactgaacaacctgctcctgaatgactactgggtaaataattaaattaaggcagaaaaaaataagttctttgataacaatgagaacaaagacacaccataccagaatctctgggacacagttaaagcagctcacgcctgtaatcccagcactttgggaggccgaggcgagtggatcatgaggtcaggagatcgagaccatcctggctaacaaggtgaaaccccgtctctactaaaaatacaaaaaaattagccgggcgcggtggcgggcgcctgtagtcccagctactcgggaggctgatgcaggagaatggcgtgaacctgggaagcggagcttgcagtgagccgagattgcgccactgcagtccgcagtccggcctgggcgacagagcgagactccgtctcaaaaaaaaaaaaaaaaaagcagcattaggagagaaatttatagcactaaatgctataaatttctctcccacaagagaaagcaggaaagaactaaaatcgacaccctaacctaggctctttttctgggtctctttctttctaaagttttgcttattttgtttactgcacaatccaactaaaaccaaattttttacatcatttcatttgagagttaccttttattctaataaactgtggaataactggggttggggagggaattgcttaagttcataaggattcttgcaaacttgaatgtgtcgatacaagattttttttgaaaatttgtaattccatttcacgatctcaaccagaattcattatgtttaaaccacctgatatagactaaaacattttttcaggagcacaattgtaaaaaggatgcagagaaatatttacaacattacttatttctttgcagatttagtgaaagtatgtcctacttttacaaaatatcttattttcctctcttttttacacatataatagagaactaacttttataaactaaatgagaagggaatactaatttttaaattatgatgtcacttgtagaatttgttttaaaattgataaaatacacctctttttttattattatactttaagttctaggctacgtgtgcacaacatgcaggtttgttacatatgtataaatggccatgttggtgtgctgcacccattaactcatcatttacattaggtatatctcctgatgctatccctccccactccctctaccccatgacaggccctggtgtgtgatgttccccttcctgtgtccaagtgttctcattgttcaattcctacctatgagtgagaacatgcggtgtttggttttctgtccttgtgatagtttgctgagaatgatggtgtccagcttcatccatgtccctacagaggacgtcaattcatccttttttatggctgcatagtattccatggtgtatatgtgccacattttcttaatccagcctatcattgatgggataaagcacacctctttaagactgcttatagaatgctatggactcattggcttggttttttatttccttggtttcagtccaaagtgtaataagcttttcagaaagtttctcctggatgtgtaaagaataccaacagatatcagaaagcatctggctgaaagtttaagcagggagtattgttattcatccagcgaaggtggtaaaactctcctgtatcctcgaagtataactaactgagagagagaggccctatataaagccagctgacttaccctgcaattgcttgtctggcaaacagacaatttttaaagactcatatatttaggaatttttaaatgccatagaatcgatggacaaaatgattttcatttatcttaatccaaaatcacaagattgattatatacttaggttatatggaaaatcagcattagaagcattagttctacacctcatttgcatgacattattacaagatattaactgtaaaaatgaagtaaatataatatctgttcaccagatgcctaaaacatacaacattagtatagacatatagaaggatctgcaagcaactaaacaagtagcgtaaatcaaagaatatactgataaagtggtaagtgccttttgggcttcttaggtaataagcccttgtatctgccagaatagtctagcaaaaaatgcatttttttctttagcctagggaaacttttcacaggagatggagttttaggtattgtgtagatgatgggagaaattgcttttgataagcttcagtgaaaaaggaagggaatgtgtcattgcagatagagagggagagaaacactggtagttggtcgtagactggtagtggtgtagaaatagaaagcaaaacctattggacaaaggaactgaacagatttgttaaaaaggaatgagacaaacagatatgaaagataaggagtaagctgatacaggctggtgagctcactgatagcagagtccaccaagaggcatttagtggttttccttcagggcaaaaagtttgaaagagaaaaatatgatctctaaatagggctactcataaaaaatattgactattaagaatatagatacagtctgtatctttaagactgcaatttagtacaatttaattttgtttataggctaaacatttttataatttcatagcgattaacttgataaaaaagggaaaatttcttggtctttctgccaatctgtgtttctaactgaccctaaacagctctgttggtttcctgctcatgcattagagcttgtccatagccacaagcccctcttttcctgtcagccctgcaaagaccgccccttccaaattgccttctcctcttgatggcacatccaagcactagcaaattcggaatcatttttgacttatcgtttccttttaccctttttaatcataggtacaatcttttgcaagttgctttatctctctgaccttagttttttcatatataacatggagttaataaaacaatattgccattttcagaattcaataagttaatgtgtaaaagcacacaacatagtgcatggcacataatagttgagctttaattgtacatgttacttgttttttctatcttctcaactggtaataataactctactgaataggtagtaatttaatgaaaaaaattaaatgcattgtggtgtttgccaaaatttttggtttgtatgtatacactggattacagttttataaatttgtcctcatgaaattgattgtcaggtgttttctctttagttgttttgttaaaaggttaattggagcataacaaatgcatcactatcttatgtagctcctataaaaacataaatactttaaaataaatttgaaaattagaggggctactacatgcaactgattatagttctaattttagttatgaaatttacttctcaactaaggcacaatctctaattctgtatctgcattgatgactcagtgattttagaggttgtgagttgatattttcacatttctacctatggtaactcattacagaatgtctgatcatgatatcctgttctgtgtagcatcatagtggacacttcatgatatttctgctaaaccctttacctgtcataactgtctcctttctgttttgcaaattccctcagcaaagtcaaattcagtcctcacttggttataaatagcattataaaccatatttttgatttaaataaagcacacaaatctcaaagaatgataaaagcattgttcatactttgtaaaacttaatcattgattatagattaaaactgaaacaacatgaagggatcagactcactcacagaaggttattgagaaccaggaatcatagatttcattcaattcaaattatcagttgtacattgttgcttgttcaaaatcattttacaatccactttgcccacctccatcttcttacgttacaaagaactttcatctgctaggcactgctgatggtagaatgccatgcctttaaggtttccctttggaatataaagtctatgttttcaatagaattaactgttcgacagagagagaacaggatttctgtgcaaagatggtacagtgctagtaaaatatatagcccctttactgtctacattaagcaaggatgataccctaagaattctagctgctgctgttgatgctgctgcaactattactactactacttctactaatcacgagtatagaaaaatatctctttgatcctgtgtgtgtggtggtaaggttttgggagaagccattatctatgggtggtggaatcacatatattttaaagtcttttcgaccatgttcgttttctaatttttctcaagtaaaagattcttctatacttttaaaaaaattataatttaaaaaaaaatcttattggacttgtttaaattatcagatatttttcagttatgtaattggtttctggcatacatagacttttatcatttgctctgctttaacataccttcatcagttttataaatacagttcgaaaggattgttctaaatatatataaagggaaaacttcatttgaaagcaaaatctgtatttgggatatttgttgtcttttttgccttctaaagggcaatctagaaacactaatattgattggttattttgtttcataatactttatagctgattcttggcaaaaatggttgatttctctttcattgtaatacaataataaaaaagttactcagaatttctccagtgttttaagagctgtccaggttgacatccaaaaatttaagagagcgttagaacatgggatatctaattgttaattgagactggaattatttctaataatcttagttgtaaatactaatatcttattagtcttcttatctttgctggtataaaaatggttgaaacatttgaaattattttctcagttacagttttgccctgtgtagaagtgtgattatctaagaagtgattttttttcagatttcaaatatgaagtgttgtttaatactaacatatagttacaaagactatcgtgactatttttggtgttcttgattatgatttaatacttcatactttaggaaagacgatttagttctaaatatatttataagtgagttcctaattttttgtgtgctgtagacttctaagctattgatataattgaatgttaagcattttcattttttatggcttactactttaatgcaaagcagaataaaatactaatttatttcttaccctcagatgatgttgtgctgatgtatattttccagtcttgtcataagctcacaattacctacataatggtcttgaaccaaacgattaaatggaagacaacatttctggtcttccattttaattagtgtggtgcaagactattatgtaggtttttgtgtaaaatgtggaatgtgaatcctcaactctttagtcattcttcctattagatattgaagcaaaatttaaaatatgccatttgactaaagatatcaaagtgctttataaagatattacaatgtacctaagtcctgttttagagcaccagagagaaaaatagaagcgcatagaaggaataaattcagttgcacattttgtatttaatccaatgactcaaaaacatgggcacatatttaccaaattaaacgctttcatcaaacatcttcttgatcataccataaaagcccccaaagtttttattggtagcattgctctgattaatgaaatgagcttcagtgcaaaaacttgggctgttagaatacttacaaaaccattattgtccagttctatagctgctaccctagtccctggctctcatctttttatacctggtttaccacatcagcatccatgctgagaaccatgcctcagtcttgcactgctcaaatacatttagtcatgaacttatttattcagcagacctttgaggacctacaatgtgccaacaatttatttaaacaatatttgtatattttccatccccaggctaggacttatagtccccagttggttatcaaatctaaactaaactcagcctaaaaatttagagttctccaaatctcacttattcttgttctttcatgccagtctccttatggtaacattcattcttagcacaatgtgtgtctgttcccacttcttgtcctagtgcatcatctttcctcttcaaggatgtactccttctcctccttaaaattttaaaaatcatagctaaaactaccctgtgaggtgtgaggtttaggttggtgtagtcatctgacttggatcattctttttattctggatcctgagagtatctagaggaaattgcgtattctggttaatgagtggcttatcacatactgtcttaacaacactaagcactctttattcagtaaaagttcacaccataagaaaatatattgtaatgtatttagtgcttcttcggtgatatataaggtgttctacttagaaatttagatttgtaggaatgctggttaatagaagtttctaatatttactgtcttccatatttcctgatgttttgtttattttaagctattttaaatattttgcatttcatatttttaaccaggcagtatctctgttcctcattctgaacacccaatatggtactttgaacataatagggtttcataaagtgcttgattcagtaaaaaaaaaaattgaacatctactatgttccaggcattttgctggatttctggactacaatcatgaaaagacagtctattctctcagcctgcttatagtctagtgggaaagataggttgacagacatccctaatatagtataagttcttgaatacaggtaaatacaagagtatagagtacctagtctcttctaggagtgtcaagcaaacttttttagtagaagcagcctctgcaccaaggagggaattaggaaattttagtgcctgataatctccttcagtctcctaaattataccaaatgaaacaaagtaacagtgtgtgtttgctatgggaatacacctggaagtcaaatatccagcatgcactccctaaagagtgccaccctaaaccttcccatgtaggaatgccagcgccacctctgagaggaagggatggctaaacagaggcaagcagcagacaagagcaggaggattcctgcaaggggaatatgaacaaatacccagtggcaaaaacaaaacaaaacaccaaggggagttggaagaagtcattttccaaggccagaatgtagatttgtttggacggagtggatggggggatataggcacagtctttgagctgcagaagaatgccaggagccaggtcttaaaggattttaaatcagtgattttttaaaacctttattttcttaacagtagaattcttaagaattttaaaattttaactttagctcaatatttaaaaaataaaaacagaactagtttggttttgatgttgtttaaggtttattttgctgtgcgttttggtggggtggtagaagtgttagtttccttggttgcttgcttctctctgtactctactgaggttaggaattgtgttctagagtcacatcatgttactaactggggctttgtgttctgactggtagtagcaataggtttcaccctttgtgattgagtaggctcctaggaatttactttcatctattcaacaaaaatgtgtatacaggttgagcgtcccaaatctgaaatgctccaaaatctgaaacttgttgagtgccaatatgatgctcaaaggaaatgctcagtggaacatttttagatttcagattttcagactagggatgctgaaccagtaagtataatgtacatattcaaaaaaaaatctgatatccaaacacttcttttctcaaggattttggataaggtatgctcatcctgtattcttagtactagtaatgtttctctgagcaaaatagacacaatccctgacctcatggagtttccagtataatgccagagatggatattagaaagtaatcctgtaactataagctgtgagataaatgctgtacagaagaggtcacttacattgagagatctgtaaagaaatgacatttagatagaaacttaagtggagatctgaacaatgagctggtggtagacagtggtgtaggcagaggctgtaacatgcatgaatgccctggggggataaggtttgtggcagcagtaaagccggagagggaggtagaacccagattatggacagccaagttagggatttcgattttatcctcagtgtaatgaaaaaatcatcaaaaggttttgaatagtggaataatataagatgacttgttttattaaaatattaattatactatggctaatgtgtggagatttgctaagagaacaggtagaatgagtgagtatggggacatcagttacaggagtcatattctcatatccgccacatagtgggcactcattcaccattttgtggttagctgaatgatgactagatcactgcctctgttgtaacatctcaaattatttgcactttaaccatgagttaagttggatatttttgaggaatcatgaagtgttgctgatttgtactaatttttcctcataaaactttagatattttgaactgctgcttcatcttgccaagggtgaaaacaaagcatttattcattcattcgagaagtgcttaagctgtgccaggtactggctgagagctgaggatacagactgaatgaataagttaggcatgatatctgccatcaagtggcttgtagtctgggtaaccagagctgagtagagcaggcggtatgttggcctcatacctccgaagtagtatgtctggaattagcctgtctgtagtcccagcctcagtatctggaatatcctaggtgaagatgagatctcttaacaatttaattacattttctcctacctcctctttgttctaatgtatactactaaatttctacttcgatgacctttgctgaaaatacagccactcttaagtcctataacacatgtgcccaggaccggacaacctaaaaattaaatcctgattcttctttactcttagaaaagctgggaccttccttaatggattaaccttctattgctgcgtaacaaatgacaagaaatttagtgatttaaacaacacgtatttattgtctcgtgcttccatgggtcaggagtccaggcactgcttagctggctcctctgcttaaggcagcaatcaaggtaccagccaggctacattctcatatctagctcagggtcctcttccaagatcattcaggttcttgacagaatttgttcccttgtgcttgtaggaaggttgcttctctccacaggcagttcacaatatggctcttcaccttttcacaagtggcagaatagagagagtttactgctttgcctctctgaattcagggaaggcctaactcctcttttaagggttcacctgattacatcaggctctcccaggataatctcctttgataaacacaaatagctgtttgggtaccttaattacatatgcagaatcacttcacatttgccagataacataatcacaacagtaatattccatcatattctcaggtcctacttatactcaagggaaggggatgatagaagaccatggatcattggaggtcagtcatcttagaattgtggccacctcacttgctttttagtaaaaactctcacatcttttagtttccaacaagtgatgcttgtctcagtctcattatatctttgatgacttcttcaccattctttctcttccttcattccgtagatatcgagatttctcaaaacatctcatcaacagtccagcctgtttcttgaccctgtacctcttatttttcattggctgaggaccaattttcttgttctaaaaataaagctaagagcaggcacttttttctccagtcatttgctgaaaaacataaactcatcagataataaaacaaatgctgtttcttgcctgccttgtaccaatttagggagaagcctaggggagagtgactgattttagctccagccactccaggtagggaaaactgtgcatggatgattgggagaaccttacttagatgggggacaggcagttgtgttagtgagttctagcagatgcaccctccatggcatggaggagtattgtccttttatgccagggtaccttagaagagtatcggtgtgggttgtgacttatgagaggggctacacatgcatgggttgggacaaccatgtggtattaatctaccagtggtttcaagttatattgataaaacaaatacattcttacaatttaagtgtagcctttacacctgaattcaaccatctgctatctagcaaaattcagtatcttgcaaacttaaggctgtcaggcgtctgctgctaatttaaggatagcttggtggaatttgcatggagggagcagttctcttttctctttctgaaatgaccttcatctctctttttatctgattggtttatctgttaaaacccagcttaggaaaaaaaaagcttagacattgcctccctgctaaagcctttccatttctagaaacctatctccagtgtccatccttgagaaagtcaatccttcttttctctttgttctctacctggattgaagttgtttctgtcaattaaaactaccatattttattataatttatttacatgcctgtctcctctactagtgagatccttggggatagaaactgatttattaattttcttaactataaagtgcctgacctgtgacaaaagctcaatacatgttttgagtaaatcaatcactgcaccaactcaaatcacagtattccccccctccccgctgatttcaagtgaccacctctgatccccttagacacaaacattgaccctgattaaacctgtgtttgctttgatccatagatacacatttgaactacaggccatcctttctggacggggttttgttactctggcctacagttctttattctttttctccccactgaccagcatgtattaaagtcacaagaccagtctttcaaatagatgttttgaatggggcaaagccttttcatcttgaagccctgtaagtcactccagagagtgtgggaaaagcaaagtgcttggcatagggtacggtagtagcagaggatcttaattatagttcttcacatttgagtgaagttctgaagctatgaagtagaaagtaggaattatcatctcagttaccttagttttgatgtgtggaccaaagaaaatgttcaggaatcttcatattgtgaaatgtgcagtacatgtttaaggttgtagaatattggctctaaggagaattttatattcattcttaaaagagaactaagttagagacagtatcttcagattattgtttccccaaagacccttacctggttttactgttgaattaaacagtaaaattaaactgttgagttaaacagcattaaagatggtgcagtagcatcattagatgcatggccttggaagaacatagctttcatatcagaaatgtacttttcaaaaaatctatatttccttttaaataattttataatctcagctttcattttagagttgggggtacatgtgtaggtttgctatgtggatatattgtgtgatgctaaggttttgggtgcaaatgatcctgtcactcaaatactgagcatagtgcccaataggtacctttccagcccttactccttttcttttgttcccccctttggttgtccccagtgtctgttccaatctttatgtctatgtgtgcccaatgcttagctcccacttagaagtaaaaacatgtagtatttggttttctgtgccagtgttaatttgcttaggatgacagactccagctgcatccatgctgccgcaaaggacatgatttcattctttttaatggctgcgtagcatttcatggtgtgtgtgtatatatatatacatgtatatatataaatgtatatataaatgtactttttcatgtgagaattcttccaataaaatattgatgactgtggcataggagtgtaaaattagaagtgcttcatatggatacaatgcctacatttcagaaatcttcatgcagctcttctggaatgtgggcaaattagtctcccggttttctctatggtcaaccattttctattatactcaccttgtcagaagatatttaatttaccacaattaactaaaagcttttgtttaaaaagtatgtcttatggaaaacagaacagaggtgactaattttttgtgtgcagtaaatgtttttaagtaagcatttctacaaccaggtgaaggaaatgattaagtagaaattgggacttgcatgtaattttttaaaagattgtgaaacttgttaatattatgcatgtatccaacttcttttctattttcaaattattccagtaacaaaggtttatgcaataggtatactcccaaaaggttgtgttactatataatgcaaatgcatgaggatcagtgtttaagcaattagtcaaaacctctaatttacctcttcccaaacgtaatgtattatctcttgagttatctataagcggctagttgtaggaaaaaatgagaaaagctggctatatagcaagtttgttcatccagaaaacttcagggtttttagtttgaaaccttcatgagaaatttttaaatagttaaaagcaactgtaattgtagctacttgttatcagttgttcttcaggcctagttcttaaaagagaaattttaggagtatgctactctaatttcagcagataatcatttaagatgctgtcatgatagaaaacgactccagaataataaggatagtttatatgtttcttagagattctgtaatgatcaatttttagaaagtatacttcatacaaagccaaatatttgcttttgtttttttgttgttgttgtttttcttttgtttggttgatttcagccaaccccatttaccccattatactcaattttaatttaattgttttggaaaatgttcttccatttcattacaacattttacgttttctctaatatgtgtttacgtaaattcactttgaagaaatgcatttataccatcagctttatggagttattgcaaaccaatgccatcatcagtgagactataaatttttttttgcagactagtcttttcatcatgactttgcataacattgttccagctagatcaacaaattgattattatattttactatatcatgaataatgcccagaggcttagtaatatgagtgaaacttactggggatgatattttatttaagctgctatatttaaatggtgctgcaatttaggtattccattgaatctacatatagtgcatacttgacatagttaagaaaaggttttgttacttttcttatattgaatatttgagtaatacacagttctgttgtacgttaggatttgagtcccttatgtacaaaaatatttactaccttctttgtttcatttcagaatgaccttatttaaaagtgtatgaggctatttataatcaactctgtggaagtgattaaagaggtgtgaataataggttattggaacttgacagctcatagtttgctaaactagtgttagaacatttatgctgctcagatgtaccttattttccttaagtgagaatttctgttttgacatgtggtttgttgatataatatattgcataggtttttctcttttaagtggtttaccaaatcttgatattttattgccttattttacattttcagcttaatcaacattttatgcttaataagaataaccttggtacaggctataaacaaaacagtcagtatagacagagtacggtccttaagtggagcatcagccttccatttcaagctatcctataaaataaatacaatcaaattttttttaaatgggaaaaaaactcttttcttacagaaaatttgaaaacatttggtaggttaacattcagcagttgttactctgggaggaatgttagaactcctgaagaaatttgggatagccaatatatccataaaaagaagaggtgtgtatttggtatttcattaaatctttactaattttaaatacaaagaccagaaaaccacgaatttgaatcaattgaatttgagttagacagcctttttatttgagaataaaaagaaatctaggaaagcatttttaaaattttgaaaccattacttaatgagtttccactgttctcatggattcagagcattgtcatttggtagtactctcaagtattctcaagatttactaaaatgcattttaataatcgcaattcagttttccctaaccagccaggaggtaatgtttctaaaaagaacgtggttgggaaaactgtggcagagaaaatcaggcctcatagacaacaaaggttagagaaataaaagtaaaaattactgtgtatatattctacaataaacctgagaaattctttataaaaaaatccaaaattaaccacatttctcaacatgaaaaacttcctagactaattcatcactggacccatttactcagttgtgattttagcattagtcacccacaaattttgaattatgtaaattacacccattttaaagtttttgaactatctggcttgaaacctaatttttctcttgatttcctcttgtcttatttttcaagtctgagaaattattgtgcagcagtctatattttggtggaacttaagggtatatttttctagacctgacttcatttattaaaaagttggagtacaagtgtttatgaaaggatggtataattgtttgaaagtatcagttgtatatgcatacatataaatagcccaaatgttttataaaaatgaagtgtgatgatatattcaaagaacgctgcaataatttatttttggagtaccatggtactttggagagaactctagagacctgtttttaatccttttcttctaattactctctgtgtgaatttgaatagtttgcttagctttactaagcttcctatatcttttccttaaaaagtgatgataataccaactctaccaatgttacagtatgttgttctgaggatgttctggttaaagtgctttgtaacttgtgaattgcaagggaattgtaagatttgccaatgttgcacttgttgccaatctgaagattcaagctataagttgaatacaaagtatgtgacctagagaaaacattactctgccccctaccctcatcccacccccatgactcaggttgacagctattcttagttaagagatacttggggaaaagaggacagtttagagaacttcctgtaggtattcattgactcgtagttccttttggccttctcagacacttttcttaaaagacagttttatatcggtaacctcactctaaagtctgtagaataatagcacattctgattatagagtcagtctaactttataacgctagagtagtacagagaactctcatgttgtttaggttttccaactggggacatcctgtgatctgactgttcctagtgcacaagctaatcccacccatatcctgtttgtgagtaattggatggatgcctggaaaatctagtgccagattgtatagtgcctttacaacagaaatctctagtttgaattgatttaccctctacctaaacaaacacctctcataggtgagcctctactctaaaaaggcaagattatataacatagatccctagttcttgtttccatagtcatgctttggatggtactcccattgatctggatcagagacatatgtaaaatacaatttcagggtgttgtttttctgtataactgaagcagtagattttgaattgtatacctcttcccatgaatatagaagacagctttgtaggaaaaaatttcttcttaaatcatcttttttatctaaattattaagaataggaaaataccatttgcatcattgtagtctctcttacttcttgggttctctttacaagatatcaaaatatgtttaaaaaaaaaacccggatgcatataggtgtgtgcaagcttgtcgtaattcaaaaaaaaaatccattgttaaatttcaaagacgtgtaatagtgctagcatttactacagcattgtgataaagggcacaagctctagagtcagtatcctggatataaatgctaaatccaccacttactgaagaattctaccaggcatggcaaaaataaaacctttcttctaattgccatattcttagccataatttgtgaattattcaaaattaataatttgttttggaaccccaactcagtaggtataagccgaaaaagggaaggactgaaaagtatgaaaagtgatagcttcagtgagccctggttgataccagggctcaaattatattatgactcactctctttctctccccccacctcccttgtatttcttcctccctttcctctgtctgagacatagggcttgaactgattgctttaaaaggcaatgaatcttggccaggcgcggtggctcaacgcctgtaatcccagcactttgggaggccaaggcgggtggatcacgaggtcaggagatccagaccatcctggctaacatggtgaaaccccatctctactaaaaatacaaacaaaaaaaattagccgggcgtggtggcgggcgcctgtagtcccagctactcgagaggctgaggcaggagaatggcatgaacccaggaggtggagcttgcagtgagccgagattgcgccactgcactccagcctgggcaactgagcaagactccatctcaaaaaaaaaaaaaaggcaatgaatctctaatggttgattgtatttctgtggggtcagtggtaatatcccccttgttgttgtttctgattgtgtttatttgaatttttggtctttgtctagctagcagtctgtttcattaatttttttcaaaaaaactagctcctggattcgttgatcttttgaatgttttttcttgtctctgtctccttcagttcagctctgattttggttatttcttgtcttttgctagctttgggatttgtgtgctcttgattatctagttattttagttgtgatgtcaggttgttaactcgagatctatcttttcgatgtgggcatttggtgctataaatctccctcttaacactgccttagctgtgtcccagagattctggtacattgtctctttgttcccattagttttaaagaacttttttattatgtccttaatttcattatttacccaaaagtcattcaggagtaggttattcagtttccatgtaattgtatgagtgagtgaatttcttagtcttgattttgaatttgattgcactgtggtccaagagactgttaagatttcagttcttttacagttgctgaggagggttttacttccaattatgtgagcagttttagagagaaagtgccatgtggcaatgaaaagaatgtacattctgttgtttttgggtggagagttctgtaaatatctatcaggtccatttgatccagtgctgagttcaggtcctgaatatctttgttaattttctgtctcagtgatctcatattgtgagtagagtgttaagtttcccactattactgtatgagagtctcagtctctttgaaggtctcttaagaagttactttatgaatctgggtgctcctgtgttgggcacatacatatttaggatagtttgatcttgttgaatgtaaacctttaccattgtataatgcccttctttgccttttttaaaatctttgtttggtttaaagtctgttttgtcagaaactagaattgcaacccctgctttttgttttgttttgttttccgttagcttggtagattttcctcattccctttattttgagcctatgtgtgtcactgcatgtgagatggatctcttgaatacagcataccattggatcttggttttttatccagtttgccatcctgtgtcttttaattggggcattgagcccatttacatttaaggttaatagtgatatgtgtggatttgatgctgtcataatgatgttagctagttactttgcagacttgtttatgtggttgactttatagtgccactggtctgtgtacttcagtatggttttgtaggatctggtaacggtctttcctttccctatttaatgtttcctttaggagctcttgtaaggcagatgtggtggtaacaaattcagcatttgcttgtctgaaaaggatcttgtttttccttcacttatgaagcttagtttggctaactatgaaattctgggttagaatttatttaagaatgttgaatattgactcccaatctcttctggcttgtagggtttcggaggccattatccttagcaaactaacacaggcatactgcatgttctcacatgttaagtaggaactaaatgatgagaacacatgggcacacagaggggaacaacagacactggggcttaccagtggtggagggtggaaggagaggatcagaagaaataactaatgggtactgggcctaatacctgtgtgatgaaataatctgcacaacaaaccctcatgacacaagtttaactatgtaacaaacctgcacttgtacccctgaatttaaaagttaaaaaaaaaaaaaagccagtgaatctgttgtgaatacttacaggcagaactttttttttttttttttttttttttttgagacgaagtctcactcttgtcccccaggctggagtgcaatggcataatctcggctcactgtaacctccacctcctgggttcaagcgattctcctgcctcagcctcctgagtagctgggattacagcctgccaccatgcctggctaatttttgtatttctagcagagacagggtttcaccatgttggacaggctggtctcgaactcctgacgtcaggtgatccacccgccttggcctcccaaagtgctgagattacaggcgtgagccaccacgcccagccataggcagaacttttacttgagggaaggattgatataagattctgacattctgttttttatgttctttgtatataattgcatatgattttgaaatataaatcttttgaatttcttattaaacttgtaaatgatgtttgtaatcgtaggcaatttaagatttcgtactagttaaggtatagactgttagaatgaattcagggtaaactgtgtgtgtttgtgtactggggaaactgtgtagtggtagcttatagggtcatctgttaattagttactgagataggcagtttatataaattgctcattcagtccttaaaaaatcttataagtagttattattctcccattatatgtgaggaaaatacaagaaactgcttccttttgcaaaccaaacactgcctttaaacttagcatcttagactgccactacctgcagacatgactagaacttattaaatattgtcttttttcagtttaatagttacttagtaatatggcctttatctaaatttcctaattttgccatgttaaaatgtaatcctatttgaactatgaactttgaatttactttaataaaaataatttctaccactgctaatacaatgtaaaatttttaagcttagcttaagattaatgttactttggaaataaattgctacacatttacacacataatttatataggaaataaatcagtctatggaaatatatttagattataagcctttttagctacagaaacaaaattgtttagaatgaacttacatagcaagacaaaattgaaaacagaggctttagaagctagtgtaatataaagtttacaatttacaaaaattacttcatttaaatagcagttatttttacttactttcattgaagaaataaaatcctatgattcaacttacagtatacagtctttttgcatggagggatgattttgtaaggcccaaatcagtactgcttaaatcagtacaaagagtgtatttgttttatggatcatgtttctggttttttcacccagaataaaactttaaaaggaaaaattttcttctgtttccaaaaggaactattggggtatgtggaggggttgatccacaaccctaaactggcagagagcttgggtgtatatataagcagctaatctctcacctagttccaggtacatatctttgttgttgaccagaaaagtgcctgaccagaagtccacatacctctcctgttattttccttcctataaatgtggccttgcctgccagggagcattgccttaaactaaactggaaataagaagcagcattcattatactatacacttgatcttagccaaaaggccaagaagcaatcattcattatactataaatctctattgtatgaggagtaatagagggcagatatatcactacaggacatgcctagtatttttacatcccagagtatgttgcagggatcctagtatgtaaaaatctcagaagcataaacaaaatttattttaaattttagttttaataagcttttttaaactccgcatcctacttttagtgggatataagggttattaaatcacacttcaaaaagttagaaaccctacaaaggccatacagaaaataaaatcctctgaacctaggtgctactaattcactcaagataaatttaatcattttattatttatggatataatctaatggaataattttaatactttaatgaaaacattactttcaatcagatgtacagaactcacaggaaaacttgaaaattcttaattataactgtaagacctacgtagtataactaacagataaaaggattgtctttaaatctttatgaaaacgtgaaatgaagcaacataaacattaattcattgacaaaacagtttattttaaacacgtaagaacagaaaaggtggagacttggtggttgtaaatttggacaggaatatattgaaatatcatgtgtatgtggatacagatatcagtattctggttactgccctcaaaaagcatatgttctttttaaggagttaacaaagatatgataaaatactgaaagaataataccagtgatacttagtaagtgctaataactaccttcagaatatagtatagaccaacactgtccggtagaactttcttggatgaaagaaatgttctctattttatctaatagccactggctacctgtggttatttgagcacttgaaatgtatgctgtatgaatgaggaatttaattttatattttatttagaaatttaattaactaatttaaggatagacatggtggctcacacctgtaatcctagcagtttgggaggccaaggcaggtggattgcttaagcccaggagtttgagactagccttggcaatatggcaaaaccctgtctctacagaaaatttaaaaattagccaggtgtggtactgtgtgcctgtggtcccagctactcaggaggctgaggaaggaggatgtcttgagcctggaaggttgaggctgcaatgagctgtgatcatgccactgcactccagcgtgagcaacagagcgcaataccctgtctcaatttttttttaattcagtgtgaatagatacatttgattagtggctaaccttattaaattctacaattctcaaaagatgcttgtctcaggaacccttcatttaaaagtgatttacggccccagagtgcttttgactatgtgggttatatttactgatatttacagcattaaaaatagaaaaattttaaatatttattcattcttaaagttactacatgttaacataaaatatctttgaggaaaagctatttttaaaaaagagtggcattgttttacatgtttacaaatctctttaatgtgtgggttaatagaaggcagttgaattctcatatctgcttctatattctagctgttgcaatgtgttgaactgtattaaaacctaacctcacatagatagttagttggaattagcctttttagataattgtggatattctttgattaccaaaactcaccaagtagcagtttcttaaagtttagttgtgatgtaaaatataaaaccatatcaatgaattttatagttacattaaaaaatcactgctctcttgaactttgagtgggccttttacccacttactaatttgcaacatcatgcattagttatttggaagatattggttcactgaattgtccagatcttccaaatgttgacacattccattttacccaatcaaaaaatcactaatagcagcaccaatctcttcagaagggtcttcaaaattaggaaattgcaaaattcaactcagctgcagttaacatgttttccaaaattctcatttacatctgaaagctcaaattttattggcaacaaatttggccaatttgtcttcctttaaatgacaggcttatttggcttatttttgagaaaatatctgccaaatactcaaacctgaataaccattgtttgtcagttggttattctttcaagttaaatagatgtaccatgaaaaaagcagctacttcggtagcaacttaattccaggagtgattttccataagacatctgttatactttgatgtccagcagaagtgttttgtgtatacatcccattttgttgtacagaacactaaaaagacatacactacagggtcaaaacttattaaagtaatttttactacttcatcaaggatgtacttaagtgaaactggcaaattttttaactggaaatgagtggcagtgagggctacaaggatatagtttgctgctgctgccttggtaagtgctaagatgccaacagtttgacctaccattgtctttgtatcatcagtgcaaatgccaaagaagtgaaaagggcaagtactgccttagtattattataaaaatggttttgaccttgctgaaaagacaataatggaggaaagaaattgcttttagttcaaataagttaaagaagactccatgataaagatcaatgtaatatgcatgccctactttatttttctttacctgcttttttctataaaaataaaagtaggaaagcaattagcatgttaaaaattatttaaccatgttacttttaaaatcattctttgattcagcaattatttattaactattttgcataagttatttttgttgttgataagtgggcaatatgtaatgtttagaataatgatcatgccaataaagcatctgtgcccccactataaagcactgctatgtgctgggcactgtgtttatgtgcttttaaatgcattcacggaatcttcatggtaaccttaggaggtaggttttatagaaagttaactggaattagtgccagctcacaatttttatataactagataaattacttaacttatttggatttcagttttctcaagtataaaatacgaagctgagacatatcttcagatgcttaaccaggcttaaaattcattaaataaacatatatttcacagcaggataaccctttattgacacattatcagaatactctgaattttattaggaagccataaaaacaattaccaaatcattaacataaactttttgaaactttatgtccctttcattttaaaattcgttgagtcaatacatttttcataacacttaatcctttactgacacatgatcagaacactgaacacttgaccaaagacctaatgatagatgtgaacataatgtaaacatgaagggatatagtcactattgtagcggaataaaaaataatacaaaagcgcaaagaacaagagtcaggaaaggtcaagaagagcatcaataaagcagcagtgttttagtttgttcattagttcaacagatgtcttatatgcctttgttatgccctgtaaagcttggaatttagactactggagggaacaaaatgatgtccttgccctcatggagcttacattttagtgggggagtgtggtaggtaggatagtggcctcccaaatatgtccatgtcctaatccctaaaacctgtgaatatgttacattacttaaaaaaagattattaagtagcaaaggaatagggagattacttcgggttatgtggctaggcaaaatgcaatgttaaaagtggaagctggagtttgaagaagggtcagtggcagaatgatgcgacatgagaaagtttcaactggccatttctggctttgaagatggaaggggccatgtgccaaggaatgcagcagcctctacaagctggaaaaggcaggaaagtggattctcccctagagtctccagaaagaacacagttctgccaacatcttgattttagtccagtgagacccatattgggcatctaattgtgaaataataaatgtatgctattttaagcctcttagggatatgtcagtttgttacatcaacaatagaaaactaatacagagtaaaagaaagtaaacaagtaactaaacaagataattacaaactacgatggatgctttgaaggaaataggatgatgtgaaagagtaaaggataaagcatgttggtttaggtgatcatggaagtcttctttggaactatgacactggagtggaaaagaaagacccagctgtgtggagttggaaacagaatctcaggccaagggaaaggcaagtgtaggggcatggagtagagaaggcttgccatttacaagaacaaaaacaggtcatttagcgagaatgaatagaatagtggaaaaggtgcaggcccaaaaatgtggagccttgcaggaatgatggaacaatggaaagccattgaaaggttttaagaaggagagtgatacattttgctttacatttttgaaagatcaccccggctgctgtgtggtaaatggaaacaagggaccaatgacatggtattgtagtcctgaggaggaagtttacaggcggaagcaaactagtggcattggtgcctggagaggattgttgatgatagacgggatatgagttccaaaagatgagtaggaatttgcccctagagaagaggaagaatacatagcagaagcatgaaagttcaggatgtctgggaaattgaatatactttgcagaacagtagcaagtgaagatgaagagattgtttaagcgataatgtatgcagtcgggagacccttattcgccatgtatgggagtttggaatttatggcatatgcaatggagagccatctgaaatttcgaatcaagagaacaaaacaatctcttgacctgaagttttgtgattattatgtatgtccttcattttcattctgaagtaaaggagaataataagggtgctttaagttttatcatcttagattctgagaagttcagaaagatttgattaagtacttgtcaatgaagtctttaataattcattgggaaccacacttttattctgttttgtttttttgtaaggacttttttttcatttatgggctctactcttctgctgtctttggagagacagcacagtaacctgttcagagcatgtccggagccacatggcctagggtacagtcctggttaccagtactaactggtcaacctttggcaagttatgtaatctaagtcttagtttcattgtctataaaataaggataataaaaattcttcaagtggcttctgtaaggattaatggattcagtgcatataaagcactgaatatgtaataagcactttgtggatcagggttgaagcagggtgcagaagtatacgaggagcattggttgtaagcttttctatatatcagtagtagaaatgtgacaggtcataatttctttaaagtacgtttaaaatacctatttcccacttcatttttatatatggtattaaattttctatttgtttgtgttttccaagaatgtccacttctttcatcacaaagcccacttattctccaaaaagtttatataagaaaatgggtagttagtttgcatgatcttctgctttattggatattatttattttctggaataagttatgtccacagatgattttaattcacactgctactcaggtaacttaggtaaaacaaaacatcaggattttttggtactacagttcaaatttatttaacttcccaacaatatattttaaataacaaagaaacaaaatactcaattttacctctgttgcacattagcaaggcataaaagagagattaatataattaggtaaggattcttatagtatttattttctgcatcacttttaatttagcatttaattatgtactatgacatttctctatataatacttcatgtatattactcatatttgcaaagattacgtatatctcagaggtggagactagatattaaatgtcttcattctcctatcttctgaagcacttaagtcagaggaactaaattattcattctaatttgacaactcaagcttgtaacatattataatgcttagaaaagctcagtaaaactaaactctagttacctataaattgtttgtttttaatacttcatcaggaaataaattccaattaaaatttcattaattatcccccttgttctttcatgtctttccaatgaaggagtagaaagactttctttacaaaactaggctcagggaattagtgtcccatgttgaaatttggctctcaggaaagctcccagaaaggaagtctcctagttggcaaccaataagccttacttagattactatatgttgtcattcccatggaagtaagggaggatccgtcctcaaactacatccttggggttcatgatctttttcttttcacttttcctatgatttctcttcccatggtcaggagttttaaattacacatacagcattactagtttgaaggaatcttggagaaccaaataaaatgaattagaatgtaattcttgtcctcttccttcatcttatttttcacaaccagttctgctactaatcgataagcctcaaagccaatcaaaggagaattaccttctgggattagtaaatgtcaaaatatttcttaaaattttttcataagatgagaaaagctgaaaatcatgccaactcctgtggttgaaactatttaaataattgactgtgtgtttgggtgtatgtgagatactataacctgtactttggggatgctcattgcccttgacaagtgaaagcgtgcgctctccacgaggcctccctcctggcgtctgtgcagtaagagagcagcttccctcagcactagctggaaggagaagtcacttgtgctggtgttcagcaagtattaccttccttttcattttatataatgttatgtagccatgaataggaaaggtaaatgtttttcatactttaaatagactactatctttcaaaaataagaaaatagatcttattattgtctcataaaaccataaaataaaaattgttttatttcaaaatccacagatatttatttacaacatagtattcatcaactaataaatgtcctttttacctttcattattctttagattttatttcagtatcctgattagtgtttttaattatacctcctattcaccgtgataacaaattcaaataacataaaaatgttaaggaagagagctgggtgcagtggcacataccagtaatcctaacactttggaaggccaagccggaggattgcttgaggccaggggctcaagaccaccataggcaacatagtgagaccctgtctctataaaaaaaaaattttctttaaattacctgggtgtggtggcacaggcctttagtcccagctacttgacagactaaggcacagaggatcgcttgagcctagcagtacacaggtgcagtgagctacgatcatgccactgcgctccagcctgggtgacagagtgagacctcgtgtctaaaatatacatacatctatagaaatatacacatatacatacgtacatacatgcatacatagagagccagcaaatattttgcccaatcccagttcagttttctaaagtttgccactagcaacattatgctgaaaattatttggctttttctttgcacatttaaaatatatctttaaaatttttttaaagtaatataaacattaaaataatatcaaaggaataagccagaaaaacaagtcactcctttggtacctgatttcctcatttgtatgtcctagacatcatgaattgatgttaaggcacatgtatagtatggatactatactgcatctactgtattttctggaaggatggaatcaaactattttggaagactttctatatcagtaccaaacaatatatcttagatgactattaaggtttttttgtaattaaaaacaagttttcagataaacatatgtatgcatatttgcatacatgtgttaatttgcacggtgccaagaaattgttagatcaacaggtcggcattttaaattttgataaatattgccaaagtaacacagcatataagagtgtactcttttatttaaaccttgcatatgtcaggcgttactgggacttttttgccgatttactaaacatcatttatctagggattagtatctacagccagtgttctagatgaggggaacagtggtgatcgaaacagaaaaaattcctgtctgaatggaacttgcattgtagtgtagtagataatcaatcaataagatattatagtgacaagtatttttaaaagaaataaattgagggagaatagggagtgcaatgggggtgggggtggtatttaaatagagcagtcataggagacctccctgaggaggtggaattgggcagttcataaagaatattacaggtagagtgatatgaagcaagaggccagtatacctggaatgcagtgagccggggtaaagtagaagacaaagtctgagagagacaggtgaggagagtcagcccatggagggccttggattacagtgaataggatgggaagtcattagatggtttgacaagattccactgatgctttagaaggttttgtctgctgtgttgagaactgactacaggaagacaaaggtggcagcacggagaccagataggaaccagtgacagtactcgaagtgagagatgatggtaccatcaggtagttagtggcagggaattggtagtgggtggtcagatcttgaatatatttttataggtatttccttccagagtagatgcatgggatatgagagaaaaagaggagtcaaaactatcactgagacttttggcctgaacaactggaggaatggaattgccgtttactgaaatagagaagactgagagaccaggaattgtatttggctatggtaaaaaatttcccattagaaatccaagtggtgatatcaccaaagacaaaagccacatgattatctcaatagatgcagaaaaggcctttgacaaaattcaacagcccttcatgctaaaaactctcaataaattaggtattgatgggacgtatctcaaaataataagagctatttatgacaaatccacaaccaatatcatactgaatgggcaaaaattgggagcattccctttgaaaactggcgcaagacaggggtgccctttctcaccactcctattcaacatattgttggaaattctggccaggacaatcaggcaggagaaggaaataaagtgtattcagttaggaaaagagggagtcaaattgtccctgtttgcagatgacatgattgtatatttagaaaaccccattgtctcagcccaaaatctccttaagctgataagcaacttcagcaaagtctcaggatacaaaatctatgggcaaaatcacaagcattcttatacaccaataacagacaaacagaaagccaaatcatgagtgaacccccattcacaattgcttcaaagagaataaaatacctagaaatccaacttacaaggggacgtgaaggacctcttcaaggagaactacaaaccactggtcaagggaaataaaagaggatacaaacaaatgggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacattgccaagacaatcctaagccaaaagaacaaagctggaggcatcacactacctgacttcaaactatactacaaggcaacagtaaccaaaacagcatggtactggtaccaaaacagagatatagaccaatggaacagaacagaggcctcagaaataatgccacacatctacaaccatctgatgtttgacaaacctgacaaaaagaagaaatggggaaagaatttcctgtttaataaatggtgctgggaaaactgactagccatatgtggaaagctgaaactggatcctttccttacacctgatacaaaaattaattcaagatggattaaagattgaaatgttagacctgaaaccataaaaaccctagaagaaaacctaggcaataccattcaggacataggcacgggcaaggacttcatgtctaaaacagcaaaagcaatggcaacaaaagccaaaattgacaaatgggatctaattaaactaaagagcttctgcacagcaaaagaaactaccatcagagtgaacaggcaacctacagaatgggaaaaaatttttgcaatctacacatttgacaaagggctaatatccagaatctacaatgaactcaaacaaatttacaagaaaaaaacaaccccatcaaaaagtaggtgaaggatatgaacagacacttctcaaaagaagacatttatttatgcaaccaaaagacacatgaaaaaatgctcattatcactggccatcagagaaatgcaaatcaaaaccacaatgagataccatttcacaccagttagaatggcaatcattaaaaagtcaggaaacaacaggtactggagaggatgtggagaaataggaacacttttacactgttggtgggactgtaaactagttcaaccattgtggaagacagtgtggcgattcctcaaggatctagaactagaaataccatttgacccagccatcccattactgggtatatacccaaaggattataaatcatgctgctataaagacacatgcacatgtatgttgattgcggcactattcacgatagcaaagacttggaaccaacccaaatgtccatcagtgatagactggtttaagaaaaggtggcacatatacaccatggaatactatgcagccataagaaatgatgagttcatgtcctttgtagggacatggatgaagctggaaaccatcattctcagcaaactatcgcaaggacaaaaaaccaaacactgtacgttctcactcttaggtgggaattgaacaatgagaacacttggacacagggtggggaacatcacacaccggggtctgtcgtggcatgggggtaggggggagggatagcgttaggagatacacctaatgtaaatgacaagttaatgggtgcagcataccaacatggcacatgtatacatatgtaacaaagttgcacgttgtgcacatgtaccctagaacttaaaagtataataataataataaaaaaaaaagaaatccaagtggagctatcaagtagataatttgggattcataggagaagtcacctgggatataaaactgggagtcaacaaatggcatttagagccatgaaacagattgaggaagtggaggaaagaaacgaaaaagaagcagttggtgagttaagaggaaactgatagagtcaagagaagagattgttttgaaaaggagagagtaatgaattatgtcaaatgctgctaaaagatcaagtcaaatgaggactgataattgtcattgcatttagcagtgctcacagtcatgacaagaacagtgttggtggagtgttgtaattggagtaatttaagataaaataggaagaaacaaattagagacacatgtaggcaacttttccaaaaagctttgaagtatagagggactgagatatagaattaggagtgctggagtttaatcaaggtaagagattagccagcatagagattttgaagccagagagagcaagaaagttgagagtgtacgtgagaagtgattataaaaatataagattaaaatggatatttcttctgttactgaggttgagcatctttttacatgtttattgggcattcatttttgtgtgtgcgaattgcttgtgcatattcttactgggtggttcatcttatgagtgtttaagaattctctgtaaaataaagatgtcagcctttagtcatatgtgttgcacatatttttcacaatttgtcgtttgtcttttgacttgatttttttctgtgtatagttatgggtttcatttcatgcttataatggccttcttattccaggtttgtaaaaggatttgcctatattttcttcttttttttttttattatactttaagttttagggtacatgtgcacattgtgcaggttagttacatacgtatacatgtgccatgctggtgcgctgcacccactaactcgtcatctagcattaggtatatctcccaatgctatccctcccccctccccccaccccacaacagtccccagagtgtgatattccccttcctgtgtccatgtgctctcattgttcaattcccacctatgagtgagaatatgcggtgtttggttttttgttcttgcgatagtttactgagaatgatgatttccaatttcatccatgtccttacaaaggacatgaactcatcattttttatcgctgcatagtattccatggtgtatatgtgccaccttttcttaatccagtctatcattgttggacatttgggttggctccaagtctttgctatcgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgactgccattctaactggtgtgagatggtatctcatagtggttttgatttgcatttctctgatggctagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaatgagatcccatttgtcaattttgtcttctgttgccattgcttttggtgttttagacatgaagtccttgcccatgcctatgtcctgaatggtaatgcctaggttttcttctagggtttttatggttttaggtctaaagtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagtcgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggttcttttttggttccatatgaactttaaagtagtttttttccaattctgtgaagaaagtcattggtagcttgatggggatggcattgaatctgtaaattaccttgggcagtatggccattttcgcgatattgattcttcctatccatgagcatggaatgttcttccatttgtttgtatcctcttttatttccttgaccagtggtttgtagttctccttgaagaggtccttcacgtcccttgtaagttggattcctaggtattttattctctttgaagcaattgtgaatgggagttcactcatgatttggctttctgtttgtctgttgttggtgtataagaatgcttgtgatttttgtacattgattttgtatcctgagactttgctgaagttgcttatcagcttaaggagattttgggctgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtctgtcatagatagctcttattattttgaagtacgtcccattaatacctaatttattgagagtttttagcatgaagtgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatgtatccatctctcctagattttctagtttatttgcatagagctgtttgtagtattctctgatggtagtttgtatttctgtgggatcggtggtgatatcccctttatcattttttattgcgtctatttgattcttctctctttttttattagtcttgctagtggtctatcaattttgttgatcctttcaaaaaaccagctcctggattcattgattttttgaagggttttttgtctctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaatatctttatttctgccttcatttcgttaggtacccagtagtcattcaggagcaggttgttcagtttccatgtagttgagcagctttgagtgagattcttaatcctgagttctagtttgattgcactgtggtctgagagatagtttgttacaatttctgttcttttacatttgctgaggagagctttacttccaagtatgtggtcaattttggaataggtgtggtgtggtgctgaaaaaaatgtatattcttttgatttggggtggagagttctgtagatgtctattaggtctgcttggttcagagctgagttcaattccctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttattggtttaaaggctgttttatcagagactaggattgcaacccctgccttttttaattttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagcaggtgattttgctcgttagttcatgcagtttcttcctagtctcgatggtctttacattttggcatgattttgcagcggctggtaccggttgttcctttccatgtttagtgcttccttcaggagctcttttagggcaggcctgctggtgacaaaatctctcagcatttgcttgtgtgtaaaggattttatttctccttcacttatgaagcttagtttggctggatatgaaattctgggttgaaaattcttttctttaagaatgttgaatattggcccccactcttctggcttgtagggtttctgccgagagatcagctgttagtctgatgggcttccctttgagggtaacccgacctttctctctggctgcccttaacatttcttccttcatttcaactttggtgaatctgacaattatgtgtcttggagttgctcttcttgaggagtatctttttggcgttctctgtatttcctgaatctgaatgttggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccatcgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcactctgcgttttagagtttccactttttctgttctgttttttccccatctttgtggttttatctacttttggtctttgatgatggtgatgtacagatgggttttcggtgtggatgtcctttctgtttgttagttttccttcttacagacaggaccctcagctgcaggtctgttggaataccctgccgtgtgaggtgtcagtgtgcccctgctggggggtgcctcccagttaggctgctaaggggtcaggggtcagggacccacttgaggaggcagtctgcccattctcagatctccagctgcgtactgggagaaccactgctctcttcaaagctgtcagacagggacatttaagtctgcagaggttactgctgtctttttgtttgtctgtgccctgtccccagaggtggagcctacagaggcaggcaggcctccttgagctgtggtgggctccacccagttggagcttcctggctgctttgtttacctaatcaagcctgggcaatggcgggcgcccctcccccagcctcgctgccgccttgcagtttgatctcagactgctgtgctagcaaccagcgagactccgtgggcgtaggaccctctgagccaggtgtgggatatagtctcatggtgcgccattttttaagccagtctgaaaagcgcaatattcgggtgggagtgacccgattttccaggtgcgtctgtcacccctttctttgactcggaaagggaactccctgaccccttgcgcttcccaggtgaggcaatgcctcgccctgcttcggcttgcgcacagtgcgcgcacccactggcctgcgcctactgtctggcactccctagtgagatgaacctggtacctcagatggaaatgcagaaatcacccgtcttctgcgtcgctcacgctgggagctgtagactggagctgttcctattcggccatcttggctcctctctgcctatattttcttctaatacttttatggtttcagttttttttctaagttaaagtctttgatttcgtgtgggtttcattttggtgaaagtcttggggtggggatctgatttttttccaaatgatttttattaaataatgcattttccccccactaatttgcaagactcctatttgtttagggtctattttgtattatattcaagtccattgattgcccatccctgtaatagtacaaatctatttccatttctgtagcttcaagataaagtttactctctggtatatctagtttatgttctcctaccaccaccattactattatttttctgaattttcctgagtattttaatgtgtttgttttctcagataataataccaacagtatgtatcaagaatatatgtgcagtattaccaagtgttttgcatatatacctattttcatcattgtgataaccatgtcaggggtatactattaatatttcaatcttggcaatgaggaaactgagacattagaagaatatataacatgctcaaggtgacaaggctagtaagcagtgaagctgtgatttgagccaggcagttaggttccagagaccatgctcctacttctctatataaactgtagacgtgttgatctaagtcatttagatttagaatccaagataccatgtgtagcatttggatcaaaattgcattgaatttatagaaaaatttaggtagaattgacatatttatgacacaaaatcattctattcaaaaccaagatatagcttttcatttattcaaatatttgatgacttttacatagaatgctagttttcttcatgtaggtcctccatgttttattttaagctttttccttcatgtgtttcatttgtgttgctagtaatagaattttttcctctttcgtgtttttagctggttattgttgattattggaaagctgttgatttttttctgttggaaagatattgatttttttcttttaaatttgtaattaaccatttaccaaatgtccttactgctaatagtttttttattgatttttcctgaattttctataaatgttattctgcaaataattttgcttctcctttctaatatttatactttctcttttattctttttaaaaattggtttattcttgtaaatcattgttaactaatgatgaaactaagcatctttatcttacaaatgcctgtcattcataatcatttattatgatactaacttcagttttcttttcatgcaaaagtatcagcaagggaatggtgaatttttttcaaatgcctttctgtatctatagatgtcgtttgtcctttatgttaatatagtaaaagcacatatattttctaatattaagtaatgtttgcttcattcttttaatttaatattttatttaggaccattgcatattttatttaggactgagcgtgtgtgtgtgtgtgtgcgtgcgtgcgcatgtgtgcctgtgtgtgtgtgtgtgcacatgcatgtatatccttcctcagattttaattattatgttgacttcctagaattcagacttttcattttcctctctctttaaaaagttacaaaattatcagtcctttacagatctgaagaaatttacctgtgaaaacacctggcagttttgggtggttaactactatcttcctaaatttattctatgatgtgtctgtctatgtctcttaaataattttccaagttctataatacagtgataattatttacattttcctagaaagggttttcatctaggttttcaaatttatttgcttaggtttggacaaaatatttaaaaagtaagtttcctaaatttctttatagttgtagttaactccatttgcattttaatattgaacattcgtgctgcttaatttttttctctaggattaagtaggctggtaatttatcttttttcttgattctttaaagtttgggcttttggactgatatatcaattacatggcttctctattttttgactaagtactttccgcatttgtatttttgattttgtcttcacacttagatttcgtcatactacctatcttccataagtaacagtttctatgaattaaaaagcatccttttataaatgcagactttacttatgaaggaaatattagttataggtaatttagtgtgaattattttactccaaatactttcctcaacacaaaaaggaatcatcttttttgggactgaatttaatttaatctcttgaggactttgctttttcactgtttcatctatctgtgagttgtacgaacactggctgaaattagctcattgagtggatgggagtttagataaaaggggaaaaggggaaggtaatttgggaggatggctcttgttgggggcagatagatacaggatctgtggaggaagagagaaaggccagaacaagaactgagagagtaacaaagaaatcctacgaatccttagtaactttcatgtaatgagagacaggagaaaataagaactagcattctgtgagcaatgacaaccctttccctgcgtttgcctatcagttttcattctattaatagcatgtatctgaagatattaaaaaccaccaccccttttgcaggggtaaaatttagaatgattgacttttattggagttatgttttaaaatatattttgaaaatataaaaagagtttatgaagattttacctagagaaggatttaaaaatttcacccaaaatttactgaatcattagaattactaaaatctaacatgttcatggtacttggggtactctaaaaccattatgatacctatttttagattatttaaattaaaattagataatatacacattgttcattattatataacattacatttgtatattacattatatccttcattatacagtaaaatatatatagacagtaagctaacattatcagttcggtcaaaagtcagattaacaaaaatttacagtaaatgcttagtatttatagacaagctcctctttcctggagtaatattatatgcagaagttttctctgatcctatgaattaccacatgacctctccattccattttgtgtacctgtttgcctggtctggttatgactgcagttttgttttcattttcctgaattgttgctaacacttaagtatattgacttgtttcttcactgagaaaagaaaaaagtgtggtcccatattcagttcagcaaataattctatacctactatgtagaaggcagtatgccagtgactgtatttaggataaaatgtgtgtgtgtgtgtgtgtgtgtgtgtgtgtgtgtgtgtgtgtgtgagagagagagagagagagagagagagagagatgttattgtagtcccaattgatgttaaagaataatggatggaaacacttggtcagtgtttccaccgatctttgcatcactcagcattcatgcctaaatttgtggtgttctcagaattgtgctaatgtgtaaaatattcttatacttaatatgagtacagtctgttggctctgtagaacacaactcaaagtgtatgtatttttctagttatttcttaaattatgacaatatgcttatctgatatatgtggaaccagtttgttaaaagtagtctgttagtttttaaggattagtcttctaagaaagattttctctttcttttctaacatgcaaatgagtgcatgcttaggggcttgatggcaatgagtgggatatagttaagcacatattaaaggcataacataataagggtgtcctctggaaagaaaagcctttacacaacccaaaataggtaaaaatgtggccttcgcctgtggctttaatcaatacatgccacagttatcgtcggacaagaattgaagccctcaaagttaatcttttccatctttcttccccacttccctaagtttcttcctctacatggccctatcctgctattccaagtcacaataaatgatgatagtgagattctttatgaagcatttaggtgatcttgctttcataccaatgaataaaaaattgagaatgtattggttttggaaccatactcatataagttatctaatgcttttttatgattgtacattacttaagaaacagatatttacatgagactttaattactatagttgatacagtgctgcatgcaatcatgtgctaaaaataatatgtgaaagttcttgtaaagatttattgacctcgcaaataaactagaaaatctggaagaaatggataaattcctggacacatacaccctcccaagtctaaacccagaagaagtcgaatccctgaatagaccaataacaagttctgaaattgaggcagtaattaatagcctcccaataaaaaaaaatgtccaggaccagacggattcacagccgaattctaccagaggtacaaagaggagctggtaccattccttctgaaactattccaaataatagaaaaagagggaatcctcccgaactcattttatgaggccagcatcatcctgataccaaaacctggcagagacacaacaaaaaaggaaaatttcaggccagtatccctgatgaacatcgatgtgaaaatcctcaataaaatactggcaaactaaatctagcaggacatcaaaaagcttatccaccacgatcaaatcagcttcatacctgggatgcaaggctggctgaacatacacaaatcaacaaacgtaatccattgtataaatggaacaaatcacaaaaaccacattattatctcaatagatgcagaaaaagcctttgataaaattcaacaccccttcatgctagaaactctccacgagctctaggtattgatggaatgtatctcaaaataataaaagctatttatgacaaacccacagccaatatcttactgaatgggtgaaaactgcaagcattccctttgaaaactagcacaagacaaagatgccctctctcaccactcctattcaacatagtgttggaatttctggccagggcagagacttggcatgcaagagaaagaaataaagggtattcaaataggaagagaggaagtcagattgtctctgtttgcagatgacatgattgtatatttagaaaacccctttgtctcagccccaaatctccttaagctgataaacaacttcagcaaagtctcaggatacaaaatcaatgtgcaaaaatcacaagcattcctatacaccaataacagagaaccaaatcatgagtgaactcccattcacaattactattaaaagaataaagtacctaggaatacagcttacaagggatgtgaaggacctcttcaaggagaactacaaaccacttctcaaggaaataagagaggacacaacaaatggaaaaacattccatgctcatggataagaagaatcacaatatagtgaaaatggccatactgccgaaagtaatttatagattcaatactgtccccatcaagctaccactgactttcttcacagaattggaaaaatctactttaaacatcatgtggaaccaaaaaagagcccacatagccaagacaatcctgggcaagaagaacaaagctggaggcatcacactacctgacttcaaactatactacctggctacagtaaccaaaacagcatggtactggtatcaaaatagatatatagaccaatggaacagaacagaggcctcagaaataacaccacacatctacaaccatctgatctttgacaaacctgacacaaacaagaaatggggaaaagattccctgtttaataaatggtgttgggaaaactggctagccatatgcagaaaactgaaactggaccccttccttacactttatacaaaaatcaactcaagacggatcaaagactgaaacgtaagacctaaaaccatgaaaaccctagaagaaaacctgagtaatccattcaggtcataggcatgggcaaagacttcatatctaaaacaccaaaagcaatggcaacagaagccaaaattgacaaatgggatctaattaaactaaagagcttctgcacagcaaaagaaactatcatcagagtgaataggcaacctacagaatgggagaaaatttttgcaatctatccatctgacaaagggctaatatccagaatctacaaagaacttcaacaaatttacaagaaaaaaacaaccccatcaaaaagtgggcaaaggatatgaacagacacttctcaaaagaagacatttatgcagccagcagacatatgaaaaaatgctcatcatcactggtcattaggagaaatgcaaatcaaaaccacaatgagataccatctcacaccagttagaatggtggtcattaaaaagtcaggaaacaacaggtgctggagaggatgtggagaaataggaacacttttacactgttgtgggtgtgtaaattagttcaaccattgtggaagacaatgtggcgattcctcaaggatctagaactacaaataccatttgacccagccatcccattactcggtatatacccaaaggattataaatcatgctgctataaagacacatgcacacgtatgtttattgcagcactatttacaatagcaaagacttggaaccaacccaaatgtccatcaataatagactggataaagaaaatgtggcacatatgcaccatgaaatactatgcagccctaaaacaggatgagttcctctcctttgcagggacatggatgaagccagaaaccatcattctcagcaaactatcacaagaacagaaaaccaaacaccgcatgttctcactcatgggtgggagttgaacaataagaacacatggacataggaagggcagcatcacacaccagggcctgttggcggggtgggggtctaggggagaatagcattagaagaaatacctaatgtaggtgatgggttgatggagcagcacatcaccaaggcatgtgtatacctatgtaacctgcacgttctgcgatgtaccccagaacttaaagtataataataaaaagatttgactataaggatgatattatgctgtaatacactgttcaaatattatgagattctaatggttaaaattgtttagtcattagaaaatatctgcagtggtaaattgttaagtatggaatttcagtaccccaaaataagtatacacacaaaagtttaagaatatttttcatcagtgtaacgattttcagtcaggagcctttgcacataatgaagtatgtaggctgtggaatctagccaacctggctttcactcttcaacttagtagctacataacctcagacaggctacttaggtactctgtttttctttgtctgtcagagggatatataataatacctacttcttaggagctgctgtaaagatttaccaagctaatagtagtagcagaaaacacttctctagtccttactgtgtaccagacactgatctaagcacaatacatttaaaaatcattatatcttcacaaccactgtatgcagtggttactgctgtgtctggcattaaatattagcaaataataccaacaactaccaccatcaagaagtcaacatgtctttacattctgatgacaataagtatgcattgaaaatgttaccatcttctattgaagtttaaattcatattatctaaagtcatgtttaaagatttttaaaactgtttaccatattttttacccttgctttcttcatattttaattaaaatcagaatcaagatgtgatgatcacctatgattgttattttcagataaactatactatattttcagccacaggttaaacagttcaggggtatagagatcattggacagaacatttagataactgaagccctcattggctactagaatttatcaagggcctgcattactctgtatgcttttggtggtgggccattttttaaataagctgtgtagatccacaaacaaaatgatagattcagaaatacaagtaagcttgactattaatttaagtttcagtcattaatatcagcagttttcactgttttttttctctcagctaagtgacagaagcaaaagacagtaaaaatcttggaaaatagttatcggtctttttttccatctcagcagataaaatacattgattttttggatttttcccattttatgacacatatcaaacatgctctgggaaaattcacaagatagttataaaatatatacaatctctgtgttttggatttatgacataatctatcttacaatggcagcttatacaggggacaggaaggagttctgctagagtcccagaaagtgataggcagtctttaagagtgctttgagctatggttgacttgggcagaatagaacacccagtatctctggttaaaaagaactcagtaaaaaaatatgaaccatgcaagcaagcatttgaaccagaatgcatatatgtcttaaagcctaatttgggggaagttttcaagcccaaaatactctagatataaatgtgttaaatgtgcaatccaaggtcaaccagagaacctacagctaacaaaattgataatataatgctaggctgcaatattgcatcattaaaaggtaagaatggcatcagcataaaaccatggccaactcaagataccaaagatgtccagaagcctcccttcgcaaaacagcaggaatgtcagctatctaggcatgcagtttcactggtcaagcatatttgagagccttgcagtgagccagaccttacatgatagccagatcttagtggagtatagaattgattaatcctcagcaaatacttaccatgttctaattttagcttgtcatatataaatgccaacttaaaatgactttatcaagtaggttgctaataagtactgaaagtaaaaatgaaagttaatagcattgtgcatcatttgccagtaagcatctccattccgtgtgtgtgtgtgtgtgtgtgtgttgtgtgtgtgtgtgtgtgtgtgtgtgtatttgcctcttactatgagttaaaggcccatcaggaaactcttacagtcaggaaacttaagcttatagtcagctgtgaaacagccttttaaaaatcattccccttacccacacacggacttcactctgcttgtagtgtggctgctcatagtgtggctgtttttccatcttgacacgtattttctcattactatattaaagtgacttttttctttattgtattgatatactgaatagacctcctcagataatatttatggaaacataaaaccattctggaaggcagtttaacagtatctacttcataagtcttcccttttactctaaagtttcacccctactaatctgataagtatatataaggaatggccaaaattatacatatttacaagaaaaattatggcattgttgctagtgcttaacacaggcaaaaaaattatcaatagatcataggttgaagtatatctgtatgatagaatgctgtgtagctatccagagggaaataagaaagctttatgtatatagatgccccttgacttatgaattatgatggtgttatgtcctgataaattcatcgtaagttgaaaatactgtgaaatcgaaaatgcatttaatatacttaacctatcaaacatcatagctgagcttagcctgccttaaatatgcctgcaacacttatagcttacagttgggcaaatcataacatgaagcctatgttttaatatgatgttgaatatctcttgtcatttattgaatactgtaccaagggtgaaaaacagaatggtgttgcaccatcataaagtcaaaacattgtaaatcaagccataattagtcagggactgtctgtactgacatagaaaggcttccaagacatgttataaagtggcataatataagtggcaaagcagtatgatgtgatcatgtgtattttgaattatatatacacacatttgtatataggtgatgctggatttatattaaatataagataaggtgaggtttgtgttacaactaagtaagaaaagtatataaaatgagttacatcatgcctacttagtgcattgaaataattaataaaatttgccattatttttatctttatggagtggattgaggaaggaaaaatagggctgcctttactaactttacatgttttgcattgactgattttacatgcattacttttataataaaataagagagaaaaccatttactcttgggaaaagatctggaaaagcatattcatactaaaatattaatggcataacaaaacttgacgtttttcttctgacacaagatattgaagaactcctaatatgtgagcacagtggtgacctctggtactcttttggacaagagtcttcctaaagtctataaaagctgttttggagttttggttatttgttttcacctttaaatatctacccatattttcaattgtatttcttccttcgtgttctcaggagtgtgtgtgtgtgtgtgtgtgtgtgtgtgtgtgtgtgtgtgtgtgtgtagagggatatgtatacatattatttaagcatttaggtgattatttttcaagaattgttggaaaatttaaggaagcagtggaaagaataactgatagtaattactgcctagttatctaaataaagtgaagcttctttttctcccttcttccgaatcttttcttagcaaataagaatcaccctgaaagtagtttaaaagagatattctagtgaccatacccaatgaagtactaaatattcatcctgttagagtgattattgcaaggactctaaaggaaaacattgattatactagattatttattttatagaattttattctcagcttatactcctggttctatgaactatagaaatcactcagaataataaaatgctgatgttatattttattgaaattcattaaaaattatagaaaaaggtgctcatttgaaaacttccaaatgtcagttattcagaatgacaaacttaattatatagaaattgactaatttggttgattctttctaaagtcagtgttggattaataatgtaatgcatggatcattaacagcttaaaaatacttgtggtaaacttgatgatgtaatgctattttgttaggaaagatggcctcttttcttaagttgcaatcctttaaggattcaaagccctaattgtacataagcaatatcgtatgctgtaggctcgttatcattggaggggaggtttaatatagagtttaagagcacaaaatatggaatcagactgttgctgttaaaatcctggctctgccacttcctagctgtgatcttagacaagttactctctctctgccttgattttcttacatataaaacaaggatataagtagtaagtggtagaactcttatttcataaggctgttataagattgttgtaagaatttaatgggttagtatttataaagcaggtctatatatagtaagtattcaataagggtagctactatttgtcattttggtcatgtaatatctagtgttacatatgtgtgttgtcaaataaattagttgttaacattatttaaaagaaaacattgaattacaatctgttttaagcatcttttttatttttctgagatgtaaaaactgattgttttactagttggttttgattatttgtttcttgtttgtattacagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagtaagtctgatttttttttgtaatattgtattctcatgattcgttttttaaaatatatattaactgaaaagataaattggatgaaaagtttgaaatcaatagtaaatttggctatcaataaatattaggtgtcctacttactaaaaagtggattatgaagcagaataagcaagttattttgaccatatttacaatgcatataatgtattgaaatttagtagaatttattaaccaggatcaagctttccaaatattgttgatataattgaacctacctttaattttttattgtaaccccgaatgaatactctacttagaaaccaataaatatcatatagatatagtgaaattataattcaatatgcaaaaatcccaaacacatataaatcatggaggtatttttagtgcttgtaaacctctctatacatacatcagaatcctttaagtaaggtggttttttcactttaaatttttacttttactcaaagtatggctgagtggaaggagcggtgaaagtaaggagaccctctacttgctgcactttcagtgagtaaacactgaaagtttaatcttcttcctcatctgtcaaatggagaaattggacctagtcttttattctagctctaaaatttcttctttctacttttcctaataaactaattaaattatttagcctgtcttgccaggttaagcaccaatgatataaaaatgggatatggaagtggcatagtattaattagagaggttggggatcaggaacaagggcatcagaaaaggtaaacaagtacacgcaataaatcgaatccaagaccagtcaaaggagaagcttcccagcaagaattcaagttcaaagaggtcgtctagacaagatatcaaaactaaaatctggaaaagtgggtcaggcatgcaggtcaggatattatctggataatgaaatatggaagtgtagataaaagctcagataataggcacagattggcagaagttaagatttctacaatatgacaaatctaatggttaacaagggacttttgaaataatgtaatcagccctctcattttatagtgttgttcatttgtccattcagcaacctctgtagaaattggttgcaactgtggataagactctctgcatgaatgatgtttatatggcttaatggagaagagagataaataagtcacaaatacattatagttttatttaggtatacattatatggcagcatcaaggaggagcatccgaattagagaaggaaggagaagtcgtagaagagttctgagtgaaacagagtggtctttagttcttaaggaccgatggaggttaattagacaaagtacagtgaatataaggttttcaggcaaaagaggcaacatacatgaagccacagaggcttgagcaaagtgttcacagaaaatgagatcagagaagtaaacaagggaaaaaatatgaagtgatttgtgtactatgtcaaggaatttgaaccttatcatggaagctatgagaagaacatcattaaaataatttataaataagtctggtgtaatatggaaaaagaattttagagggagggaggctgaggtagtgtcttcaacgagacggctgtaataatcaggcagtgttaagggtttttgagttaaagtagttgcccatgggatgggaatagaagggagataattgaaagacagaaaggagatagaatatataagaattggaaagggctgtttttagatacagtcccaggtttctagaaagtgagactcagagaagttgacttgctcacttatggcagctggttaattgtagagctatgaacctgttaatgttaatactaagctcaaacatttttggagcaagggtttcttatgtatttcttatctgtggcctgaattacgtagttgatccagagtcttaataggtaatcaagaaggaaatgatctgtctggggaaaaaagggggcaataagaataaggtagatgaagggagaaaggaaggtgaaaaaatcagtgaacaggttctgcttctgagaatatgttgggttcgattatttgaactaaccctttttactgaaaacaactaatggtgctagattaaaaacaaaaacaaaaaacttcttagcacttctaaagagctaagtaagacactaccttgtcaaaatctaagtgaaaaaaggaacccatagaagtaaacagagcagatcatagaagacactttggtcctgaatacatttgcctagccagtgaaatgtaaggtgattttcaggcttctgagaggaaacaaagcccaagaccaccaaagatagtttaatagcagtatggattatgtctcgactgtgaggatgaactaaaagcaaaccattttccatctctaccatccttgagagtgaacaagcaaagtttccctggttaggtattcagggaatggaggattgtctttgagaagtagtaaccacaagctgtctcgcactgatttgaagtccaagtttacattgctgtgtagcctgaaaaatctcaagccatatttgagtttaaagtggaactgctacaaatatctattggcaccaggcagaagtaaacacaagtcttttggagaaatataccttcatcctagtactatagaagtctcccaaataatttagcaagaaggtagaaacatgagtgagaattaccagaaacaaaaggaagcagaaactgacccataaaggctaattactagagttacgtcatacagatttataaaatgactactgtcttgtttaaagaaaaatcagatggttatctgctatgatatgataaaataaaaccagtgtgttttaagaataatctaatagaactaaaaataaaaaattgaatagtaggaatttgaaattcagaggatacatttaacaacaaattaaacagggttaaagaaaaattaataatttggaagatagagaaaaattacactaaatggaactcagagagacacatagaaaaaatatgaaaaacaggtgcctgtagtcccagctactcgggaggctgaggcaggagaatggcgtgaacccgggaggcagagcttgcagtgagccgagatgatgccactgcactccagcctgggcgacagagtaagactctatctcagaaaaaaaagaaaaaagaaaagatatgaaaaacaggttaagatacatgaagattcaatacatcttatgccaggagaaaagatactagggcagcagccatacttgaagaaataatggctgaggtttttatttataatcagtgaaaaacaccatactacagattcaaaaagcccaaatggacattcagatctgtaaagatcaaagaagtccaatagattgaacataaaaagatcttcactaaggcacattacaatcaaattatgaaaagtcaacgacagttttgaaagcagcaaaagaaaagttgcagactccataagactgtaggcagatttctgtgcagaaacctgtcaagcaaggagaaagtgggatgatatattcaaagtgccaaaagaaaaacactgctgaccaagcatactatacccagcaaagttatacttcagaaatgaagaagaaatactttcccaaaaacaaaagctgagggattttgtcactgttaaacctgcttcgtaagaaaaactgaaggcagtttttcaagttgaaacaaaagaacactaattagcaacatgaaaacatgaaagaataaaactcactagtaaagaagttccaaactataaatactattctatatagtgagaaagaatgaataagacctactatttgatagcacaatagggtgactgcagtcaataataacttaattttacattttaaaataaaagagtataattggattgtttgtaactcaaaggataaatacctgaggggacagttaaaaaagaaataaattcagaatgctgtgatactataatgatgttgtgtaaatgtcttgtaactctaatataaaaataaaaaacaaggtattaaaatatagctacaataatttttaatagatatacaatatacaagtatgtaaattgtggtataaattaacacagaatgtgggaggggagaggtaaaagtgtagtttttatatgtgatggaaattaagttcttatcagtttaaaatagattgttatgactataaaatggtttttgtaagccttttggataattaaaagaaaaaaactgtgttagatacacaaaagataaaccatgcgattgcaaaaaatatatatatatatataaaatatcaatggaagcagcaaagaaacaaaggcacttaaaacttttcagaaaacaataaaatggcagtagtttttacttatcaataattactttaaatgcaaatggattaaactcagtaatcaaaatacattgttactatgcatgtttttaatacagagatagggccttgctgtgtcaccagggtagagtgcagtgatgcagtcacagcccactgtaacttcaacctcctggactcaagcagtcttcttgctttagtctcctaagtagctaggactacaggcatatgccaccacatgtggctaatttaaaaaaaaaaaaaactttcatggaaagatggggtcttgctatgttgctcaggctttaaatgcattttttaaaactgacccaactacaagctgcctacaggagacttattttacctttaaagatacagataagatgaaagaggaaggttggaaaaatatgttccatgtaagtggaaccaaaagagagcagtggtggccatttttacaccaggcaaaataaattttaagtaaaaaattgtcacaagaggcaatgaaggtcattgtataatgataaagaggtcaatttatcaagatgatacaattctaaatatatttgccaccaattttggagcacataaatatgtaaagaaaaaatataactgaagggagaaatagatagcagtacagtaatcataggggtcttcagtgctttcaataatggagaaatcatctagacagaaaatcaataaagaaacagtggatttgaacaacactagacaaaatggacctgatatacagaacattccattcaacagtagcagaatatgcacatttttctcactcaaacatgtaacattctccaggacagattatttgttaggccacaagataagttttaacaaatttaaaattaaaattatatcaagtatgttttctgtcaacagtggcatgaaaccataaatccgtaacaggaggaaaattggaaaattcacaaatatgtggaaattaagcaacacactcctgaacaaccaaaggtcaaagaagaaatgaaaggggaagtaaaaaatatcttgaaacaaacaaaaatggaaacataacataccaaaacatggaatgcagcaaaagcagttctaaaagagaattttatagcaataaatgcctacattaagaataaggaatgatcttaaataaacaacttaatattggacctcatggaactagaaaaataagaacaaagtaaaaccaaagttagaagaaggaatgaaataataaagattagagcacaaataaatgaaataaagagtagaaaaacaatacaaaagatcaacaaaactgagttagttttttgagaagataaaatcaacaaacatttagctagaatttaaaaaaggagggaatatccaaatagaataataaatgaaaaatgaggagagggattaaagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtgatacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggtaagtttcccccaaaagacctccaactttgcatctctataggagacagtgagccttaccacatatacagcataccactactacaaactacaaacaattaacatttgagaaaacaactacactaaggctatctgtaaccaaggaatttatacagagccttggccccctaaaagcacgtagaagcaaagccaaaggacacaacccaacatatgcaagagtcacaccctcaaggggcaacgaaaaataatcccacccaaatgaagataaatccaaaaataataagtgccagcttctacacatgagaaggaaccagcacaagagctccaacaccaggaagaaatagaatgttgtgacacccctaaaggaccacattagctctctagcaatgaatcttaatgaaaatgaaaactttgaaatgacagataaagaatttaagatatggactgttaagaagcctagtgagatacaagagaaagttgaaaaccaaagcaactagagaaacaatctaagagatgaaagacaacatagatatattttttaaaaaacaaatggaatatctgaaaatgataaatttgctgaaggaacttcaaaacactgttgaaagccttaacaatagactagacaaaccagaagaaagatttcagagcttgacgactagtctttcaaattaacccaatcagaaaatggccgaataggaacagctccggtctacagctcccagcgtgagcgacgcagaagacgggtgatttctgcatttccatctgaggtaccgggttcatctcactagggagtgccagagagtgggcacaggtcagtgggtgcgcgcaccatgcgtgagccgaagcagggtgaggcattgcctcactcgggaagcgcaaggggtcagggagttccctttcctagtcaaagaaaggggtgacagacggcacctggaaaatcgggtcactcccacccgaatattgcgcttttctgacgggcttaaaaaacggcacaccacgagattatatcccgcacctggctcagagggtcctacgcccacggagtctcgctgattgctagcacagcagtctgagatcaaactgcaaggcagcagcgaggctgggggaggggcgcccgccattgcccaggcttccttaggtaaacaaagcagcccagaagctggaactgggtgaagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagatctgagaacgggtagactgcctcctcaagtgggtccctgacccctaacccccgagcagcctaactgggaggcaccccccagcaggggcacactgacacctcacacggcagggtactccaacagacctacagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaagtggaaactctaaaaagcagagcgcctctcctcctccaaaggaacgcaattcctcaccagcaatggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacacacaagcaaatgctgagagattttgtcaccagcaggcctgccctaaaagagctcctgaaggaagcactaaacatggaaaggaacaaccggtaccagccgctgcaaaatcatgccaaaatgtaaagaccatcgagactaggaagaaactgcatgaactaacgagcaaaatcacctgctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaattaaaaaaggcaggggttgcaatcctagtctctgataaaacagaccttaaaccaataaagatcaaaagagacgaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaggtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattgtaacaaactatctctcagaccacagtgcaatcaaactagaactcaggattaagaatctcactcaaaaccactcaactacatggaaactgaacaacctgctcctgaatgactactgggtacctaacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagacccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaattaatcccagagctggttttttgaaagggtcaagaaaatagatagaccactagcaagactaataaaaaaagagagaagaatcaaatagatgcaataaaaaatgataaaggggatatcaccaccgatcccacagaaatacaaactaccatcagagaatactacaaatacctctatgcaaataaagtagaaaatctagaagaaatggatacattcctcgacacatacactctcccaagactaaaccaggaagaagttgaatctctgaatagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcagtaaaatactggcaaaccgaatccagcagcacatcaaaaagcttatccaccatgatcaagtgggcttcatccctgggatgcaaggctggttcaatatacccaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacagacccacagccaatatcatactgaatgggcaaaaactggaagcattccctttgaaaactggcacaagacagggatgccctctctcaccactcctattcaacatagtgttggaatttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagtaacagacaaacagagagccaaatcatgagtgaactcccattcacaattgcttcaaacagaataaaatacctaggaatccaacttacaagggacgtgaaggacctcttcaaggagaactacaaaccactggtcaaggaaataaaagaggatacaaacaaatggaagaacattccatgctcatggctaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaactgaacagagccctcagaaataacgccgcatatctacaactatctgatctttgacaaacctgagaaaaacaagcaatggggaaaggattccctatttaataaatggttctgggaaaaccggctagccatatgtacaaagctgaaactggatcccttccttacaccttatacaaaaatcaattcaagatggattaaagatttaaatgttaaacctaaaaccgtaaaaaccctagaagaaaacctaggcaataacattcaggacataggcacgggcaaggacttcatgtctaaaacaccaaaagcaatggcaacaaaagccaaaattgacaaatgggatctaattaaactaaagagcttctgtacagcaaaggaaactaccatcagagtgaacaggcaacctacaaaatgggagaaaatttttgcaacctactcatctgacaaagggctaatatccagaatctacaatgaactccaacaaatttacaagaaaaaaacaaacagccccatcaaaaagtgggcaaaggacatgaacagacacttctcgaaagaagacatttatgcagccaaaaaacacatgaaaaaatgctcatcatcactggccatcagagaaaggcaaatcaaaaccacaatgagataccatctcacaccagttagaatggcaatcattaaaaagtcaggaaacaacaggtactggagaggatgtggagaaataggaacacttttacactgttggtgggactgtaaactagttcaaccattgtggaagtcagtgcggcgattcctcagggatctagaactagaaataccatttgacccagctatcccattactgggtatatacccaaaggactataaatcatgctgctataaagacacatgcacacgtatgtttattgaggcactattcacaatagcaaagacttggaaccaacccaaatgtccaacaatgatagactggattaagaaaaggtggcacatatacaccatgaaatactatgcagccataaaaaaggatgagttcatgtcctttgtagggacatggatgaaattggaaatcatcattctcagtaaactatcgcaagaacaaaaaatcaaacaccgcatattctcactcataggtgggaattgaacaatgagatcacatggacacaggaaggggaacatcacactctggggactgttgtggggtggggcgggggggagggatagcattgggagatatacctaatgctagatgacgagttagtgggtgcagtgcaccagcgtggcacatgtatacatatgtaactaacctgcacaatgtgcacatgtaccctaaaacttaaagtataataataaaagaaaaaaaaaaacaaattaacccaatcagacaaaaaataagttttgtaaatgaacaaagtcttcaagaaatacaggattatgtaaagctaccaaaactgtgacttacaggcattcttgatggagaagaggaaaaagtagaaagcttggaaaaatatttgaggggataatttaggaaaatcacccaatcttctagagatgtagacatcaagatacaagaaattcagagagcacctgaaaaatactgtacaacattaacatgaccaaggcatatagtcattaggctattcaaagtcaatatgaaagaaaaatcttaaaggcagctagagacaagtgtcaaatcacctatgaaggaagctcatcaacctaatggtagacatctcagcagcaaccttgtaaaacataagagattagaggcctatttttaaccaccttgaaaaaatgtcagacatgaattttatatcctgccaaactaagcttcataattgaaggagaaatagtctttcccagataagcacacatagagagaattcatcaccactacaccatcttacaagaaatgctcaaaggagttctgaacatggcaatgaaaggataatactcaccatcatataaagcacaggtaagtagaaacctcaaagatccaataaagcagttacacaactgagactccaaggcacctagctaacaaaactatgatgggaaaaaaacacacatattaatattaaccttgaacataaaaggcctaaatattccatttaaaaaataaacactagcaaattggataaaagaagcaggacttaaccatctgctgcctaccagagacccacctaatggcaaaagacaactacagactcaaagtaaagggactagcagaagaagagaaataacaaagagcagaaccaaatgagattgagaccaaaaaaaaatgatgaaaaggatcaacataatgaagagtttgttctttgaatggataaacaaaattggtagaccactaactagtttaatgaagaaaaaagagagaaaattcaagtaagcacaatcagaaatgataaaggtgacagtattgctgatacaacagaaatacaaaagctcatcaggggttactatgagcatctctatgtgcacaaactagataacctagaagaaatatgtgaattcctggaacacacaacttcctgagattgaatcaggaagaaatagaaatcctgaacagacaaattatgagtaaggaaattgaatcaatagtaaaaaaaaaccttccaacaacaaaaaagcccaggaccagagagatttacaggacagttttgccttatctacaaaggagagcaggtaccagtcttacagaaactattccaaaataccaaggcaggaaggatacctccctaactctttctgtgatacttgttatctccctgatgaatataaatgtaacaatcctcaacaaaattctagcaaaccagatttatcgcacatcaaaaacaaaatgtatcacaatcaagtgtgttttatttcagggatgcaaagatggttcaacatttgcaagtcagtaaatgtgattcaccatatatgcagaattaaaaagaaaaacgatatgatcatgtcaatcaatagatgcagaagaggctgttggtaaaattcaatgtcacttcatgttaaaaaccctcaaaaactaggcattgaaggaacgtacctaaaaatagtaagaatcatatatgacaaagtcacagccaacatcatattgaatggggaaacgttgaaagcattcaccctaagaactggaacaagacaaggatgcctactcacaccacttctattcaacatagtactggaagtcctagacagaacagttgggcaagagaaagaaacaaaaggcatccagattggaaaagaggaaatcaaattatctctggtcactgatgacatgcccccatacctagaaaatcctaaagactcctagacttgataaacaacttcagtaaagttttaggatatagaatgaatgtacataaaccagtagcatttctgtatactgttactgaatctgagaaccaaatcacgaactctatcccatttacagtagtcacacacaaaaataaaataactaggaatacattgaaccaaagaggtgaaagttctctacaggaagattacacaaatggaaaaatatctcgtgctcatggattggaagactcaatattgttaaaaatgaccacaatgcccaaaggaatctgcagattcaaagcaatccctaattaccaatgtcattcttcacagaattagaaaaaacaatcctgaagttcatatggaccaaaaaaagagcctgaatagccaaagcaatcttaagcaaaaagaacaaagccagagacatcagattacctaacttcagattatactacaaggctgaacagcatgttactgatatcgtgataccatgataaagatggacacatagatcagaggaatagaacaaagaactcataaataaagtgacatacctacaaccaactgactttcagcagattcaacaaaaataaacaatggggaaaggacatcctattcagtaagtggtgctgggaaattggccaaccacatgcagaaaaatgaaactggacctctgtgtctcatcatattaaaaaattaactcaagatggattaaagacccataaatgtaagatgtgaaacttaaaatcctgaaagaaaacctaggaaaaactattctggacattggcttaggcaaagaatttatgactaagaccccaaaagaaaataaaacaagaacaaaagtacacaggtgggacttaattaaaccaaaaagcctgttcacagcaaaagaaataacagagtaagcagacaacctacagaatgagagaaaacatttgcaagtcatacctccgacaaagaactaatatccagaatctacaatgaacccaaataactcagcaagagaaaaacaaccccattaaatattggtcaaaggacatggacagacatttcttaaaagaagacataaagttgccaacaaacattttaaaaatgcttaatatcactaatcatcagagaagtgcaaattgaagccacaatgagatattatcttataccagtcagaatggctatgattaaaagtcagaaaacaacagatgttggcatggatgcagagagaagggtattcttatacactgttggtgggaatgcaaattagtacaaccgctatggaaaacagtttggagattcctgaaaaaactaaaaatggaattaccattcaattcagcaatgccactactgggcttctacccaaaggaaaagaaatcattatataagaaagacacctttatgtatgtttatcgcagaactactcacaatagcagagtcatggaatcaacctaagtgtatatcagtggataattggataaagaaaatgtggtccatatataccatgaaatactatgcagtcataaaaacaaatgaaattatgtcctttttagaagtttctacatggatggagctggaggccattatactaagtgaaataactcagtaacagaaaagcgaatactgcacattctcacttgtaagtgggagctaaacagtggttacatatagatgcaaagatgtaaatatcagacgttggagactccaaaaagggggaaggtaaaaggggaattcggatttttataattcgaatttacaattttacaattgggtacagcttgttcactgtttggattatgggtacattagaagcccaaacctcactattatgtaatatatctatgtgataaacctgcacatgtgccccccaaatctaaaatcttaaaaaaagaaatttataaggaaaagggtacactacaactgatactaaacaaagacagaggatgataggagactgttatgaacagttatacactaacagattggataatcctgaagaaatggataaatgaatagaaacgtacaacctaccaagatataccatgaagaaacagaagatataacagaccaaggaaggagattgaagctgtaatcaaaaatctcccaacaaagacaagtcaagatgagatggcttcattggttaattgtactaatcatttaaggaagaattaatgacaagtggtcaacttgtagaatcagttcttctcaaattcttctagaaatttgaagataaaggaatactgccaaagtcattctgtaagaccagcattgttatgatatcaaattcaaataagaacacaagaaaattataggccagcatctctggtgaaggtaaatgcaaaaatcctcaacaagataatagcaaattgaattcagtaggaaatttaaaatatcatacaccatgatcaactgggacttactcctgggatgcaagaatggtttaacctatgcagataaaaaatgtgacataagacattaatattctgatattcacagatctgtaacataatgtcaaagatctaaattatattgggaaatataatatgctattgaaattgttaagtatgtagtaagtacctttaaaaagctattatctgtgaatgaaactccaaattaggattaagttcttaaaagaatcatatggaaaaaggagtattttattgtaaatattaaactaggacatgtttgttattaaaaataaaatttatacagtaagtgctattgacttaaaatactatcaactttattctctgtagagaagaaagtataagttggcaatgttccaacatgtctgtattaatcttacaagatcttgtggttcagccaaaaactctcatgcttgtgtcagttaaactttttaagtataacttttgaaacacctgtcttaaaggcatccttatgctttcagtttttaaaacatatataaaactgatctgataatgtgaaatattgttcaacatgttagctatttcttaatgttttgcaattggtgagttttaaaactgtcccaagttaacagcgatttaaaaacatttttctcacatgtagtttttaaagctctctagaaattgacatgtttaaaaactgccaagacaattaaactttttatgttaaaaatgtttaaaactctgatcatatagcacatagtaataacgctttcttgggcataaattataataaaatactataagtaatacatgtaaagaatgtatcagtcactatctaagccttgaagcaaattgtattcatccttcaagattcagttgaacctactctttggaatcattttcaaccagaggtggtgtatgatttagaaaagattgagcacatggcttctagtcttcgctgtaccatctcttgagttccacttgtacatatgtaaaatgaaagcaatgggccagatgacccctgagtgttgttttattttttagctctacttataagggaacacttccatttgcactaaatatactgtatgaatgtttaagtatttctgggtatcttgagtattcagaggtggcactaatgaaggagtgtaggctttccctgcaatgttgaaccttggtgtacattttgtcctctttaaaaaaccaatcaaacaaatttgctacctagaatacagtgtgtataggtcttttggtcattagccttataataggtagtcatttaaaatattttccaaagttacttaggtaatttcttgttttccatacctcattcataatagttttattactgttggtattgtatttttcattctccctatctgctggatgatttaaattatttattttttgagggaataggaaacattgccatagttatataaataagctctacaaaagggtgtactcagggaagtatcaatcctccccctatgcctactaccctgtttccattctccttccagttattaaatttgtcatagagatttgggttgttctgaaactacttaagtgtatactgggatataacaagtaagtaaatatgtttcagataataagacccagatttctcaccgtaagataaaaggctagtgtgttcagggctatggtgttcagttggaattggaagtatcagtatgaacttatggttctgaatatatataaaaacagataaatatgaaaatatagatggggtatgttagtgtacatacatatatttccaagccctgcctactaacaagacatgaaagcagtgacacccagtagtagtgaacatagataatacccagatctaggatttaaataccattctccagtagaaggtactatgccgccttggagaaatggctgattctatatctagggcagggaaaatggaagatgagcctagaatagtaagtacacataaataagtaaaaataaatttcaggtgcagcggcatgcacctgcaatccctgctactcaggaggctttgtaatcccaactactcgggaggctgaggcaggaggatcgcttgagaccaagagtttgagaccaacctgggcaacttagcaagactccatctcaaaaaatgaatgactaaatgaatgaatgatgagagcatgtcaaaaaaacacaggagccaacttgaaggagttcccaatagccaattctggagcaattttagcagcaaaataaataatgatagcattattataatccagaaaataaaagaaatatccatccatctgtattgatataaatacttaaacacctgggagggaaaggacaggtcttccttacagtagaaatccaattataaattaataagtaaatatggaaatggagactcaccattaggcaaatatcatggtaataattgtttaaaagaactatcaatggatattaaaataagtgggtgaaagtgtcatgagaaaaaagattttttgcataattttgaagtattttcccagaagataattaataattgctaagagaaacatcacaactggtgtggaaaaataaacctggcaggcaccaccttaaccagatgatcaattacagatgataatatcaccagtaataagacatagtgacataccatgtgccactagtgtggtatattgacaagggcacctattgctttagttctgtttttgctcaaaatacatcacctcaatctaataattagaaaacatcagagaaatccaagttgaggggcatatgacaaaatcagtgcccagtacgcttcaaaagtgtcaatgtcaaggtcataaaatacaaataaagacagaagcaacttgtcaaagacaaacagattggattatcaaattttggtagaggttacaggaggttatggacacatgatacagtgtagcatactaaattggctcctgggccagaaaaaaaaaaaaaggattattagtggggaaactggaaaagggcaaataaggtccctagataagttaatagcattgtataatgttaattttatatctttcataacactgctgtgattatgtcatgttctctttaggggatactggttaaagggtatacaagaatgttgattttttacagcttttctgtaagtctgaaatttttcaaattgagatactttgaaaatttctgatcaaaatgaagcaaaatcctttccttgggctttgttagtatgtattacctgaaaaaagttggaattttcaaaaatattttaataagcagtaataaaacaaaaggaaaaatattggaatataataataattcagtttacaaagtgcatagtaggtcagaggatcattcctagatctctgactcttgtcccattctgttagcctaaaagaatgtcagatatcttgccccaaaggaaagttttttgtacttttcctgatctgcctccatgttgcagagtgccagcttacttccgcacatttcagacctggtcgcgataccttgaacttcaggggcaaggataaatcaggctaattctgctttcattaggcttttctgttcaggcctggttggggtttgagagaatatgcctcttctctaaaacactggaggactgggaaggctggacacaataaattaacaatcagtggcaatcccacatttcatatattgggtaagaaaaataatactgagtgtacctgtacagacctaatgctaattgctttcccaaatattatttattttcatacttagaatagctctgtgagatagatgttggctcctttctaaaaataaggaaaatgaggctcagacaggttaaatatcttgccaagatggtacattaagtaatggaaagccaagattcaaacccaggtctatttgattccaaagcatgctattctttttttcttataggtccaacagaaaaatacatatacattaaatatgatatccatacatataatagagcagtgcagaggtaattctgtcagtatcaatgcccatccatatagaaacatcttaagagaagttaccatatcatatattctttttaatttcccatggcctccaataaggtagaatccggtaattactacattactggtgattttcagattcatagtatctgatgaaagtaaaacagcaaaaagaaaaaaatattgacctctgcagggcaatcttatctgtagctagctggcagattgctgttatcttcattcttctctctgttctataaatatttaaccacctgtattggttttctgttgctgccataacaaatgacaacacacttacgatttaaacaacacaaatttactttcttttggctctgtgggttgtgagtccatcccaggtctcactgggctaaaatctaagtgttgtattcctttctgtaagttcatggggaagattcattttcttcctcagatggtggcatagtcagatccttttgatcatacaaggaccccatttccttgctggctgaaggccattcccagcttctagagggtacctgcattccttggcttgtgacttcttttctctaaagccaggaaaacaggtcaagtttgtttcatatcgtatctccactcctgcctcactctctttcacttttaagagctcgtgattaactggcccacccaaataatccaggataatctccccaccttgaggtccataattttaatcacatctgcaaagtccatttcaccatttaaagtaatatagtcacagggtcagagtactaggatgtggacatcttcatggatgccttattctgcagaccacaatgtaaaaaaaatcacacaagttcataaaccactggctaatattaataatcataactatactgagcagtttgtgtcaagtaatgttctaaattgtgttttatatattaatctaatccttgcaatactgtaatgaagcaggttacttagccctattttatggatgagaaaaaataagtacaaaagacattaggtaatttaccagagtcactgatagtaattattatctgtaatttcaaccaggcggtctgagtctgtaaactatgccattaacttccgtactatcataagtcactcagatgattcaggacttcggatattttacttaactgattagggtcaaaatgtttagcaagcctatactgtatgtgggctggttattcttagtttttacggtaaatgaatatttttttcttgctggctgacagaaaaggaatgataatgagggtacacagatgactgaaattgaatgttatttccttagattattttactcattatcactattgtataagaatatgtcactgtttgttatataagttccttcagaacaacttagagaaaaaatatggtaattaggttatcatgtaatccaatgacatacatctctgttgcagcacttttgcaatgatgttgtaattctctgtctctctctcccccaacctttgttctttgatgttagtggtctttccaattttgtatttcaacatctatagagtttctggctgatggatcctcaaatagtgaattggatgaatggattagttaattaattaaatcattcctataattgtcaatccatttataccctgctcttaaaatttaatgaattaatttgaggtgaaaatgtttcagacaagatgatcttcaaattctacatgtaataaagataattttaagagtctcaaaacaatttgtatatttatagaatccctaataatggccatttgcagtgtgctaagcattgggctaaacgagagctcagtattcacaacaatcctgtgatgtaatgctctagtcgtatacatgtggaaactaaggactaactgagttgtatcactccccaaagtctactcacggacccagtagagccaatgtcttcacctaggaataattgactctaaagcgtttgcccttatccactgcctcatttctttttattcctaaagtaaaactactcataagatttctggatctgatttctgtactacttgtggattgattaaatacaaaaacattattgtgtattattatcagttggtctttcaaataactgagaccaaaacattaaaatagttttaaaaatctgtaaacactcctattcttctggatttctacttacagaattagcacctagaactagaaaagtaagtttcttttttttttctgagtgttaagacctcaggaaatatttttttaattaacatactataaaattgacttgatattcatttatttgagctttaatacacacacacacaaacagacacacacataagtgtattcatgtagcaaccatgacgatcagggcacagaacagttccatcatcagagcactatcgtgctacccgtttttagtcacattttcattctaccacaaatcctggcaaccgtgatcttttgctatcattttctcttcttgagaatgttataaaaatgaaatcatacaacatgaaacataatctgtgtcactcagcatacaatatgaaacatttctatttcactcagatgtattcaagttgttgcgtgtatcaatagtttgatcctttttattaatgagtagtatttcattgtatgggtgtgccacagtttatccattcattagtggaaggacatttgggttgtttccaatttacggagattatgagtaaagttgctgtaaacattagtatacaggttttggggggtgaagttaagttttcatttctctagggtaaatatttagaagtgtgattgctgcataatatgttgtatatatttaatgtttcaagaaactgccaaacttttccagagtggttgtaccatcccaccagtaataaataagagatgatccactttctctacatggccacaggcattttgttttatcagatattttttactttaaccattctaataggtgtgttttcataacaggtttggttttcatttgcattcccctaatggctaatgaagttaaacattttatcatgtgtttattatgtcctcttcagtgaagtgtctgcttaacaccttttgtgtattttcttttcttttttttctgtagtgttttttttttctttttttaattatactttaagttctagggtacatgttcacaatgtgcaggtttgttacatatgtatacatgtattttctagttgagttacttattttattaaattttgagagttctttagagttgtagtaaagactactgtagcttgtcttttcattctcttatcctagtctttcacagaacaaaagttttaattgagatttagtttatcactttttctttttatggatcatgattttcatcatgcttggtgtcatgtgcaggaactctgcttaactccagatcatcaggtttttctctttgttttcttcacctttttattagggcttgttgtattttgacctaatttttttataagatgttagattgaggtgaagtttcatttcttcaatatggatgtccaattgtgccaatactgcttgttgaaaagactattctttctctattgaatatatttgcatttttgtcagaaattaattgtctatatttatgtgggtcagtttctggactttgttccattctgttgatctgtacatccatccttttgccaataccacgtaatcctgattactgtagcttgatagtaagtcttaaaattggaggatgttatttctctaattttatttttcaaaatcattttggctattatagttcctttgccttttcatataaattttagataatctatttatattaaaaataatcatgctgaaattttgatttgatttgtgttaaatatgcagatcaatttggagagaactgacttcttccttaaagtgttgaggagtcttccaattaatgaacatggtgtgtgtttacatttatttaggttttctttttcttacatcagtgtttcataatttcagaatacagatcatgtacatagtttgttaaatttacacctatatatttcttctttggagataagaactgtgaatggcttgaagtttttttcttttaatttggtttccagttcattgcctatgtagacagtcttgttttctgcaaatagggacatttttatttcttcctttctaatgtgtatgcctgtaattcttttattgacttattgcaagacatcaagagaggtgataacggacattcttggctttttcttaatcttgagaagaaagcatagtctttctcctttaagtgtaatgttaactgtaggtttcttgtagatacgctttatcaaattgagtaacttcccttctattcctggttcgctgcaagttttcatcatgaataaatgttgctttttttcaaatgctttttctgcatcaattgaaatgatcatatggttttactttaatctgtgaatatggaggaatgcactaatcaatttcaaatattgaatcaggctttattctctgaaaagcctcactttatcattttctttttgtatattgctaatattttgttgaagatttttgtgtcgatgttcataaggtatgttagtctataattttttttctttttctttttcttttattttcttcgtactattgtcctatggttttggtattagaataatcctggccttaaaaaaaatatttaaattggtgttatttcttctttaaatatctgataaaatttgcaagtgaaagttggtcctggagttttgttttgcttaggaggaagattttctaattcaatttaaaaatatttacaggaatattcaggttttgtattcatcttggatgtgtttagtgtctgattttcaaggaatttacttatttcacttctttaggtttatgtttacacaattgttcagagcattcctttatatccttctaatatctgctggttctacagtggtattctcttttcattcctgatagtagcaatttgtggcttctttttttgcttaccgatcctactacagttttgtccattgcattgatctttacaaagaaccagctttttgtctcactgtttttttttttaattttattgctttttgatttttattacttctttctgcttgctttgggtttattttgctccttgtttactgttgttttaatacacaattcagaattttgatctgagaccttcttttctagcacaagcatttaatgctataaattcccctctatacagtgttttagggacactccacagattttgatgttttttatttccctttttgatccatagattctctctaaatcagtttattaatttccagtgttttggagattttcttatctttttcctattgacatctggtcattatgatcatagaacatactttatagaatttaaatcctttaaaatttgttttgttttatgatcttggaagtggtgtgtctacatgaatattttgtgtacatttgaaaagaatgtgaatttcgtcattggggtgtgttctataaatctataaatgttatttggatctagttgttaatgttgcctggttcttctatatccttgctaattttttgtctacttgttctgtcagttaatgcaagaggagtattagaagcctgcaagaatattgtagatttgtctctactttttgttctgttcatttttgctttgcttattttaaagctctgttgttaaaggcatacacatttaagatctctctgttttcttggcaaattgaccctcttatcattatgcaatgtttttcttgatctctgataattttcttatcactgaagtctactttgtctgatattactataatcacgctagctttcttctggttaatgatataatttttcatgatagaattttttatccttttacttttaaactatgtaattataattgaagaaatttttgtagataggatattaatggggattttttttattatttttggtctattctgatcatctctgcccttaattggtttgtttaggccatttatatttcataaaatgttttatgtttggatttgggtttatcattttattatttgttttttgtttttctctctgtattttcactcttctggtcctctttttctgccttgttttggatcatttgaatattttttagtattccattttaatttagttttgactatgtatctttgtatagatttcttttagtggttgctctatggattagaatgtacatcctaacttttcacagtctatttagaatcaatcttttaccctgccaagtggattgtataaatctttcatgtaagtcttgttattctccctcctttattttatagtttttatatgtactacatcatttctcttcttcttttattcccgacattccaagtgtccctcatttcaccttctttatgacagtcttcctttagtaattcttttagaacagatctgccagcaatgaactatactttttatctgagaatgtctttattttaccttcgttttttaaaggatattcttattgaatttagaattttgagctgacagatattttttgttttaaacatgttccactttcttatggaatctatgatttctgattataactctgtagtccattgatcccctataattatatattatttcctctggctctttttagtatttttttaaactagtttgattgatggatttgagcctagtgtttgattgatgggttcgagcctagatttggggggttaggaggttactatttgaggttcagttcttaaatctgttggtttatgtctttcactaaatttgggaaatttttaaacattattcagttttttttctgcactacagctcttttccttctgggactccagtgacatgaaagttagatattttattattgtcctgcattatcctgagactctttattttttaataaatatttttactctgtcttattcaaagtggatagtttccattgatgtactgtcaagttcaccagtctttgctctcttatctccattttactattaagcccatccagtgatttttaaactttggttactgtatgtttagttctaaaattttcttttagtttttatttaaatatcttccatttgctgagacattctatctttccattcttttcaacagtgtttacccttacttcttggagcatttttataatagttgtcttaatgtcttagtttaataattctaacatctttttttcccaatgttgccattttttgatcatcttttcctatgtgacttgagactttttctgattcttcacatgccaagtaatttgagattatattctggatatttcaagtattatgttgtgagattaataagttaaataagactaatacttcgtcttatttaaatcctatcgagaattttgatattttttgcttaacaggcaatttatccagttgtattcgggatgcagtctccagccagtatataggttttgattccacaactggttcacttttcaaagcctttgaaatgctgttcagatctgtccttcatgtaccacccagggtccaatctagaacatgggtaattgtctgtctatacttagtttctcacagtctgtgatcagattcacacatgagaagtttgagcataaacccaagagttcataaacagccttatgaggtcactttcctgagcctctctctttcatgatctcagtactttgagttcctggagactctgcttttcagtcctctagccaaaactctgggactttatttaccctactttgccacatgcttcctgcatctatgcctgtagaagagctgaaagaagacagggagagaaagagctcagtggagtttatattgtactcttagggccacagctcctcctactggagaggaagttttccctccctcaaagttttaaattcttgcagttatcattatctctgctactaccttgaaggctaggatgcaagagaatgaaggagaaaagggcaatttttctcttctttgagacttttcctgctccttgagcctaaactataaggattctcctagagccttcactgccatgccccagggcccactttcaggttttaagctcccttgaatccaggccaggggtaccttttaaaaaaagaagaagaaagaaaaaggtaaggggaatcaccctgtgctactctgaattcttgtcatgtcatcttctccagtccacctgctgtgacttaccctttagagtctttaaataaccgtttccttcattctcaagttttattatctagattcagtagcagacataaacagtttgtggattctccatattaactggatctgacctcaggtatatatttttaatcattatctaagttaatgggtgttcatggaggttgtgagttgcatttgttttaactttgctatacagttacaccccaaatattcacatacatattataaattggaagatacaggagcaggaaaatgaaactatctggaaaagtatacagtgaaacatttcatctctaaagtttgaacacattcaggtctgaatttaggaatctgttggcattcgcttttttgatagttttcccttagcagggaatagggtaggaatagcagaaagctggctcagcgatgacttacagaatgagagagatgtgaattggccttttaaaaatctgtggaagttactcatttggactgggtaacggctttctaggcagagggagcaacttcaggaaaggtatagagaaggtccccaacttacaacattgacttaagacttttcaactttacagtggtgtgaaagaaatatgtattcaatagaaaccacactccaaggacccatgtaatcgtttctcattttcaatatagtgttcaataaattatatgagattttaatactttattataaaatgggcttcatgttagatgattttgcccaattgtaggatactgtaattgtcctgagcattaaggtagactaggctgaactgtgttgttcagtaggaccggcgtattaaatgcattttgacatgatattttccatttataacggggtttatcaatatttaacctcatcataagtcaaggagtatctatacaggtataaatgtgcatggcatgtgtgaatgtgtgtcaaagaggagtagacaaaccaggaaagggaaatatgattcagttaggcatttactgtgccttcttagaggttgcagtaagatattcccatgaacatatttgaaatggttagaaacacatgggtgtgaatttcaaaaaatacaagtttttgaatttaacacatatgctaaataatcagtccttcagcttaaactatgttatcctgcaaatgatagtaagtcttctggatttttattagaatgaatcacattttccatccttgtttttatttactaggaatttcatcttatgactaaaaagaacaagccataagctcttttggtctaaatttgagatatttgcctttgacttatttttaaattaaactttttattttgacataataatagattcacaaataatacagagaaatcctgtgtaccctttacccagtttcctccaatggtaacataatataatgtcacaacaagcatattgacattgatacagtcaagatacagagcagttctgtcactaacaggctctcgtttcccattacatgttcacccctgtccctctaccttgccgcattccttacccctggcaaccactaatctccatctttacaattgtgttatttgaagaaagttacataaatgaaatcatacagtatgtaaccttttagactgactttttcattctctataaattcttggaaattcatctgagctgttgcttgtatcaatagtttgttcttttttattgctgagtaatatttcatgacttattttttagcccacctttttccattatgtttcattttgaaaaaacaaagtcttactactcaggcatttttctcacttacatatttgctttagaatttatactataaacaaaaaccttaggagcattctagtgttctttttaaaattgcatttaggttaaccagttaatctgttgacattattacgtcttacaggaaaaaaatatgtacaagtagattttattactttactccccttttaattcctaaatccagaagtaagatcagaacacatgagagatactgctgcttgaaaaatacttagcacagcctgtttgcagacacactcatgctagtccacggctgatgcagaaaggagcctatcccaaggcagcatttttttgcagtgctaaaggccaacattaggatgttgtctgttttcattaggcaccatggtcttagttgctcaaccaaaactccagcctcaataatgagggaaaaaaatatacttctagtttttaaattgtgggaaataggtctgggagtagattctgaagtatgttaaatactcatctaaagagcctagaatttatcccaaggggggatgaagaaatgaagaaacaaataaattaatcaaattgcagttcctaaaatagttataagtagaaaaattagcagtgtccaaaaatgtcattttacctttaatatcaatgtcatattccatcttacgaggtagtaactctggctgttttgattttcattttagaagaataaggaacataggtttacaataatcagtaactatattaccatcatataattacccagttggcatactgtttattattttagtttaaggagacacattgaagcgagaaaaagggggtgctagaggtttgcagacacttagcaaacactagtgtttatcctacagctttgtaaacactttaccaagaatttttaaactgtcattttgctgatggaaagtgtaaaatgagacttcagcagaagttaatctcatcatctacttaaaacagtgttttttacattgatctaaagaggtttgtgcatattttaactgtttttcctatatgatcatcttcatgtactagtatgaaagttaatgagtaaagaaaatctgctgaataaatccacgtgataatccaaggcacttaaaagaaatacatgctataatgggatgcaaagattttacttgattagtgctctatttctcaatttaacaatcaaacctaagagaaatctcaatcaagacttttgactaacatagtgcaatttgattagggtgcagataagtacactatttcggtgtgactgtataagtattctgatcataattatgacatatactctgctactagttagaaaaagaacagtttttaacttcttcatgcctttcatttatgcacatgttcttaatacactattataataaataaaatgtacctgaaaatataaaacatactttttgcttgtccaaaaagtatgcatttatttataatacaaaatatttattctgaacctatgctgtatgatagcccactataaatgtagaggtagcaagggaagatgacagatatctaaaaatatttgttagtagcactatattgttgattactacatatcagtaattagaataacgaataaagtgaaagaaaaagcataatgccttaggtgtttactttgggcacagtaacatttggtccagtcatctttctagttttctggtacccaagttaaatgagcaagagtgtgatggaaagtgggctttggagccaatcagacctgcatttatatttcatttctaccacctaataacggcatgtctttgggcaagttatttaacttctccaagcctcaagttttttaacttataaaatatgttgttacaaagcttaaaagaagtaagttactagcacagtgcctggaacatagaaatttgtgctttagagaagaaataaaaatatataattctaccgtctataggtagagctcttttcccaaaatagtactaaaattccagtttgcttataatcctaaaatatttataattccagaatatctaaatctgtactgcttttacttctctaagatatcttcgtgagtttggtaagactgtccacttaatttctttaaacagctttacttttcaaggacacattaccatattcataaaaggaaaaaatccaaattaaatataatctgtactgaaagtttccttttcagatttcgggaagttaaaatgtttgtgacaactggatttgtttttttaatcttttattgatatataatagctgtatatatttggggagtacatgtgatattttgatacatgtatacaatgtgtaatgatcagatcagagtaattgggatatccaaaactttaaacatttgtctttcgtttgtattaggaacactatagatctattttaatttcttctttgatttcagcaggaaaggaagggcaagaaatcctggggcctgaagctcaggcagatgaagcaggatgtacaggtactctgctgcgactttctttcataccatagcctttaaaagaaggtctttgtgtcactgatttcgcatttgtgagtcctgaatttagtccgtttccttctcttttatcttaccttccttaaatgtttaagtacttaggcatatggtgcactacataaaaagaagtaaatattccttaaatacagagtaacttacagattcatattatgtagcagatttctccattctataagaatgacaagtataacctacagataatccaaaaaataagtgtttgaatgatgatttgaacttctatcaagtttttgaccaaagttagagaaatgcagatctaacttttgagtttcgttattagttacctgggtctgctttgaattgcccacaagacaaaaagcagaagaaaatagaaaaagcatggatttatctataaatccgatgagaatcatgaatattaatgagttgagtgaacatgtcacagcaaacgagaatcaaaaatttttcttaaattttctgtgattgaaaaagagtaaaatgaagttgaattataataaacaaggaaatttgcttttaggtgactaaaaagtacatattccctgaaacttaaggctattcctctgtaatggattcagatcagatttaagaagcaaaagagtaggtggaaaaattaaatcagatcttatgtatagtaataccagtcactttttattgtgttccctaagagagccagaactgttagaatgtaaacttcaaaaatgcattccagatttttaaaacatttcctcaaaatattatacttaaacgtagtgtaattgtactttgtatattcaaccataaattagatatttctgtcatatagttttaattacattttctttttccttctcttctatgagttatcatttatagatttgtttttttactttgctgtgcattttaggaatattccataaaggcttacaaattatctttcattaggtaagatgaggtatggttcatggctaataagtgtcaagattagatttttatctgtaatataaacaatagcactcctatactcgtcagtcatttctgtaaaacagagtaaatctttgtgctgttattaaaagtgaattccaaaataattaaataataatggagtatgtgataatttgtggtgcgtatagcctgcgattttatgttttgcccctaacttcgttctgtgtaacttgcatgaataatgtattcagatatgcttgttatcaaatatttgccatactaagctatagaatatgtaaaatatttaagctggacatttgttagtagtaatacagtagtgttaataaacataagagtacactatttacttttacctagaatcgttaaactttggagacttatattaccagaattacagaagacaacttgcccttctaggtaaaatgctatccaaaaagatgctcacaggtttacagtattttatctgtcatgctgttcttcactataaaaataaatgaattctttcagtttgaagtactgaatagtatgtaaatttcctcaaaaaagttgcatctggaaggcagggtaaccttctcaaatttgtgtttaacaaaagttgctgctgaaatgtaaaatctcccccacgtacacaatgatgatccctgctgcattattcgcctggaacatggggagttaggagtaagcaaacttccattaaagctccagtgagtgtagctttaaaaggaaatttagcttttgagacttttgagcagttaaactgtaaaatgatgtcctgcctttgcttttgttacttccttgacttctagggaataatatgctgacaaaatgagcaaaagcattgtacagcagtcgccatcattagttcagaatgttgtcagatcttttttatagcagacttccttctgcagctcgtgaagttaaggaactatagtctgaactcagtaatcagagtaaaaaattcattgaaaacatcctttgttccttctgagcgtccctttttttgtttatatagttgataattttagaaagtttcaaacatggaggataaagataagaggaagcctgaggatactttattcaggatggaaaaatagatagatagatagatagatagatagatagatagatagatagatagatttaaaaatattcagtgtttatattaaatatttgctctctcaaatacatgtatatagtcatttaattctatactttgtcaattttgagttttatcatatttaaagaaaacccaattaccttttatgctgtgtatatttgctcatctccctaatatttaaatatataagtttatcatctaaagaccaggacatttgctttataattgaccttttcaagatgtgcatttcccaacactttaaattttaaaaaactgcagaaattctggtctcagtttgaaattgggcctggtaaatgtgggttcatggatatagagtgtagtttaatggaaagagctcagattttatacctgacacctaataccaatttgtctgctctaatagtaatacattttctctctgtgatctcagaagagcttttctgaccctaatttttctattgaggaaaaattttaattgtaaaattatgatgttcaccttgcaggacttctttaaggtgtaaatagctaacaattacatagtacttactacataccaggtaccctactaataagtacattactatattaattaatctaattcttacaacaaccctaagaggtactgttatataaattttataggatgtaaacattatatactgtctcacaaatttcttaatggacatataaaatttttcattttaaatgtcagtagttacaatttaatttctggcagagtaaaacattgacattttaacatcactattacatatgaaatccatagtatattaatacctattatcttttttaaaaatatgaaaatgctctttaagaaatgttgtgtcataatatttactttttgagctcatatttccattctatatgcactatagaattttatgcaaacgtatattaattacttcataaacagtaattaattgtaatagcttaatattacttctagaaggaaaagtgttcatcattcagtttcttttttttagcattgaggtacctttattctcaaataaaaagatgaaataaaattttatgttataactgagttgctcagtttttatgcatcttcagctataatgtcaaaagttatttgtcaatgaaaatattttaatgtcctgtcagtatttcttcaattttgttgaaaacaaaaatttaaagccatctaatttgcaaaaagatttgtttcccagtcattacaatcatctattccctcattttctgggacgtataccagaaagactttaccaatagttatttatcaaaggactaatgatacctgttttgggctttaaaatgttttttctcacagtcactttgtttaatgtattcagaaatgattaaggaaactgaaatatgttaatttcagtatcttttatcagtatatttttcatgaaaaacacttttattacatgaactgtattttgagcaataccttattggttcacccaatttctggaaaatttccaataacctacccagcaaagccagttatcaacatcacaccagccagccaagtcagacttactttctgtcaggaaaaaaagcattttttcgttttttgaactcagtgtgtcaatacatattttgaggaattctataaaatctcatcaataaggaagtgtatgaaggatatatttaaaatacaaaagttaaccaggcatggtgatgcacgcttgtaatcccagctactcgggaggctgaggcgggagaatcgcttggacccaggaggtggaggttgcagtgagccaagatcgcgccattgcactccaacctgggcgacaagagcgaaactcattctcaaaaaaaaaatagaaattatcaataatgaagaaaacataaagtataagtaaatacatcttataataatactaagtagtaaagtcaagattaagattatgtagatcgaatctaatttgtatgttaaaaaaatctttatctctaaatgtgtatatttagacctaatcaatgtataggaaagctagaatttattgaagtagcaaaattcatatataaaatacagatcatgcagttctgaaaagtgtatactatttaaaaactcattattccaacagctagcacacttataatttttattaggatgtagaaaatataagatggagattgcttaattgaaataaatattttataatataatttgataaaaataattttaactatcttagcaactctacatggaatctgtaagaaatcacataaaatattaatttcattttttacttttatctagtttaaattgaaaaattgaagttgctttgaaaagaatgccactgatttgttctgctttagctcttcagaaatgctttttgttctacctaatgacaaatcctaggaatgatgtttgagaatgttatttgctttgctcttatcagtctcctgaaaagcaatgaatttttaaataatagggaggtcattaagggaaaattaccctcacttcctctggccatattatatagttaattgcagcttcccaaccaggaccagcatacccccatttcagttgtgctttatgcctaatagaaattcatgtaaacaggaaagaccagaaaacctatagtgattctctgttgccttgatttgtcagtaaagaaggctttccctaatcggtattttgaactttactcctttggcaccctggaggactttacactccaagcagtgtaccataatcatgtcatggatggatagaggaatacgccttttctctttttttcttttaagaaagtgagaacaaggtatactgtataaaggagagcagggagaagaattttcaaggatgctaggaaagagtttacatggaagttgaggatccgggagttgattcctttaaacccaacagtccagcttacattttaaaagtcttcgcttacctctggatccaataatcccaatttggtaactactgacatgaactaaataatgcagttcttggtatatagcaaatgctaaataattgatagctattgaaaagtggggaaaaaaattaggatcaccatttgttactgtcattggttctcaggttttaaacagcagtcaccctgatgagtttggttactgctacagtgcaggagatgtagcaagattgttttaataaccatcgaacaaacagatgcccatacatccccattttaatttggccaaacttcagcctgctggggagtgctgttttacaaatttagacctgacagttcagtcagagtctataaagaagtcatccctgaggcatttgggagccatactaaggcattgcagttgccagcatggagtagagaccctcttctggagccagtggaggaaatggaggaaaaccatagtgcagcaataatgctttagaaacttggcagcacgctgggctaccttctcaaagcataagcctttctaattcaagaaaagttgccactgccttaatcccacagttaaacatttactgaggcagaaatagagaaagaataggcttgttttatatgaatactagcgtagctaagaaagagttttcatagatttgataccctttgatgcttattagaaatccttcttactatagataattattaaaaactattttctaagaaatcatataactgaactgaacgtcagagtggtttatatgagaattattcagatttaaagtagagctcccccccccattatctgtgggagataaattccaagagtcccccattgagtgtcttaaataaatacttatatatactatactgtttcctatacatacatacatatgataaagtttaatttataaattttatacagagttgcaacaagaactataataaaatacggttataacaatatgctttaataaatttatgtgaatgtggtctccctcgctcgctctcaaattattcttcttgtactgtattcacctgatttcatattgcagttgaccacaggtaactgaaaccatggaaaatgaagccacagataaggggctgtctattgtccaactttaaataagtattatgatatgataggttgctaagaaggtgacctttgagaactaaagtttttttcttgctttatcattaattgagaaagaattcagtcaactatattgccttctctgtgttttattagtaaaatgcaatagaagtatgactttaacatttgaaagggatactgtgagaatttcacacattcatagcattttaaacttataaagcaaagatatatcttaatacattacaacaaaatgagtggaattcatttttaattttcaagaaatattttctgcagattcaagaacaatcatatgttctctcaagataaataatttcttatttagaaaacctttgtaataacttagtggtgagattgctgtcttaaaagtatgcattttttttagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggtaaatggatcttaacagttgtgtttctttccctctttaaaggattcttgtttctaccattctactatgggaacctgctctactatagggaacattcttgaagaccaaactttattacaggtgcctatagagagtaatctgttttattaatggaacactatgatgaccatgcagtaataaattattagctgctcatgtattgtggtagtaatgccactgcatgtgaaatgcttagaacagtgtctggacatcaaattccatttacttacatggtagcaggcagtagaagtgagaactatacctttactgccctttggattctttcccaccattcttttaacaaataaaaatatggttgtctgctttataccagaacatactaatttggaaacagtggttttcctgaatctgccttagtccactctgatatgaatagtcagcgtacagagtgtggaaaatgcaataaaaatgtgttcagactctcctgagaagaaataggctgtgatacagtttgggaggaaaagactatgttattgtttcaccagaagaaactaggttatcaaagaaatgaaagggaaatacaaaatttaaaaatatatgtatatttacgtaaaatttttatgtgacaaaaggctttcaaaaagcctcactgaaaggaaacaatgaaacctaaagaaatgatccattatgtagttctaataaaggttaaaccttttaaagtttgtcaggtccatacagtacgatctaaaaattgaggaactaccattctgaattagtttgaattatagaataagttgttgattttgttattcattactttcagatatttaatgtaatttaattaaatgctaataaagcattttgaagtattctgtcatatcagcgacatttgtttacatatttatccctttttataaccaaatagtattcattcgtgtgtatatgccacatttgcttcatccattgatgtacactgaggttgattccatatctttgctattgtgaatagtactgtaataagcatgaagatccaggcatctctttgatataccaacttcctttggataaatacccagtagtggaattgctggatcatataatagttctatttttagttttttttgagaaatctccgtagtattttcacagtggctgtcctaattttcattcccaccaagaatgtatgagagttcccttttctccacatcttcaccagcattcattagtttttgtctttaatagcaatactaactgggatgaaatgatatattattgtggttttgatttgcatttctctaatgattagtgatggtgagcatttttttgtatatctgtggctatttgtatgtcttcttttaagaaatgtttattcatatcctttgcccacttttcaataggattatttgggttttttaaatctgttgaatagtttgtgtattcttcatattagtcccttgtcagatgagtaatttgcagatattcactctgttgtttcctttgctgagtcttagcaataaagtctttgcctacccaaatgtcctgagtgttttctgtatgttttcttctagttttatggtgttgtgtcttatgtttaagtctttcattgatcttgagttgatttttgtatgtggtgagaaataggagtccagtttcattcttcacatgttaatattcagttttcccagcaccatttattggagagtgtgtccttttcctggtgtatgtttttggtgccttgtcgaaatcaaatggctgttaataatgtggattttattctgggttctctgttctcttccactggtctgtgtgtgtctgttttttactaatgccatgctgttttccttactgtaccttgtattatattttgaagtcaggtagtgcgatgtctccagctttgttctttttgctcaggattgctttggctatattggtcttttgtggttccgtaaaagttttaggattgttttttctgcttctgtgaaaaatgacatagatattttgatagggattggattgaatctgtagatcgctctgggcaatatgatcattttaatgatgttaattcttctgatccatgagcatgggatgtctttccatttacttgtgtcttcttcaatttctttcatcaatattttgtagttttccttggagaggtctttcaccttcttgggtaaatttatccctaggtattttacttttttgtagctactataaatgagatggtcttcttgatttatttctcgtctagttcattattggtgtacagaaacactgctgatttttatgttgagttttgtatcctgcaactttcagtttatttagcagattgcagttttttggttgtgtctttaggtttttctagatattagatcatatagtctgcaaagagagactatttgacttcttttccaaattggatggcttttatttctttctcttgcccaattgctctggctaggactttccaatactgtgttgaataggagtggtgaaggagtggaaatccttttctgattacacttcttagagggacgtctgtcagcttgttccatgcagtatgctgtggttctgtcatatatgtcctttattatatggaggtgaaccatctttgcatccctgggataaatcccacttgatcatattgcattatctttttgacgtgctgttagatttagtttgtgaatatttttttgaggattttgtatctgttgtcatcagggatattgacctggatagttttccgttttttgtttcatctttctctggttttggtatcaagatagtgatggacttatagaatgaagtagggagaattccctcctcttcagttttttggaatagtttgaggagaactagtgttagctcttctttgacagtttggtagaattcagcagtgaaccctttcagtcccagacttgaaatattcattatggattcaatctcattactcattattggtctgttcaggttttctatttctttctaatttaatcttggtaggctgtgtccaggaatttatccatatcctctaggtttttcagttttttcatgtatagttgttcataattgtctcttttgtatttctgtggtatcatttgttagtcttctttttcattttttatttgcatcttctctgttcttttcttagtctagctagtggtttatcagttttgttaccttttcaaaaaaaccaactttttgttttgttatttgtgttgttttttagtcttcatttcattgattttgttctgattgttattatttctttccttcttaaatcctaatttagggtttgctttgttcttgcttttctaagttcttgaggcacattgttagattatttgaaatgtttctatttttttgttttaggtatttattgctatatacttcctcttagtgcttttgctatatttcataggttttgatatgttctgttttgattttcatttaaagaaattttaattttaatttcatttaaagaaattttaaattttcctccttatttcttccttgacccagtggttattcaaaagcatgttgtttaattttcatgtgtgtgtagagtttccaaagttcctcttattattaaaatctatagttgtattactttgtggtctaaaagctacttgatatgattttgatttttaaaaatttgtttgagacttgtcatgggtcccaacatacagtctatcctagagtatgttctgtgtgttgatgacaagaatatgtatcctttagtagttggttaaaatgttctgtaagtgtctcacatccatttggtataaaatgcagtttaaattcagtgtttctttgttaagtgtctttctacatgatctgtctaatgctgataggggtgttgaagtccctaactattattgtattagaatctgtctctccctttagatctaataatatttcctttatatagccaggtactccagtcttgggtacatatatgttaagaattgttatatcctcttactgaattgattcctttgtcattctttaatgaccttctttgtccccttatactgttttgtttactggatttaagagtttatctcattatagctactcctgctcactatggtttccatttgcatggacatctttttctgtccctttactttcagtctatatggatctttacaggtgagatgaatttcttctaggcagcacatagctgggtcacagtttttatccattcagccaatctgtaccttttaagtggaaagtttaatccgtttatgttattattattgatatgttagagcctatttctgtcattttgatttctggttgttttgtgtatcatttgttcctttctttcttactgattattattgtggtttgatagttttctatagtggtaacatttgagttctttctctttcttatttgtacttgttctaccagtggattttatattttcatgtgttttcattatggtagatatcttcctgtcacttccatggataagactcccttaaacatttcttgtagggccagtctagtggtcatgaattctctcagcttttacttgtttaggaaagactttatttctctttcatttatgaaggataattttgctgggtatgatattcttggctggcagggtttttttctttcaatactttgaataaatatatcatttctttctctccttgcctataaagtttctgctgataaactgctattagtcgtatggaggttcccttacaagtgattggacacttttctcgtgttgtttttagaatatctctttgtcttttacttttgacagtgaatataatgtgccatggagaagatctttttgaattgtatctatttgggggtgcgctgagctttctgtatctggatgtctaaatcctttgctagacttgggaaatttttggatattatttcattaaataggttttctatcccttttgtttcctctttgccttataacacatcaaaaattcgaatatttggttactttatagtttcttatatgtcacacaggctttgttcattgtttttttattcttttttctcttactaggttattttaaaagacctgtcttcaagttctaaaattcttcttctgcttgacctaatctattgctgaagctttcagttgtcttttgtctttcattcggtgaattcttcaattccagaatttgtttagttcttttttatgatacttacctctttggtaaatttctcattcatatcctgatttgtttttctggttcctttgtgttgcttttctgttttcttctatctcacttagcttttataagatcattatttttaatcattttccaggatttcataaatttattttgattggaatctgttgctggataattattgtattttttggaggtgtcatatttccttcctttttcatgtttcttgtattcttaccttgataccacacatctggtataatagtcaattattctggttttttggatttgctttcattggttgagtagggcactttggctttgattctgggtacatgtggtagtgtaatttctgtatgatatctttcgttataaatagtgtgagtagggtccgtgatttcctcgttggcttaggtgcaattgttagtggaggctgaggtgaagtttggctgggacagggatgccaggtggaccattccttgggccctagcagtggtagtaacgggcttacagtacctgtccttagaccacagggtggcacattgacaccttgtgttagcaggtccagttgggctgatccttggaactccaggtggcttgcttgggtgctggtagtggcagtggtaagctgggcaggtgggcaggttctcaggctcctgggcagtggatgtcacttgggcaatggcagtagcagtggcaggacaccctctggttccctagtgattcacgctggtgttggcagtgactgcaatgggctgggtgagtcagtccccaggcctaccggtggtgcatgcaggagggtgccagctgtagtgatagtagcaggttgggtggacccaacctcaggcctccaggaggagtgttcaggtgacaacagtgttggactgggctgggtcatccccacgtccctgaatagcatgctcggaaactggggaggaggtaagctgggccagatggacctgtcctcaggccccttggtggtgtgtgtaggcattggctatcatggcaggggcaggatgatcccaggccaccagcagagtgctcaggtaaggacatcagtggttgcactgtggccttcttactggggagggcaaggttgctcttggtggcagcagccatagggagggagctgggaaatgtgcgctttagccccagacagcggctgtggatggggtagcctgtcctcaggtcccttataaatgcttagcagctcagctgctgaggaaattagggtcgctgccagtggctagcactttgtccccagcggtggaagcccacagtggcagcagtctgttggggagtctgtccttggggcatgtaaaaatgtgtgcagctcctctgctgggaggaggtatggtcactgccaatggcttgcacttcagccttagcagccgcaaccagcattagtgatgactgggaagggaggtatgtcagtggggctcaacaggatgtagtctgttgggggttgggctctcaaaatagtgctgtgctgtagctacttagaactcagggggtgtacagattcagcataagctccctctccggagcagcattgtcatgtggtctccacatacctccctgtgttagtctcagagcccacgatggtccaggggttctcccatggctaggattgcaggagtccatggtgggaatgtggacccctgggggtctctcacttactctttccctgcattggagagcctttgcaggttgctttacttccttcttccttacttgaggtgtttcctgtcacttttctgttgaattccagtgttctctcttagatgatctatgtgaagtgtgattattacctcattattttggtttttccttgtagaggaggtgagtaccagatgcctctattcagccatcttgaagcccctctctcaacatatttgaccaactatttaacattcaggtgctcagtctattatttgcagtctggtccttgagcaagacatttgatttatatggacttgaataaaggaatatatgttcagaaagcacttggagattttatgaaattatctgtggtggtttgtttttctatagtgaattcaaaatgaaaatagagatgatgtttacaaaaagatatcacttaatttatttcattgaagaaatgtcaaatatggaaaactactcttagttaaataatattaattggcaaaatattacattttaggattgtcaggcttagacagctccaagtgtaaaaataaagttcattcagtaaactaatttattcagaatgcctttgttttctaaaagctatatatattcatacatatacagttatatagcagatttgccagtgtatttcaataggggaaattacaagcagggtcatgcatgggatgtgtttatgtagcaggcctagatctggcccccatcagtctttccttccccaccttacacactatttttttggtctgaactcagtcctatggccacacctacctgcaagggactcttggaaacatagtgtgtgtgtactgtttactctttgatgatgatgacttggtagtttcattttcaaaatcagaggaataaacattaaataaataatgatacataccattgttaccaatagactctgttgtagagcacaaaattcccctttaatctgtatacacttacaaagacaacctacattctaattttacttttgttttcttttctagctaatcacatgacaaaagggaagaattatggtttagggaaaaagaatgggacttgaaggtcagacagcccgtatttgaaccctgacttcatcattttctggctctgtgacttttcttttaagttatttaaccttcctggaaaccactgttctctctcttataaaatagagatgagtatcattgcattgttttgaggatcaaatataaagtgggtagcacaatatctggaacatagcatagggactcagtggaaactttggtaatattttctgaatgttttaaatttaaaatatatgatctttcttttacaggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaagtaagtgcaatgactgagagttcactaactttccagattttgacaactcagccctcaatggaaggcaaggattttaatatatttgaaagttaaaagaatgtactaaacagtgctatatctgcagccttataaaagtgaaaatgattatttatttgagttatctggtcattcctgagattaaaaaccacatatgaacgttactttagaggtaactcagtattttgttcaggtaagaccctttccatcttgacttaattattttgcttatgccataacagttaattcttcaagtttagaagatgttaaattgcattctattaaaatgttcagtgtaggaaaaataagtactgactatataaaccacattatactaaccaaattgacaagaaagtcaaattaaaaagtttaagtttctttgaaccagttactatttattctcagtataagctacgtggtttttttcccccgtagtaaagggagttgcctcctctaaaaatctaaagtttagatttttttattctgaagactcaatttttatatggtttattctacttctgtgtcactgtgccccagttttcagaagtataaaccaagactgttttgtaactataagttacatttaaattgctggttctatatttaggattaaagtcaaaaaagcttttatcagttgttcctcttttacaaggtcctcatagttatcagccatcaacaatgaaattaatattgccttaattctaactttaaaaattaaataaattttcagccacacagggtttatgagggtacatgttggggttaggccacatttccagtttcttacatcaaagaatgatgtatatctacatacctgaactctgccctatggatgtacctaatatgtgtcacatatcccatagagaacaagttagaccatttgctaaggtgatggctaggccaaacaaacaacaaaaaagaattgtaacagaaaaagaatgactgagcagagtcaacctatttccttagtactttggcaacagtactcatgaaataacaagataataagaagagggtggcaatcagggagaatagaaccaagattttataggtttatggtccataagcccatgaaggagcacttgaaacaggtgagagctccaagagaaggacgaaattaatacagagaagggacgactgaaggcaaactccgtctccttcctagtgcccctattaatgagtcttatcagagagaccagcagaagagtatgttttataccttagcgctgtgatgtggccacagtgtagacaaggcttgggaaagagcctactcacgtgacattcaggaagcagacccatcctgcagctgctgccaccatattccctctactccaagggccatcgtgaaaggagaggacagattgaactggtggcgaaagcagaagatgccattataaaaacaaactccaaaatctttgatgagcatgaaaaccaattctatgatgatttttccagtgggtgcaaatgtagtaggatttacatataaaccgtgggtcagactaaggtcaggaaggagctgtgataaatatggggaccagtaatgtgaggaaatataactgggaggtcttggaaacaatttagtttgcaaggcagcaaactaaaaggtagaatgtatattttgctggcccttgagaatcatactgtgactaacaagcattttcaagtcttattaacttgtttattcaacaaacatttgtgtttcttttatatgtgaggccctcttctgggtgttaaaggcacagtagtcaaaaaggaagtccctgatattagggaccatacattagtagattatataaaacagaaataaaataatacatactgtgaagaaaaatacagcaggataagaggatagaaagtgatgaaagctgctaggtttcacagagaagggagatttctctgagaatgggatatctgaatacagtgaaggagccagtcatggaatattggagaagggcattccagtcagaggaaacagtgaaacataagaaagccttgaggccagaacctgctgggcacacactgagaacagcagaggccagtgtgaaagggagaaaggtaaggccagagaggtgttgggggctacatattataggccaagataaagacgttggattgtattctaaagtgcagtggggatgcctgtcaaggatccaggaatttttaatttttatttttaggggaacactgactgttggatgatagataagagagacaagaacggaagcagggagatcatttagaggcttttgctgtaatctaggccagaggttttggtggcagacagataaataagattgttggcttcagaatatgttcatatgcttgctgatggattgggtgagggtacatgagtaagagggtaatcaagaataactccaaagtttaaggcctaagctataaccaaataaatgatagtgctattcacagagataggaaatactaaagacggagctggcttgcaggagggaaattaagagtttggtgttaatcatgttaagtttcagatctctatcaccttccaactggcaatatcaaataagcagttggttgtaaaagtctggagttaaggggagaggtttagagatacaaatgtgggagtcgccaccatatatttggtattttaagtcatgggttttagtgaagtaggacctgattcagagtaagtactaattctctttccttcctgtataaaaggcaaaggaagggagattccagctggaagagcatgaagcagtagttgagttaagccgttaaaggctgggtagaatcttagtagtcaaaattatgggaaaacacagtgaaggagtaaggaattatgtaaaccaaagccaaaagataaagaggagcaatatgtgtgcagaaaaccatggctcgctaaatgactgaggcatagacttgtcataaaaaactggtgaagaatcatcttggaaactcagggactataatcttggaatctgtagacttggaatctttattgaggggttaatggggatccttcagaagtttatgaggaggagttgatagaatgcaattcaagcagtgcttttgtaagattaatctaagtatgaagaatacatttgaaatatgtgaaaatgggaatttgataaaccagacagaaagctattataataatccacatttggctgaaaaaactggaagtatttttttaatcatcagattaaagtacattttggaaatatcaaatagaagagacaggataaagtacaggaaaaatcctgtcttctattcaggaccttgttctgttgagtgagctttagacaggttattcagtatttgtggatgcggtttctatatctataaattggaaagcaaacaagttaacctctagttcctagcaaagtatatattactttatttttactaattttgaatattgtttaataaaggatgaactctgatactttagaaagttggtatttttctgtatcaaattctgtccccactatcactatcctttttggtaataatttcaggagttacatttttgtgactgctacaactgctaataatttcaagagttagatttttgtgactgctgcaatttgaggtctttaagaaacaaaacaaaacaaccatcaggctcacaaaaatgtcactcttagtagattggatgttctttagtctaaagatcttttgcttttcaaataaaataccaattcttttcttacagagacatgtgacgcagtctgggtgtaatcgtaaattcaaatgcactgagtgtggaaaagctttcaaatacaaacatcacctaaaagagcacttaagaattcacagtggtaaatattttttttctttctataccctgaatatcatagcatatgtggtaataaataaatatcataacatgtaatctacgtacatgatcagaaactccttgcatttcttttggcatacactaattgggagaaattttatgtttattttatgttttattagagtcttaacctttgactaaagtatatcaaattaatatagtatgacatactccagatttcctaatcagaagataatatagcatgttttagtaagtacaacctgaaaacatattagctttctgatgaatgtaaatgtcattgcctcctttgcacaattagcaggggaatggaaaagagtatagagatacgatttgcacaagagaatagggaagtgaagacatcctttatttgagaaaagttgaaatggaactcaagattagaaaatattggagagctgatatagaggcaatgagagggagtgaaaggattacagcattaatgagaatctgaaagaaaaatgtgctcacccaccatcttcacctgtctattccatgtcattctgtaaattattacttacaaggttaatactattatgcgatgaaagtgttgtgtctattttaggaactcagagtaaacagagagctatatttgcatttctttggagacactacttgaacaaaagcgcaaaaggaaaacttgctggtatcccacaatgccctatgaaatctgttcatctcctgataaattttgatatgttattttagatttaaatcattttaatgaaaaaattattaaccatgaatgggaaattatgggttttcacacattgcttattttgtgaaaattatgtattgacatttacattttacaaacatcttcctacaaaaaaagtatagttggatagctttgtgaagcatagttgatgatatttatgttttattttggaactgcatttctaaaagttttactgtattgctcattaaggctaaccctcaatgttaaacgtgctgaagttaccacttgaaaatgctcaaaccaagatccttaccaaaacatttattttcacacattgattattgtttctaaaaagtagaggttgtcttttgcagcctgccacaatattctgtttcttagcttctatgctattgaacaatttttatcaataataatatattttaacaacctaccttcttaccagagatgatttaaagttgttaataaagatatagctaattcaagagggatttttaaatgttgaaatcagggcagaggaaggaaaataaagctaacagtaagattcatgtatataatgagtcatattcattttgtcatattgcagtcatggaagatttatcagatctataaataatacaaagttggaaagtataaatcagaacaaggattgaaatactggtctagaaataagaagttgaaagttaagcattggtatttaaaaatcagtctcaatcaagtagtaaatttgaatggcccagagcttaatatgagctgactgtatgctgatactgctcaaaagctaatgcaaatttaggccagatcatggaacacaaagctcccactgtactctgcactgtccactcattatgtatgtacttatttctgtcttgtttttaaaacatctaatgtgaggcttgtatacctttaacatagcaagtaattttaatttaaaaatatgtaggaaaaattaagaaacactaacatggagtaaattgttggggggacaaaatgaatgctgtgaaatgccatacatatgctggaagtggaccacaaattaagctctaaggtttaggaagaaaatgacaatcagtaaccaagacccagggtgtctgtaagtaaaaaaaaaaaaaaaaaaaaaaaaaaaaaatcagttgctagaaaaaggactattcttccttcctgataccaagtccatagaaaacgttattccttggaacaacataaagagaaaagaacaaaacagaagttatataatcctcagaaatatccttaaaataacacagcagagaatttgatagggtttcttttttaaatcagattattcaatagaagccagtcatagttcaccaaagtgctatttaggaaaagcattgctccagggtggccacgtagatacagtttaagtacacagctctctgatggtctggttgattccaagagaagatttttgagcaaaggctacccaaagtgacatctcaggactggtaccagtctgcaaaccctgtgttactcattcttgagataagtacagaaattgagagtaagcatttagcatttattataccaagactttgtgacattttactatattttataaaatattggtccacagtagattggaaacttaaaaaagaaccaaacaaagccaattggtcattcaccacaaatagtttgaaaagctcttcctagggtatctaataatggaagagctgaatatcttttaggaaacctccataactttcttttcacatgacttttgaaaagatgttgagaatcaggatccaaaattatactctctaaaattacctatattgttgctaaatactggtacccaaaaaattttgatcatgaccctatgcagaaccgtgtgtgttaataattagttgattctacctgtaggaattgagctatcatgaggaaaaggctaccagacctccactcagattagagacaaaagaacacctgcatatggctgtggtccacccccaaaaataattttccatggtcttagtaatttttgcctggaaaatttttgtatcagatgcagccaaacacccaccttagccattaaaaaaaaaaaaaagtcagtatacatagtataccgaactttgagtagtgaaacttcctgatgtaaccttcaggctaaaatacttgtaaaccctaacctccatagataaattagtgatatgcctaactaataaactgtaaagctatgaagctagaaacaaggagttttaaattaacaaatatagtgactttggctttagaataattgttgtgtaaactttctttctggcaatgataaaatatcaagataatttttaacaataataatgataactagcacttattggatccttagctatgtatagccacatgttagttatttgtatgcattaattcatatagtcctcaggataaccctatggagtaggttttattattttctactttttactgatgagaaaattgaggctcagagggcttaattaacttgtccaaggtcactcaggtagtacatggcaaagctagggctgtgatgtagtcatcctgacccaaagtcattcccttacgtaccatttctgtccccctgttttaaaaaatagtctgtatttatagatgtttatctttctagcgtctctagaaggaaaataagcatgtagttcatgtaaaaatgttatcaagtaattaaaagtgttaaaatagagatgtactagagtatattccttgttttacccccactggaaacttttgtctgttgtattttgagaattgaatcctattccaggcatcgcattggaaaaatattgataaattggagaatccccagaggtgggttaacaagcaggtaagggttctaaaacccacatcctgtgcagaatgtttgaaggacctaggtatatttaacctatataagagaagtttaagaatacatatagcagctcttgatccatttgaaggtttgacttgagaagaaaagttacacttgttctgtgtggcatcaggacaaactaggatagggaaataggcatcatagctatttttttggctcaaactcagcctgtctcttagtagaattgcctttttaaaaagtgactagcatttgttgagagcatactaagagttttgctatataatctcatatgacccctataacagtccaatgagaatgtatctgcatttgcacattgaaaaactaaggcttggacaggttaagaaaatactatgtgatggagccaggatttgaacccaaatccatggacctcaacagaaccagacaggaccatcttgtgcagggctgtccagcaggtcctaactccccttttattaaagaagctcaagcagagattagctggtgtcaagaatgatatgaaatgaactcttcattgaaaaggaggctgtactacaagggtttcttaaatctcttccaattcttatatatgattcttcaaataatcatatttattagaaaatataactcacatgtttaaactatagcattgaagttactattaagcaatttttagtagggcttaaattgattcctcactgctttcattttaattcttaaaaagagcaggagatggagagttttattttgatactaagtagacaaatcagtgtcatcacatctcatcattcaacaattagccattcactcatccaaaaaaggtttaatgagcatctttgcaacctgtactttgatgggtgcaagggataaatggcaaacaagcctcagaggctcctgccttactgaagcttatagtctgtaacctttaaattataaattagtgaactataacttaaaactcaaaggaaacattaggtttgtaggaaaatattacatttagctcggtgctttcaaaattttctaccaaagtatccctaacagccaaggagaataaatgccttttaccccacagagtctagggaagcagcttgagggaagcctctgcaagccaaaggctactttgacagtgcgtggcttttcctagcaagtcacacaaatgtgtttttctctgttttaatataaaaataatgttttatcatatccactgtcactaaaattgaaactccaaggtgctttgatacccactacagtgtttatcctgggagtatatacatttcagtttaataagccaatgcttatagaatatcttatataagttttcctcccattagggaaaaactattttcaagaaagccctatgggtacaggaattattattaatcaaagatagatattcatacttgttaagtcatatgggacattttacttatttttcttttctttaatatttctcctacagatggttgagtagagtaaaatatagaaaattatataggtcggtgaaatgggataagaaaaaacatacttgaaagagtagaatgtaattacttttgatacttgagaattatttgaagttataaagattggtggaaatattatacacatatgctgagaagattccatgattggttagcagaacatgtacctcagacttagttactagcgttcatcacatctatgtaggttttgaagctaaaaagtttattctaaatacagttctgtcacaagcatgcatggcagtcttctttttaaaattgataccgcttgttttagggaaatgaggatacataaaaatttatatgtaataattcagtgaatataatttgtttgtttgtttgtttaggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggtaaaaaataacctccatcctgaacctggctagtaatatgctatttgactaatttcaattaactttgtctaataaatatcagtcccgtagagccaactagattattacaaactgtcatttttaaaaggatcaatgtttgctttaacttttctggcatgatgtcttcagttggttgtttgctaatccagggtattgttaccagcttaaagtttgaaatgctattctactgaaagatgatttttaagtcccagctaaaaacctgtttgaagttagaaatcaaaaaacaaaattgaaatactcgctaattgggtttctgtttttatagctaaattcctaaaattagtaatagtttctgccttgattatggtcattaattaatgaaaatatgttcccattcacaggttcataccaggcaaacttatctatcacttttatatactaatacatctgtttataaaaggttttaattaaataaacaggaatgaagtatacaaagaacgcatcttgtgaatttactgatcattttatgaactgtgcataaacagtgttcagtcataatgtatatgaggaagtgtggctgtgaacctaaaaatacatatgcattttcctccttaactatcacagtgtttaccacaacagtgtttattctgtccaggaagaacccttgaactggtcttaccccaaaatccacaatagttttggatagagctattgtatgcctcattgtccagactttttccatgtcactgatgttgatgttttcccattttttccatcaatttctgatggaatcaaatgaatactagagacaaatttgatattttatgcaaatattttctataagtataataatttcaatatcctgctcaaacttgtatttgctgcttttgttttcccttaaatattgctattgattgggtttcctgtaattgtgataactcttgaaaaaaagttcttacgtgatcattgaattcctctaaatttttagtgtacagaacactttgcatgcctttgaatagaaaaagagccatccttagcatttcatagactcacgtgtcacgtgactagatcaagtagcagtgaaagtagaatcaagttacttcagcaccagggccactcacaaatgacagggacaaatggctgcacctctcttgcctcatagagccataagaaatgttgtgaaaaaccttcaacttttagaaaatgtgtgggtttgaggcaatggcgtggaacactctagataaggtaggaagatcttaggggacccagttccacaacaggctccctgcagggttatttggcttacataagaacgtgctgcccaaaattatctccatgagactgcctggagtttctaaaggttcattttgattagcaattatttctgttaaaaagatagaccctcctgcattgtttttccatcttgctccttagacaagtggtagagcacacctctctcttttcaaggagaccgtggaggttaaagaaccctgaagttctggaggatacaattgaaagaccaggttttaaaaatagaatgttagcttttgcttagtgaaacccagaatgagaaaaatgaaggcaaaagatgcagttagtaatgagcgattaattagcaaactaataagttaaaaccttctgcaaatttctcgtaaagtaatgattcacatgaaactaggtaaactctgttactatatattttacatgctttcttttcggtgtccttgctttctttccagtaccagttgagtatatgtctttgctatggttttgactgtgttatccccaacctcactcttgtctttgtcatctccacctgtgatctggccccacccttggggcacatgtgcagtgaagatcagtgtgcttgctttggtcaagtccttgaaagtataaaagtataagttaaagtagttctttatctcatgcttttatgtatatctcttgtttatcttttaatgttaaattacattttctcacacctttctccctctaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtatgtcagtgaacacaaacataaagtgtccatgatatgatatactggaagatgcaaaattaaaaactaaagttttagaattttctttctttttttttttttttattttgttttgagacaaggtctggctctagtcacccaggctggagtgcagtggcacgcaatctcaatctcggctcactgcaacctccgcctcccgggctcaagccatcctttcatctcagcctcctgagtagctgggactataggcacataccaccacacctggccaattttgatatagacgggttttgccatgttgcccaggctggtcttgaactaatgagctcgagccatctacccacctcggcctcccaaagtgctggtattacaggcatgagccaccacgcttgacccagaattaattttcttattttttacttatctgatctggccattttcacctgtttgcccacttctacctagtacttaaggtctgtgcctttcttttggttttttgcttcatctgtttttttgtttttttcatgacttatttcctttaagctgacacagcatttattctgtccgcattcatttaatgcaagcttatgctatattaataaaaacatagtacatagtacccattaataaaaaatatgagaccagtgggctaaagtcatagggagacaggatctggcttcataaaagaaaaagctgcttcataagcatgcggcaagctgtcctggcaagtcaagatcttttgttttaagtaagaagttctgcctaagaggttggactagaagattctaagatcctgtaattctgagatcctgtaattctgccacaaaatatgcctccttaggttgactcagggatggcaaactatagctcacaggccaaatgtgagcatacgcatgtttttctatgaggtaagaatggtagtttttgattttgtttttacatttttaaatgattggaaaagatgaaaagaatatttatgactgatgaaaattatgtgaaagtcaaatatcagcatccgtaaataaaattagttggaagacagcatcgcctattcatttacattttgtctatgtcagctttcatgctgttctacaatggcaggattgagaagctactacagagaccatttggcctgcaaagcctttaatactcactaccctttacagaaaatagttgccaactcctggcctatttcattccttccatcagtgaagtactgataaattttaacacctggttctctgaagggtggggaagccctgatttgtagtgtttgcagctttttgtggcataaatactcccatcatggtggatttcgagcttgaatgtgatgtcagcttgcagaattcctgaaaatttagcagtagactctctccagccagtacaaactggctccagcacactcctgtgtctctctctaacatgggttgctgtagaaggggctgggtttatcctgagctctttaatcccctacctgctcttccctgcccccactaccagccattatgactacagtatccatatttatctttcatattcttaactgtttcagtgtattttttactcttgtgagaaaagatagaattgtttttccttcttcaatctgtggattcatacagtgacacttggaaggttcttggagctaaaaactggttacataagagaaagtcacacctctcaaaatcagccccttgtaactcagtcctctggttttcagagatctaagaagagttagaaaatccccttcctcttcaggcaaagttaaatattagcaaatatcaaagtgaaaaatatatatgaaaaactacactatttctaaaattaaaaatcatttctgcatttgttagtgttaactgcttgatagctctgaaattggacattatcgatcctgactatgatcagttgttgccagtccttttcatgtctgggcagcaacactcctgtagcccatgcgttctcaggaggggcaatattgccctcacgggccaaaacttgtttcttagggggcaaaaaagtctgagatactacaatggctgtggttttctaaagaagctcagtatatatactgtatatttatgagttttatcgtatataaaaagtgtatagtaaacattaaaatttcactgggagcagagcttgtgactaggaaaacaaaatgactaaaaagggaccttgtagtgataatgaacacaaggtgagcagcaagtctgtccctgtctgccctcactgtgctcgttcactaccagacatctcctcccagctgcacttggcccattttccacctcgctgtcatgatgcttgtatttttggcatttcaatgtcatgtagctcccattgacctaatcatctgcacagcagagtgtagagcactacgttttttaatgtaaagaacaaaccaaattgcaatattatattacaaagagtttgggacctggaaatgttttaaaaatgaaactaataaccctcccctttctacaacatgaagtaccccaaaaaccgtataaggattttatttgctgaataccaccattttatttaacagaattcttattttgcaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagt

SEQ ID NO: 16066 - DNA, 144362 bp, Human
  misc_feature (1)...(144362): n = A,T,C or G
cccagtttttaaaagtgtggaagttaaactgtaagattccacaaagaaaggtttccagaatataacatatttgccagaaactgcctttcaaagcaagtgggaaatatccttactagttcggaaaagttcagatatttaaaagaagtaaaattttgcacaccaattaaaattgaagtgcctttgtgtaactagaagtgaaatcagcacataagaactttttttgtaatttgtaatctaatttattcaagttgaagagacttgcacattatttaaaaagtataaaatgaagtcacagtcatcaaaaatacagtacagtgtgttttgaccatacagtaattagggtgattttctcaggagacttagtcacatagcatgcaacatttaaaatgtgtcttcctcagccaagagcaacaaagtgagaccagccaagagtcagtcatatgaccaccggcaaagttgccaatgcagtttttccatttcatgtgccctgtggaagggcaaaagtggaaaagcagacccaatcgcaatgggcaaaagtggaaaagcagactcaattggaatgctagtttttttcacattgtgtaagttaaaggtacaacagctgctatatgctaaattatcactagttatgggactttagttacagtacttgaatttccccccaatccaacttcttaaaatgtgttgaaataccaactagcaataagttaatttctccagtgtaattgaatagtctaacttggtatcttactccttaactgattttgactaaaattataatatttacaggaaaaaaaaaagttcagagttaaaagaataccatgaaagggcaaatgattttatggacaaactttgaactgcatcttcactgttcattaccttactgtatttgctaaggaagctaagatctcatttaatttttgtgtgctttgctttggttcaaaactaacatcacattctcagaacttggtcaggccttaatcaaataaaatgctattgagcttccacttggtctttccactctgctaagtgcaaagacagttctggagaaatcagtcgtggctcatgtcctcaaggagttggtcaaaagacaaggcttggcgaatatgtacgtgccatgtcaatgaactgctacaatggaataaacttataataatgcctaacatttattgactcctcataataaggccataaactttgcatgaattaactcatagaaacgttatgacgttgtatcacaagcaatcctaatttgcagatgaggacactgaggcttagggaagttatctaacttgcctaaggttaaagcaatatactgcttttatggttgcatctttagtaatctctggggttgctgggactccagtgcgagaaagagcccgaaattcgcaaacttggatgatggggaagaaaaggtgtgctaaactcaggtcacagaggtccagtcttaatcttgttcctctgcaagccttgttgctcacacctcttgaccgacagttcgaggcaagtgctcacagcaaacttactctatgtaagccaaggccagatgtggggagaaggggctgagaaatgttagaaacgtgaacgcagtccaggcgggagaagagaagggggcctcgaggggtgcccctatgcagcccacacacacgccaggcactaacttggaaaagcaacaagcttggcgggagatcctcccgcggccggagggccctgaaccctaggccaagactcatccacaacctagggggaggcggccaccagcgccccatcgaagctaaagggctgacagaagggctgtagcggcaagtgtgcgccaacacagctgcacacgcccagacacctgaggcgctgagaggaacttccccgcgatccgccccggctgcacagagcctcttctccccgccggggccccgcccagcctcacttcttttaaaagcagcagccagcagcgcgccggtggcgtgcggctcgaaaggccgggaggacgtcatcgacgcgctgtcgagcctccagcccgcccgggtttccttcgcagtcgcgcaccgacgctcaaacgcgcgctccaacccgcagcctcctcctgcctcaccgcccgaagatggcggctctcaaactcctctcctccgggcttcggctctgcgcctctgcccgcggatctggggcaacctggtacaaggtaaagtgcgggggaagaggaaggccatgggcaggaagaacgtggaccaaaccctgagtggtgcccgcgttttcttctctgcccctacccgctctctccagcctgggatctggcatccgtggcgcggtgccctggtcacggacacgcggcgacgcgttcctggcctcgccggcccctcggatgaccgcctttgcttggttctgcagtcgcttccctgatggagcgagacgcgataaagaagcgcgcggagaggctgagaaggggcgggaggactcctggcagcgctcccgagccctttggcgctcgtcggcttccctcctggcacccgcccttggatagggactctgagggtctgaacggggggaggagggcgccagtatatggaggtttaggagtgaggcaacagcgggtaggtttgcgcccccgatgttggatctctgggcagaggaacctctagaggcccagaacctgaggctgggttagccatggctctgctcgagttcaccggggctggatgccgggtgcggcgggtgtggaatgccgctcccatcctctcctccctatttggctctgctgccccgtagactggagcgctcgccagggcgtcttgccggccaagctgggaaaccatccgaggtgtgtccctggcccgcgcctgggctgcaggggaggacaaacctttctctcgaggcccctcgtatccgggttaggggctttcggttttcagagccctttgaaatcctttttgtgccccactgccgactctccaccgagtggtatccggaggcattcccaccgtggactgacttgtggttttgccttatgcactgtcctcgcttgtaagcccacccctgtctggagccctaggagcgaattacaggaccagagcgccaggtccaggagggtggctttatccccgccgtctcaatcgcgggagcctcttccttggtattcagtaataggtctgagcttgacagcgtgccatgcacacggtgcttactcctgaagcgtgcctgcctggccccattgctctttcctgcatccaatccctgaccgctgagaacacagaggagccactgagctccttcggtaggtgctagggaatggttcagaactggaccattttactcttaaatgcctcttaggaagcatttttataactgcagatagacttggatatataaagcattattaaaagggaacttgaccttcagtgagattgcagcggtgctgaagctaatacaaaccagagcacagcgatacccttgggccgaggtcaggaacgttccttcttttgacagttactgatttgcccaactgtaatttactcacttcaagtcttttccatcttgagtatatcattaaaccatttccgaagctcagcaaacctcttcttagagggacgagatgcaaataaggggttctgctatatctcattaaaagttcatacagagttcaaacttagccctgtcaggcttgattatcataggtctaactcctgccttccactattcccctagcttgtggctcttagtgcccttattgtttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacagcccttattgtttagcactttaaatcctcacctgctgcttctgttgaactgtaccacttatctacttgtttaacttttcagatgtgtatattgtctcctcaaccagatgacagttccccgatggcagagaccatatttatgccttacacttagtctccctcaacaaacacactactctgcatagatcagatattctacacatgtttaaagtacggatgagagaaccctccaggcaaacagaaaccttgagtttttccactaaacataactaacagctaaaacgagatagttattttcttaaatgtttaacatttttataatgggcaggcccagtgtctcgcagacctgagagtgcatcagcattacctggaggttttctaaaacagattgctgtacccacccccagaatttctaatttaataggtcctgggtggggccctaaactttgcattgataagttccaggtgatgttgatgctgctggtctggggactgactgcccctttcagagttatctggcatggacttaggtgaaaatagactattgggaggtatcttcttttcttcattattactgaggggcagtggggagcatttaatactattttcactatagaaaattattagtgggaaaaaggttataagagtaccactaacactttacccaccattcatccttgaccctgtcttttcccaaatctctttccaacctctgactctcctgagctgcagtccttctggtgcaactggtgaacttcacttggatgtcagttggtgcttaaagctctttctgatccaaagcaaactagccataaagtggctttcccattccttgttttgttcttctatcactgtgcttaacagcaccagtatccatccagtatataagctggaaatcctggaaccatcttctcttctccttgctgcacttccaattgatcaccaagtgtcatatgtgtgcctctttctgaaatgttcctcagtgctgtccctggcattctttctcagcaactgtttcttccttatagctccccaattaaatactatgattgtgtttaaaattttgtaattatttaatgactactatctttgctagtttgtaagtttcattatagcaggggctatgtctgggttttattttcaatattttaactttgtagccccagtattttgtatagttggtacaaatgagtgaaggaaagaaataatgagtttccataccactttcttaattcaggcttcctttgagttgtgacatctgtttcaaaagctttgctgtcccttcgtcatggaatgatcaagtcacaaatcaacactaaagaacttactcatgtaaccaaatactacttgttccccaaaaacctatggaaataaaaaaattaaaaagaaaagaaaaaagaaactctgcagtgtggtctgtaaggctttttacaaactgcctcagtctgcttctccagcctcatcttcatgaacctctctccatgagacctgatcccgcatgtctgtaaccacacagccttttcatatcgctgaactcttactcatgtggctcccttgtttggaatcactgtcctgacaagtatttaacacctggcaaactttggttttctagtccaccaggtagaatgaattactccttcatctgtgctccttcggagcactgagtatccctccagcattggagaagaacatgtatgttccctcaataacaatgcacaccactgctgtagagaattgcctagtgttgtaactctctgtgagctccttgagatttattcttgtcacatgtgcataattggcagtgtttagttcaaggtgaaaattctacctttggtagacaccggtcctcttctggacagctaaagtattttcacacacatcactacctcttgggagtgatgccgtgctctgcaggtctgtgagtgtatccactcacatattactgccttttctttataacgtgtatctctttacttctctccatataacttctccccacttttgtttctcaaactgtgatacttggacaatatcagctgttccttgtcatttatttaactgtaaggtgacaaaataaatatcacctcatgtgaaagtaatcttaaagctaaggcctatgtctttttgaaaaccttcaacaaagatcacctgggttaatttgctacagtatgaattgtgtttaaaaacattctttgtaaaatcagtggagtgtgtgtatagggtagagtgaggtggttaaaaattaaaactaaactccaataaatgacaagttggtcttactgccctggtagagaatgaagaaaagtttgcattttccaaaggaagctaacaacccctgagtatcttctatagtccaggcacagggcttctgtatataacatcagaatatgttatatacatacataacctcagggaaactgtggataagcggtgggggggggggggtctactgtacatataaaaacaccatgtatgccataaatatatacatttgttacctgcataaatatatacatttatatacaattaaaattaaaactaaactccaataaatgacaaattgatcttactgccctagtggagaatgaagaaaagtttgcattttccaaaggaagctagtatcccctggatatcttctatagtcctgcaacagggcttctgtatataacatcatttgatccttactacattcctagaaaacaattatcatctttttgtaaacttaaaataccttctccccccatgaaaaagagatgcagtggttaagtaattttcctagattcatacaactgtggcagaattggaatttgaagcaagggtattttttgatcccaagagcatgatctattatggcacactatctcctaaactagatgttgggtttcttaggatacaatctgttgtagtataagttgacctgttagtaaatagatatcaaatgtcaacaaatattgttaactgaatatatgaataatgaaaaaaacaagtacctgcaggttcttcattgtcttgagcccttctcagattacctggaaaacatcttcactttatgcttttaacttttgattatctgggtaaacatgtcttccctaaaatacttttgaagtatatttttttgcagagagtgtggcaagctctttggtaatttctaactgtagtgaaaactatcagatgaaacaaaaaaatagaattcttgacaagcctgtagttatatgcttttatttgtgggcaggggagaggtagtgagggttaatgggtaccaaaaattagaaagaatgaataagaccttctgtttgatagcacaatagggtgactatagtcaatagcaacttaattgtacatttaaaaatagcttcaagtgtattcggattgtaactcaaaggataaatgcttgagggaatggataccttaatgtaaaaagcctctataggtatataggggaaatgagttttcttccaacttcctctctatgtgggatttgtgtttctcagcatattgaaatagttagggtgatcttactgcacagactgttgagctgtggatgaactctttaattttcttccccttccagctataagggcctgactcttcacttttgggtggaggtaatgacagcagagttatacaggaagaaatagaacactcacaaagatttattttatatcaaaaaatgagaagtggagtatgagaggtttcaaaaaacatggagagaagcatattgtagtagaaaggccctgaggtagaaggccaaataaaaccttggatctggtcttgctttaatacagttttgggtaaagtacaagatccttctaagcttcaaaaatttgacctgtgaaatgaattggttggattagatatatgcactttttaagtgtgtctaggagatatcctcaactttatcttacgatccttctgttggcctgtttattcaggctatcacacttgtaatttctaatatattaaaaaatatatgtttaaaacagaagcagatgaatagaaaagagggaaaactctttgtggctcaagccctttctgtctctgcctagacttatttctcagggtttgagcagtgtgctggcatatttttaggggaagaaaagaatgatggatatttatgctgtcaccttgaccacttcaggttgtgtctgtctgggagactgttaggcagtggatgtgagctcataactggcatgttaaggtagcagtatatcaggattcagatgttattctttctttttagcctggctgtatagtgagaataaaggagaggtgatattgagtatgaatgattgctacagaatctgctttcttgttttcttttgtgcatagtgtggatgaagtaggggaaagggaaaagtttacaactgattgctcatgaatattcactaggtgactcatttgggaccaaatagtacacagtggtaaggctagacttaccttccttgtagataatggtttgttccttttatgtagcctccataaaccttaagccccataggaggatgagttgttttgtaaggtgtttttgtccctctaggaggcattctttgacatttaagattgaacctggggcccaactctgtaggtatgtgttttgttcatattggctttaatttcttagagagcagtgctcatgtcttaatacttaactgtgttggaataaatagtacaggacttgacacatggtgggtttacagtaaatacttgttgattaatggaagattgggttaccagaaactgatgcttgatgacaccattgctatgaatttgaattccagtatatggacttttctttctactttcattcttttgggtggccacaaatgatggagttagaactttcccttatgtaatagaagacatctgttacaaggggacttcagtgataatctgtggataaaatatccatcctacttttaagtatgagtcacttaaagcgccaggcttttgaagagggggatagtatcacagacagaaaggtgaaatggtggttatggaggctgggggtgaggggttggtgagatgttggtcaaaggatacataattttatttaggaggaataaattcaagagatctgcggaacaccatggcgactatggttaataatatattttatactagaaaattgcttagagatttttaagtgtttttaccataaaaaagtgtgtgcatttataaatagcttgatttagctgttcaacaatgtatatagtatcctcccttatccaaggggaatatgttccaaaaccccagtggatgcctgacctgtgggtagtaccaaaccctatataagttgtttttcctacatatgtgtatcattcattttaatttacaaattagactatgagacattagtcacaataactaataatagaacagttataacaatatactgtaataaaagttataagaatgcattctgtctctcaaatcttattgtaccgtactttcctggggtgacagacctcagaaagggaaactgtggataaggggggtctactatccatataaaaacaccatgtatgccataaatatatacatgtattacctgtataaatatatacattatatacagttattacctggcaattaaaaacgtgtatatataaaggagataatgaaattatcatttgtctatcaattgaataaattgctacacacacaaagtaaagctgtatctccaaatgattatcaattttttttttttaatatttcagggatgtgtttgttccttttccaccagtgctcatcgccataccaagttttatacagatccagtagaagctgtaaaagacatccctgatggtgccacggttttggttggtggtgagtactaacactgttttcatgttatggtaatgtccttatgtttttaaatgaagcaggcaaatcacaatgacaaagatgtataaaaatgataattattttattatgcattatttattgtacatattataatatcatctattttattagtgtctccttcctaaaagtttagcaaggtttagcacttaatattttactttctctgtgtgcgtgcatgtgtgtgtgtatgtgtatttgtgtgtttctgttttgaaaaactgaagcttcaaagtagtcaggttttattaatagctttgaaaaaaatccctagatcccaattttttaacttaaaatgtttgcattaatctcataagcttacaccttcagagaccccgtagacatgtattgacctcccccactgccaattctattgctgcttcttgtttggactctcgagggagtttcactttgtcacccaggctggagtgcagtggtgcgatctcagtttactgcaacctctgcctctcgggttcaagccattctcctgccttagcctcccgagtagctgggattacaggcacccaccatcactcctggctaatttttgtatttttagtagagatggggtttcaccatgttggccagtctggtttcaaactcctgacctctagtcatctgcccaccttggcctcccaaagcgctgggattacaggcgtgagccacccacacccaacttgctgcctgcttctgataaataatgtcaaggattatttttagcattgatctccactcattcaagtaagtcattgaatgttcattttaaacccaatacaatttgagtaatcatggaaaatataaagaaatgacagttttgggcttaggcttccaactatgcaaaatctactcagacatattaacattcttgaaaaagttgtagaaaaactgatttacaaagcaggaaaacaatagatatatagttaagtgcaaactgaggaatgagtagccatataaactggttgcacttggcttatacttgtggttcaaagactgggcagtgatatgtgatataatggtgcaaaacatttggatacagctatatgaccatttacttagctgctgagatatatctgtgtattttgcttagtagatctaataatgtgctttgttttatttcccttttaaaaagaataacacacacttctctgaaagaacattgttaccccctttacaaattgtttattttttgggcttaatataggttttgggctatgtggaattccagagaatcttatagatgctttactgaaaactggagtaaaaggactaactgcagtcagcaacaatgcagggtaagtgtgcattttaaaaacaattggctggagagaaatgccaattcttaatatttaaacagagtttatcaatgaaatgaagttttctcctattcacatgagcaatatgtccaagcatcaaaatctagtgtttaacaaggtcaagaggggtggttacatttatccaaatgtttttggtaccatccttcataagtaaagcagacttgcttcatctagtataaagatataaattaagactttatatcttaatgtgatgtgcttttatttttctaaacttaaaatgtattgaagttagaatatatatcttcaaattaagtcttgcattttaaaatttaaatgtattgttttatgttatttattagatcatttataaagcaaggtgggcatcaatttgaaatctgtttaaagccctttcttttagcaatgccatcattctagatcataaataaagggataccattaatcacaaaaacatggctggtcttggaaggtggatatgcagccagcacttaagataataggattgcatattatagtggtcagaaataagccatcattttaataatagcatgcacattaaggtacatttagctatgttaggaaaagccatatttttatttttacaaaatggtaagtcatcagctctcaacaattaaagactttaaggattttacatttttaatcacccaattggcattttagccaattataaaagcagtttagaataaatagtgtaggttatttgggaaataaaactgatgctacttttttgtgcccatttttccttttctgagtctgtttccttctgggagactgtccctcctctttcctgtctatccacatctctcaggattagacttaagttgtatatcctcaaagtatccttatccaattatagaaacttttctagtctttattgatcttgcccctttttgagttcctttagagacttttagcctttctttgtgtgctgaattttacttatctttgatatatatgtatattacattaccaatctcctttatttacagtagttatgtattccctactgtcctgagcctgtaagtctgagtctcagagttactgtgtgttggaggggaatgggattgtagaaatcatctgtcccttgtttaactgacttttcagatcgtctgaaaatagagaagtaactgtttaagacaactcgataactcttaaacatatcttatgccctttaatttgacttgattatacatacttttgattatcagcactttcagttttccagatagctttatgcttataagggatactacagatcaatataaaattcttgatgcagaatagatgctgttatgacaaaggctgagaaatctgattatacatatgtacctacacctataattacttgtgtgtgtgtgtgtgtatatatatatatatatattacatatatatatatatatatatattactatactagtcaggtataatagttttttgagagcccaatggtcagtctatcactctaaaatgtctggttgtgtaccaatgactttgaacctcaagataaaggcagtgacccctctgctgtgcccttgttctttgttgaggaagctgcagctctgaaggagttaataatcagatgtaggccatgagctgattatggacattccctaggatttagttattttgtctgggaagggctaaccaattcctggcgatgtatacttgaacttctgtgctcagctcatgaaagatttcatttgtctcatgtaactacagaagtcctcccttattcgaggggcctgtgttctgaaatcatggctaatactcaacccaattgctgtcaatgggaatgtatttctgtttgtcttccacccacaaatttaatgtcttttccatcttaactaagctcttattatgctctgtggctataacttttgcagtttgagatatgacagcaaaactagcagatatttttctctttctttgaaatttaatggataaaagattcattcttacttagatctttcacttaaaggaagcactttatgacctctttctggcatatccaagttgcctgcaccactactcttgtgttttggggccattattaagtaagataaggactacttgaacacaagcacagcaaagactgcagcaatctatctgatcaccatcatggctactaagtgaagaacaggagagtagtatatacagtgtagatgtgctggacaaagggaggattcacaccccgggcaggatggagtaggatgatgatagctcatctcgttactcagaatggtgcaaaacttaaaacttatgaattttatatgtctggaattttccatttaatatttgtggactgcagttgactgggtaattgaaaccacatagaaaatgaaactgcagattgggtgggggatggggaaattactgtatgtcataaattagccttatatttaaatgaagcattttgtttttggtactcttgatatattaaatataattatctaatccagatttaagtatgtctaaaatgaaaagtaaacaaaagaaatacaacttggtaagtgatcccaactttatttttgtttatcttattttgacaagaattgccaattaatgagatttcagaaaatcagcaaattaaatttcagattcagagcatggaaatatttccagaacattgtctctgatgcggtatctttttgctttataataatgtgtctcattaatgaattcttggccttagactttttctagtcaccaaaatgtttgaaacccaggtttgttatgatgcaggaaaaagatcacatctctctttagtatgctaaaaaatgttggctactaaaggaaagcacccatctttttgaaggtcttatcagcattgtctttagtattaaagagctataagatggtttaatatacatgtctctattagaaatgatatgttccccatttgcaaaagatcacatctatttttctttatcttgtaagcctttataggtaagggacttgtcttactaattttttatcatcaatgtctgataataggtaagatatacacttgccaaatttgggttgtaaagtatgtggcaagaaacactctcattgtaagctgacagcattttcaagacctgaagaactggtcaggtagtgcacctggggctagcgtcttatgcactgcttgattgctatgccaggatactagtctaaaaacaaagcaaagcccatataaacaatgattctcagagctaacaaatgaataaagagatgtgatctccaaatagagccaacttaaaatgggtaatgggttgaaaagccaaagagatccagaagacagtagttagaaaaattcccaagtcaatcagtgtccaactatattctggctttactatgggcctgtaggagtttcagatattttaaactacagaaagtaaaatggatcatatctaccttcatgaattattttattacaactttattagtctgggctgtagatgatatcaaacgtaattgaattttctgagtggttgaggagtttaccaaagggagccttttcagtggaatggtcagggatgagggaaaaatgagtaataaagaacactggaatttgtattggaggggtgctgttaccagccccaggtctgaaggagtgaaggcagggagctgttactaggacctggaagaaagctttatggagggggttatccaataggctgtaacttctcagggagagagccagaggaatataaatcccaacattttcccctcacccacatcctcttgatggtgcctcccattgggtgaacccggtcagagtggctgaacccaatcagaagccagagggcaaggggacccctcaatttagtctacagggcagccatctgaggtccagatgttggagggatggtgaggccaggagaggaagagaagtgagccaaaaggagaatgggtggagtgaggttggggacatcaaagggcaactgatcacatgggaccttgcaggccactccggagacctttaattttactctgaatgaaagtaccatcacaagggtgtgagcaagagcagtgatatgttctgacttacattttatatggcttgctttggctgccatgttgtgtgggaggggaagcagggagggtttgcagtaccctggcaagatagtgcagagtaccaaggagagagtgagaaatggccagattttgaataggctttgaagggggaatcaggatttcctgatagattcaatgtggagtttgtgagagaagtcaaagatcgctgcgttagttttgggctgaggatctgtaaggtgagcctgccatgaggtgagatgggaaggctgcagtggagttgaatttgggggaatagaattgtggggacctagccaggtactaggagtaggttaaaaactcagaaggcattgtgtgcattgagagtaatgggaagacagcccttgaacaacggaatccttaggcctctggtgacctctagtggacaaatgtattcttaacttgccgggcattctagctcaaaagtacactcttgaaaatgcttatgttacttaggcattagttttcttttgaaccaagtgagagtaagtcatgcagctatttcttttctacccatggtggatgggaaatcttatcagattcagcatttgaaggctaggggtgcaaaacacgttgagtaggaggttgacagttacctgttacctagacactttgaagtgttcattgtgtcaggagtgccgggggtaggaaagaggtttggaaatgaaattctgagaattgggaaggaatcagctgagctggagtggtcacttgtcggtgtgaggagtatgagagtggagagtggaatgaagttgggagaacaggtggcatcaggagaaatgtcagtggtttgtcacatacttaacacctttccagatcaagtaagtaggcgtcactagtgcttgttaatttcccccaaccaactttctttatattccatcaccaaagccagaattctggagtgggtctgcagcttcatcaggatgggcaacaagtcttatgaattatttcccccaaagaccctcttgatttctcccttctccattcccattcccactgctcagactctcactgttggttgtttggactacttcgagcctcttcattgatatcccggcctttcatctttcaagctttccagctaatcatactgttatatttccgcttaaaactttttacagggacttcctgtctttcaggatgaaatcccacaaggctgatcacaactggtcctgccttctcccctcccacatgctgttgccctcagtccatactccaggaacactgaacatgtagtttcctgagtgcatctttgcaaagctgtctatctgtctgtttttctctacacctccaccccacacactgttctcgagatgttttcttttttcctatgtctgtgtaagtgccacctcctgtaagattttttctgctatctttctcctccccaaaagttgggttctccattttcagaattatcacaatttgtgcctaattcccttagcatgtctctccctctgttgtaattataggttacgtgtttattttctcagtttcaaagctgcccaggaccaggtcttattcatgattgtagctccagagcctgacacagggatagaataagcactcagtaagggagttttagatgaattaacaaacctgtggtagaataagcactcagtaacggagtttcagatgaatgaactgtgtagatgacacaagctctgtagggaaggaaccatcagagcactaaaggaattaggagggagagattgtaaataaaaacttctgtttctaggaagcactctggtccttatcactacatttctgtctcttaaaaggctttcttgaagcatagtatggagtaatatagaaaagtgaacatctcataaatacagtttgatggagttttacaagctgcacacccatgtcatcaatgcccagatagataaatggaacatgaccagtaccccaggaagccctcttcctgctccttccagtcgctgttctcttctcccactaccaatattaatcgttagccttacttttgattctcatagatttgttttgtctgattttgaacatcatattaaaggaatatttcagagtataatcttgtgtctggctttagctcaacattattctgtgagattcaaccattgttactgatggttatagatgagtcattctcactgctataccccacttcattatgtagtatgccacaattatctattttgctgatgagcatttgggaggctccaattttggccataatgaacagtgctgctatgaattttcttgcacatgtcttgtgatgaacctaagtatgcatttctgttggttatagacccagaatggaattgctgacccatagcatatggatatattgaacattagtaggtactaacagtttttccaaggtggtcatttcagtttaaattccccttggcacatatgagagttctgattgtttcacatctttgtcgagacttggtatttttttcttttttagccatcccttcatgtttgtggtggtgtctcatcatactttttgccattaaaagtgttttgctacgaaaaatacttccccattaaaacaatttcaccattaaaaaatatttcgccattaaaagatatttcgccattaaaaatatttcaccattaaaaaaaaattttgtcattaaaaaatttcaccattaaaaaaagcttaaggtcaagtattcttatcttagaaatgttttatttctctagttggttaaaatatttctgactcttgaatggaagatgatcttcagtctttaaggtgactgaaatggaaaaataattcattcagttatctatcttgttacattgactttgctttaaattctaggcatattttgctttgaaaaataatagaaataaagaaaggcataaacctggagaccttcacccaatgaaaaaataaagtcaacactgtgtataccatttctaagaataaattgagcgccagctttaaaataataaagatattaaactatagtatatataatttaacagatacaggattattgtttccacttaacactcttcactggcttgtgattaattttttttttgcttgtttttgttaagaatgtgtaaatcttcttgagcaaaagatttatgatatagggaaaatgttcatagctatttataatttgggtccacatttcaatgagcatgttaatctctcttttaaataccagaatgcccctctctcctttttagaagtgaaagagcttctccatccaaatcttcattttgggtcagtatattgtcactgcatttatgtgttccttcaaagcataggacaagaaccaattcatctctttgcttatcttctaactcagaatcactctgcagccgtgaaaataacaaaaggtgcggggtaaaactgtagggttgacatgggtgtgaatattggctgtatgtcccttactgcccaagaccttgccctgtgcatgccccgctcccacaaaaaaataacttaaacttcttgacttttagtttcctcaactgtaaaataaaaggatagctaccttgcaaaagttttggggttatgggagactaagaatgtggatcaaatgcctataagaaaggatttatttttctttaaattaacaaagttttatctctttaaaaagatgtaatagtgttctgtcagatgctctttggtaagctcccttcattttccttctagggttgacaattttggtttggggcttttgcttcggtccaagcagataaaacgcatggtctcttcatatgtgggagaaaatgcagaatttgaacgacagtacttatctggtgaattagaagtggagctgacaccacaggtgagaaaatttgcttttcttttataatactaacttactttaaaaattccttttttctccgtggaaatttctttgtgcaaaagaggtaaggcagaaggaatagtactttgccaaaccagggaattttgtttctaactcacacctgttgattgctggaggattaatattttcttctactgtgtactgaaaaaggagatatttctaaaagatatccaggctgcaagataagattttaagtttggcactgtaatgtgtattgtgccagaagcatacaaaaggatttgctggaatgtttgagaatcatcctaaaaagttaatttataggaatttatttttatttttttttttgaggcagagtcttactgtgtcacccagggtggagtgcggcggtgtgatctcggctcactgcaaactccacctcccgagttcaagcaattctcctgcctcggcctcctgagaagctgagatttgagattacaggcatgtgccaccacgcccagctacttttgttttctgtatttttagtagagacgggatttcaccatgttggccaggctggtctcgaactcctgacctcaaatgagccgcctgccttggcctcacaggtgtaagccaccatgcctctccaatttctatgaattttagaactagaaatttatgggtgatctggtcttgctgagacacttcagagtgaagcccttgaaaggtgcatgtgactatatctgagtaagtgctgggatcagaacctagattcccagggaactgatgttactacaaagcaagcagttactataattaatctagcaacttttcactcattttctatgtcatctcttaactaattggagttattcataaagaaaggaaaactttctgaaatctttaagtaaaatgagggtctacagtttgctcttctttcattttgacatgctctgctctcagctcttgaactgagccactccgctttattttagtcaacagaaaatattgctactgactttgccaagttggtaataacataatttagtagatttttaaaaattagtaatgaaatcatggtgtgtttgtctagaaagcacacatgggaactattctgaggctcgtgttgcagtcacacctggtcactctatagcaccgttacctgtacataccatagcattgcactgggcttggtatttactcaattttctcagttttttgaaaaaacaaaaacaaaaaaaacaaagatgtcttagtctgctcaggctgctataacaaaatatcacagactggtggcttaaacaacagaagtttctcacagttctgaaggcttggaagtcctccttggcttgcagatggccgacttctcacggttcttgcatggcggagagcatgcatgctcactctctgggtgtctcttcttgtaggaacactaatcataccagatcagggcccaacctttttgacttccttcaaccttgatgacctccttataggccctatctcaatacagtcacactggtgactaggaattcaacatatgaattttggggagaacacagttcggtccatagcagtatttttcacatggtaggttaagatacagtattctttgggttgtggaactattgaaaattaaccttttgattacccttggtatcttttatgttactccttatttcgtcagaaagtacgtacatcattaatatatcatttttttttttacagtttttcctcaggctaagagaggtcagtgtctccttccccaacttagtggcccgttagtaaacactggctctggcagcttattttgcagcctgaaggctagggggaggagtatcgatggtggggatcaggagttctttggtgggtgagggtaaggagctggtggcacctacagaaggcctatctgcagaaatagtccactttcaggcccttacctggtatgatagaaggagagtattcagggagggtatatataaaacatattttaaggcaaggggtagtgttatggtaattttgatgatttaattttttgtaaatgttactaacttcacaacacaaggtagagtcatctctttccgttggctagataatcagttatctggaagattttcagttataccccaagtctctgtttccccagaatattccacctacttgaatgactcaatgtctcaagtcccaactgttagtttcttttttgagttgaatacttagagtcctgttaaagtagaaaatactttttaaggttgggacaatatgaacacatcatcattaataccatgaaccaattcttttttttcttaaagaggcagatctcattatgttgcccaggctggactcaaactcctggcctcaagtgatccttcacctcccaaagcactgggatttacaggcatgagccatggtgtccagccccaatttttaactactgactagccagtcagttttctagtaagactgttgtaacaagtctatcacagtaggcgtcaaggttaggaagggtgtcaaggttcagggccagagttgattccttagggaaaacctgggtagaaaaacagttgagagtgagagagccagggaaactagtcttgaaatcactggtacctaggaagaagagtcacccatcggaaagatgatgatcaaaagaagatacaaagtaactttgcttgcagctgtttctactctgaaacaatttgatgtactcttggcttttaaaaaccaatttaccagtatgctgtatttttcactttgttttttttcttagacgatttgtagataaaaatatttatgaaaatggtttaaaataagctctaaaatttaaacactttacattattaacttgaataaaatttaggccataccaacatagatcatgaaataaaacaaaatttaactgcattacttaatatatataactaaagtttcataattcagattttaaaattgacttagaatatcaaaaatagacacatttaaatgtgtcaagagatcattgagaggtatggaagctcaatgcatgactatacaaataagcggttacattttgaatgtggatttagaatggttctagaggggcagtaacttcttaaaattgatcttctagcatacaatattagtgaagtatgctaatgtacaatgctagctactttttagaattataagcctctagatagtaggaaccacgtctaaatgtttgtgtccacatagagaagtgtgcttagtgaacttatggggtgttggttgctcacttgcagggcacacttgcagagaggatccgtgcaggcggggctggagttcctgcattttacaccccaacagggtatgggaccctggtacaagaaggaggatcgcccatcaaatacaacaaagatggcagtgttgccattgccagtaagccaagagaggtaagaaacactcttaaccagattataccaggatccctctttccacgtgggattttgggtggatcattgggcaaataagtataaaatcacctctatgtgagaaaaagcactcattcattttcataaataggtgaaatttctagctaaatctgggcatccactagcatttaaaatcacgtagagaaactacaataaaaagaaggaaaaaatggtgtaatccacatatggtgtactagtcaaggttagttacttgaactgattttatggtaggctttaacaaattgagaaacagttatacttgctgattatgcttatatggaaaataaagtagttgtggtatgcatgctagcaaactctttatgctcaggcccttcctaaagtgactgtaggaagaaaaaacaaggaaataatatgtttgtctgaaaccttgaaaggaactgttatgatagaatagagagttcatatggtcactatttattttgtatcttggacacatttgagcttttgatggaataacctacttctatttaaagtgctgagtaggatggggtacatctatcctaggcatattatagaagagtagaatttcagataaaggtatttgagatgctcaggttggagaaaatttcaaaaattacactggccagtatttcattacggtattttttagtatctttccattttcctgtccaaatggccgaagaaagttaacacaggttgcagaaatgctgtagtcatctctggggaagtgaacgtagtaaatcaggggatctcttatcacttttctgcatatggggatgctggctgtgcccctcccattcctaggaacgatcagagggaagattggaggtcactgaatatgtcctttgatgttcactgttgatctccagctgcatcttccatctggagacatctttctgttgagagtgatctatgtggattcaaagcttttattaatgtgttttttagattctggatattagccctttgtccgaagagtaggttgcgaaaattttctcccattttgtaggttgcctgttcactctgatggtagtttcttttgctgtgcagaagctctttagtttaattagaccccatttgtcaattttggcttttgttgccattgcttttggtgttttatacatgaagtccttgcccatgcctatgtcctgaatggtaatgcctaggttttcttctagagtttttatggttttaggtctaacgtttaagtctttaatccatcttgaattgatttttgtataaggtgtaaggaagggatccagtttcagctttgtacatatggctagccagttttcccagcaccatttattaaatagggaatcctttccccattgcttgtttttctgcaggtttgtcaaaaatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccggctttgttcttttggcttaggattgacttggcgatgcgggctcttttttggttccatatgaactttaaagtagtttttttccaattctgtgaagaaagtcattggtagcttgatggggatggcattgaatctgtaaattaccttgggcagtatggccattttcacgatattgattcttcctacccatgagcatggaatattcttccatttgtttgtatcctcttttatttccttgagcagtggtttgtagttctccttgaagaggtccttcacatcccttgtaaaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaatacccttgatttccttctcctgcctaattgcccttgccagagcttccaacactatgttgaataggagtggtgagagagggcatccctgtcttgtgccagttttcaaagggaatgcttccagtttttgcccattcagtatgatattggctgtgggtttgtcatagatagctcttattatcttgagatatgtcccatcaatacctaatttattgagagtttttagcatgaagggttgttgaattttgtcacggtcttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgagtctctgcctggctttggtatcaggatgatgctggcctcataaaatgagttagggaggattccctctttttctattgattggaatagtttaagaaggaatggtaccagttcctccttgtacctctggtaggattcagctgtgaatccatctggtcctggactgtttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcagttttgttgatcctttcaaaaacaaatttacaagaaaaaaacaaccccatcaaaaagtgggcgaaggacatgaacagacacttctcaaaagaagacatttatgcagccaaaaaacatgaaaaaatgctcaccatcactggccatcagagaaatgcaaatcaaaaccacaatgagataccatctcacaccagttagaatggcaatcattaaaaagtcaggaaacaacaagtgctggagaggatgtggagaaataggaatacttttacactgttggtgggactataaactagttcaacccttgtggaagtcagtgtggcgattcctcagggatctagaactagaaataccatttgaccagcatcccattactgggtatctacccaaaggactataaatcatgctgctttaaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagaacacatggacacaggaaggggaacatcacactctggggactgttgtggggtcgggggaggggggagggatagcattgggagatatccctaatgctagatgatgagttagtgggtgcagcacaccagcatggcacatgtatacatatgtaactaacctgcacattgtgcacatgtaccctaaaacttaaagtataataataataaataaataaatacatacatacatacataaataaataaagagaagacttctggattggaaggcagaaaatgagtgcaattagggagggaatgcagggggatttaaactgaatattaatgttctatttcttaagctggtgttataaaaatgtataagtactgcatatatttttaaaatgctacataagcatattttgtacatttttatatgataaattttacattaaaatattttaagataaaaaatgtgttttttatgtttgatctttttcctttactgtctaaataagtttaaaaggcttcttgacaaagtaaaagacaggagcctaattgttaaaatgaactgtagtagtatctcataaagttcccggaaaacttgggataaatactttgatagcttgctagaagttgaaaaattaattcacctcgtgaaaatatgagactaaaatatttcttaggttcatttctgcctggaatcaggtgcctcaaactcgtagttttttaattttgtctgaattccctaggaatatgacagataatttatttcttaattcttagtactttttttttttacttaaagcaggaaaaagtgagttcatttctaaattagtgttatttattgaggtcctactctttgccaaaccctggtctaagcactgtggtaaaatgatctagatcaagtcctcctgctagtggaggaactgacaatgaatgaataaatgcataatgtctatagtggaagtactgtgaagacaaatcaagtagattaacagcaaagagaattaattatcactggccaggcagctgatattccagactggtggccagggagagcttctttggggaggtgacacttggtagagacctgaataaggtaggagaacgaggcaagtggagataagagggtttgtgctctgttcagaaggaagagtaagtacaaggtgctgaggcagctacaggcttgccctgtttggggaacaggagggtggtgaggctggaacagcacatgaggcagagagtgataaggatggagattgaagagaggcaggagtcaaattcatgcaaagtttgaattttacggaacgcagtgggaagcctatggagttttgaataagggtgagagtgatgtaatttgagttgtcttttgtaactatcactgtggctgctggggtggtggttcttttttttttttttttgctaggaagccaagagcagaagcagcgagagagggtttaggaggctgttgtgttaatttaggagggaatggaaggtggctagaccaaggtggtaacagtggagtttgagagaagtggttgaaattggtgttatgttcatggtagagccaacaggatttactggtagataggtaaggggtgtaagaggagtcaagcatactgtgtaagatgaatgaagcacaggccttatcaaagagctctgtttggaacatggtgcattggagacgttcattagactccaagaggaggtgcttagtgaacgtcatatcaggggagagtctagagccaggatagagactttggaggcatcagcatatagtatttaaatctgtatactagatgagtgtctaggggctgagtgcagagcacctcgttgacatttagaaattgggaagagaaggagcagcaaagagaaatgggaaagagtgattagtaagtaaagaagaaacccaggggcatctggccaatttgaaagagaagggaaattttaaaaagaagggaatgatcaactgagtgtgaagaggttggtaatacagggcctggaattgaatcattggatttgcaaaaacagaggtcattgacaactttaaggattattcctttttggaatagaggggatgaaaatctcattagattcaagaaagaaccaaaaagtgaggaagtggtgactacgaaatgtagaattctttcaagtgagtataatagctagtttgacaaaaccaactccttccccatttttaaatttcagtaaaactaacactcagcaacagctggtatgtagacacatcagaaaattatgtaactagaatataaaagaagcctatttattgactttgccttgcatttgcatatatttaccccagttttctagatctgtatgtaaaacactcaactatcattgttggtatttacagtgatttttgaaatacataagccgttccaaaataactttgtatattgatatgtggctcagaaatatctttcatataatttatcttagttcctatagtaagatcctcattcatcagttattccctaagtgcattaatcttttttctagcaggcaacttggttaatgtctttaaagtagcctttatttaagaaaggttttgtttcaaaccatagttgaaataaatgtaccaaaattttctattttctatagcagctttttgtaaaacgcacttagtctgtttttccactagggggtgcggtagggatgagaatggagttctacattcacatggctccattttgtgcagtgatggagtgtggcaatggatgcttgttttaattcccggaaataaaccgtcaagaataaaagaacatgatggcaagacagttttgctttatgttcttccctccaaaattggtagtataattaaaaggcaataaacataaataaaaatcaatagcattccctagatcagtaatgtcagaagagtagataggagcaaatgtaacattcacagtagcaagagaaaccactaagtacctataaataaacctaagaaaaaaaataaagcttttatggagaaaataataaaactattgaaggaggtcgaagaaaacctcagtaaatggagacatatactatgctcatgggtgggaagatagggcttgttggttttctccaaatttactgattctgtgaatcccatttaaaatctcaacaggtgatataggttattgaggatagctgaatgatagatttttgtaactattttatgtaggaaaacaatacatagaccattttatgcaaactgttttttcaggggagagggaaagaaggactatttttcacattcaatatacaacctgtacatacaaatagtaaaatgaaaatagtctatccctcaggccatagaactttcagttcctcaaatgcacaaattttcttttgtcactggacctttgcttgtctgtttccttagctccccttagaccactttgactaagtcctgcttgcctaacactgcttatctttgaagtctctgggatgcttttccctctgagaaattttccctcagtaggcttgtatccttattatctacctctatcagagtgcctctatcacaatcaagacctatgcaaatacctgatgatgccttctccctcttctgcaggtgagggagttcaatggtcagcactttattttggaggaagcaattacaggggattttgctttggtgaaagcctggaaggcggaccgagcaggaaacgtgattttcaggtattgtgatagttttaaaaacactcgtgcgtatcagcaactctaaaaatggacatcagagtgaatttggaatttaaaaatgtattttcgtaatggcccaaaatcatacatgcccatgtgtattgcacatatataggtgtgtgcagggctgctggtatgtccacttgtgggagtctgtttagactggtcgatatctatgttgcactgcttgttaaatatttggatctatatgcccttttatataggcacatgcagttgtttttctccttgtgtattttagttgccaagaccagttacatgcttagaaaatgtgacatcatacaattttatttaattgatattgtaatttacatgtattgtcttaaaatgtcaaagctaatttgatactctggaaagatactgctaataatcattggggtcagtccttcagtccttttggtgtcttctaggaaatgcttacaaaggttctatctgaaaaattgattaacctttataatactgaattttcaatcctctcagccacagactttatagattttaaaatcttttggttattctaagcatactaagtatttatatcttggatttatagatttatatagttgttttttgaggaatatgaaacctttgagtgtacacttaagagttttccaaactgatcttgaagactttacctatcagattacagaaatcattgtttttgcttatttatcatttgctgctttcgattaacaatttttaaatctttagcaaatgcagctttggtgcaattacagttaagttctcagtgatactctcatatcactttttatttctgaaggacttatgtgatattaatgctctttgatttctttaatttagccagttttttaaagtacaactaattttggcaataacaggagtaattttacatcatctttaccttatttgacacgtttgtgtaatatttacacgtttagttgctttttaaaaaagattaacaaaattgtatactaccaaacagaaaggaattattgaaaatattcccatgtttattctgcgctgcagtgcctggctctggtatttgaaggctgcacaagggctattctgggcactgactttatgctggtggttaatgagttcgggtgtgaaatgaaagcttgcatcaccaatggtcaagtgaccttaggattaacttcatatttagtgggacagctggaacagaagtctgtctaggttattcaagtgggggacttgggactcctttgcctctgaccattctgcccttggagcttttgatgcctggatgtctggtgggatctaacccagcaacttgtgaaagttcacgagggctcctttctcaaggatgctcctattcctgtactcattcttcaatctgagcaaaagaaatattggtggctcaaaagagctagtaaaacatagctgtgacttacttccttttaccaaagaaattctgccatcaacgtatattcccagagacaaaaaatatgttttaatttttaccattaggggaactgtattgaggaacatcagagtgcaaaaccatcggcaaaattggcacctgctagaaatttttacacctcggggtctgatgtgggtgttatacttccaaaaacttcatcagaaaatgattctccagaatgatctttatagttgactcacaaattatcaatgaatgtttcatttagtttcagcaataggcttctcttcaatagagaatgtaattactgtaccttctcatgtgaagcatttgctacttttcctttcttaatattttaatgaaagcaagtggttgaatgaaatatttaactaatagggacaaagcatacttgttaaaagattaagggaaattaacttcaaataagatagatttattaatattcctttttttgttgtagctatatgttgaatgtgaaaaatagttcctctttccctcaatcctgttcaaaacaaaactatatacattgaataaagtagttatggtttttaaaatttatgagatatttatgaaactttattaatggaaaatatgatacactctttttggaaagattcttagattcttagttcatagaaattctaatctataaaaccttaaaggtgacagagatgcttatttttcgtcttttcccccccactttcttatctcctccacccctgtaggaaaagtgcaaggaatttcaacttgccaatgtgcaaagctgcagaaaccacagtggtagaggtaagaggttatttttgaattcttggtgttaattatttaacttgatgttaagtattaattcaagaaaaagtaccacagttcatttgttttatggataacaatgacagcttttttttttgttttggaaatggatccattctatctaaatatataatagttaaaattttgctgtaacttcagctttctggttagatagggtctcactagaatgctctctttgggaatcaagcaatgggaccagcttataaaagtcttttgatccttaaatgaaatagatctccttgaatgaaatcccaagatgaatttatgtatgtggaatccctggaaaacagtaaatgtgtcagaagaagttcatgatcttactgtgatagattttgtgatttctttaagggaagagcattgcacatataactactttgatgtggttcaattcagagcaaattcaggcactgactgtcctttgggtatctcagtgtttggaaggggcttggataattctgcagcctttccaggcttaaggacccagggcagaaacaggggcttataccaaaaccgtgccattttggttgtaacatattgaacctcaaagaagacttcaaatggttcttaacttgaggctttgaggatcaacttggaacccaattttcgtgggagtttgaggtagtttttccttgggagggctttataggacccctattgggatctggaattgaaaatacataggttcctgattgatttttctcatgatggcaggtgttgtatgtggtatcttttgattcatttttacaaggccaagataatgtttcatgaagtcagtacagtgtattttgaaacaatcaaatgttagagttttgttcctttcttggaaaatgaagtgtgctatttttaaattgctgaagtatatgttactttcaaccgaggcatggtggtttcttttgcaatggctttacattttctgaatttaaaatggatagtgtggcttacactttctgtgtaacctgtctttaatttattcatccatcttaatgacctgtccgtggcacacaactatagcattactgaaaaaaggcctacagcatagcttaaaataatcaatagttttacaccctgttgacttcctgtatttctgtaaaactgtcagaaaccagtatttctttccagagtacagaggggcgttatgcattatcctgggtgaagttctctttaaaatttttcctgttataatctggttcttttcagttcatctcatttcttacaagagcagaaaataaccttgtgttgaagaatcattgcaggtattaggaaagagaggctctcttttggcctaaggagagaaaatcctttaactaagcctgcaaatgtaataaaggcttccctcctgtgtcccggaacagacatctctgatggatcacagaatgctttcctggtaggccgagacacacattagggtctctttcaatacagtaatgtgcgcaaccactcctaattcactacactctccagtatggtagccactagccacatgtgacttataaaattaaaattatggcacagtggctcaggcctaatttatcgcagcactttggaaggctgaggcaggtggatcgcttgagcctagatgttcaagggcaacatggtgaaaccctgtgtctacaaaaaattagccagacgtggtggcatgtgcctaagtcccagctacccaggagctgaggtctgaggatcgcctgagtccaggaggtcaaggctgcagtgagctgtgactgtgtcactgtggctccagcctgggccacacagtgagaccctgtctcaaaaaaaaaaaaaaaaattgactgagaaattgaatttacctttatactagtcccatatcaagcaaagctacatgtggctagtgattactgtattgattagcacaagtaaacattatcattgcaggaagttttattggacaaagctggattagaaggatcaagaataatctgttatactagtacaggaacataagcaaaacagctctttggactataggattattgtaagcctacccctgacacctgttcatagtagaaacatatagtatacatagtagaaacatgaccatagattgaattgtaagaactgtgctctcaaaagtggaaaataatttggaattggggttagtgcctagattgggcattttctgatgtgaaactctgttttggctttgtgatttgtattttgagtccagtgagtaccctggacctccagccccctgttctgtgctataccctatgcactccgttacctgcgctggcctccaggttgctatgacttttcaagccctatcttgctttcttttatgggagtcatagtgggatggatgattataagctggtctctgaagtgcaacatttaagaggaatcttcagggatcattaagttaactgcatattcttctgcatgcaaaatgccaataatgttagctactattcaggcatttatgatgtattagtcactaccgtattccttatgtgcattattttaaattctcacaatagtcctatgagataggaataataattatctttattttagagatgatgactttaaggcatagagaggttaagttatatacccaatgtcacacagcttaggtggaaccaggagagacccacagagaaactgattccaggctgtctactcttttccattatgtaatgaaatgcttccatgttatctatcaatggatgctttaaactcttggaagatattgaatctccagaagtagtccatttcattgctaactattagatacaagcaaataaggagtttttttttttttttgcccagcttatttttctatcccagaccttccttgacaattatttcaattgtagtcttttttttttttgttctagtaccatctaccttagagatgtctttgagaaaggcatcatcctgtgttcagtggccccgtgcattcattcagtctttctcttggactcttttcattcgattgtctagcctctttgacctttaagctttttacatatttctctaaatgtggtgactgaatgtctgttctagtactatagtatcttaagcagtgggaggcataacagtgtgactacaccctatataacatagtcaacggcgtctttttttttttttcttaaataaagaactcttagctcatctcctttcttttgaattgtggaatctggattagagcttgtctcctaaagctctgtgccagcatcttcccactccacaatgctgcatcttctcaacctttcttctccctggtgatttgagttttgacttgagttttaaagaggatagaactataaatatttaaagtactaagattcccttaggcatcttaaatttgttttggatttagaagcagggtggcaaaggaacatacatcttgcttttttgtttataatttttaaattatataatttacagcaaatgttttacatcaagaagtaaatgagtatgtttattgtgaatttaaaagaaaatcaaattgtccttgatgttacttatttctagactctgcaaaagggaaacattagtcctttttggcaaagttttgttttcagatgtgttctagaccaagggccccaaccctcaggccatggacctgtactggcccatggtctgttaggaactgggccgcacagtgggagatgagtggtgggtgagtgagcattactgcctgagctctgcctcctgttagatcagccctggcattatattctcataggagtgggaaccctgttatgaactctgcatgtgagggatctaggttgctcgctccttatgagaatctaactaacgcctgatgatctgaggtggaacagtttcatcccaaaaccacgtccctgcccaacccccatctgtggaaaaagtgtcttccacaaaactgatccctagtaccagccaaaaaagctggggaccacttttctagataaacttatgagttgtgtaaaaccatagaggtgatcacttatgtctgtttttaacaaaaccaatatgaacattacattcatatttcttaaaatgtgcagccatttgcatgcttccccacaaagttgtgacacagttgatgctggctgtatcttcctacccctcttatggacctaggtagctacttgggaaaaatagtgcacatgggcgcatattgccacacatgctagagagatgtttctcttttcagtccagacagtgttatttctggacctccctctctttgagtgagggtgaagtcttccctgataaactttacaagttcaagtgcaaaaccagccagggaatgactcttgggtgttgccttccatgtgtatgacaaggagtagcaaggactcttgagtcttccaaagggaactaatttggctgtttctcaggaggaatcctgttattgtgttaagctctcaactccctatgagcccctctgctagtcttctgtgtgcataacctaccatctaagtttctctggaaatggcctatttctgtttttttttgaaggagcctgtaatagaaaacctatggggagggatgagagtgcttcactcaggagactgttgatgctttgtctcctgcaagcagcctggcatgcacgtgctgtcagaaaaggtcgtctgactcagccactgaagctgctgaggctgcctgtgactgaaataacctcactgctgtggatttctttgtgctgtcaggcttgtgccatggctagtttacgagacagcaaaggtttacccaaggccctttcaactattttagttaacttcagctttcagtcaaaacaagtacatttatcatgacataaatataattacttttattgtatttatattgtggtatgtttgcctgtaaaagaattgcttagatgatacgatatttggtgcacacaaatatttattgtagcctgtgtggtttatgaatcacaatataaattgaatatcggtgaacccatctaatataagaattagaggttaatggacatatagaaaattattttcaaaagtgatattctaagacttatttataagagccaggcttcagggagctgtatcttctgtgttctatactggtgcctggcatgtgccattgttttaaaatttttaaatttttgtggatacatagtaggtgtatatatttatgattattgggctgttcagattcttaatttctttctggttcaatcttgataggttatatatgtctaggaatttattcatttcttctagattttccaatttattggcatatagttgctcctagtagccactaacgactctttgaatttcttatgagttttaatgtcccctttttcatctctgattttatttgggtcttcatccctacccccacccccaccgttgttagtctggctaaaggtttgtcaattttgtttatcttctcaaaataccaactttttgtttcattgttcttttgtattttcttcatttcaaatttatttctgctctgatctatatttcttttactagttttgggtttggtttgctcttttctagttctttaagttacatcattaggttatttctttttcttttttgatgtaggcacttatagctgtaaattttcctcttagtaatttttatctgatgaaatgttctgtagatctctattaggttcattctgtagtgcagattaagtcctatgtctctgacttttcttcctgagaaatctgtcagtgctgaaaatggggtgtggaagtctccagctgttgtattttaatctgtctctctttagctctaataatatttgctctatgtatccggctgccccagtgttgggtgtgtatatatttataatcattgtatcctcttgctgaattgacccctttatcattatatgataagcttctttgtctcttcttacagtttttctcttgaaatctattttgtctgatgtaagtatagctactcctgttctgttttgtttttttttttttttttgtgggtttccattggcatgggatatatttttccatccctttatttttggtctctgtgtagctttataggtgaaccatgtctcttgtagacaacagaccactgggtcttaacttttttcatccattcagctactgtgtcttattggagagtttagtccatttacagtcaatgttattattgataagtagggacttattcgtgccattttgttttttgttttctggttgttttgtggtcttctttcttctttccttccttcctgtcttccttctagtgaaggtgatttttctttggggtgctttgatttcttgctttttattttttatgaatctgtagttttttttgtatttgatgttagcatgaggcttgaaaagactgtcttataactcgttattttaaactgatgaaaacttaacactaattgcataaacaaataagcaaaaagaaaactaatacaaactctatgcttttttttttttgagacggaattttgctcttgttgcccaggctggagtacagtggcatgatctcgtaagtagctgggattaaaggtgcgcaccaccacgcccaactaattttttgtatttttagtagagacagggtttcatcacgttggccaagttggtctcgaactcctgacctcaggtgatctacccacctcggcctcccaaaagtgcagggattacaggcatgagccactgcatccagccaaaactctacacttttacttcacccctatgctttttaactttttgtttctcttaatttcttattgtgctatgtcttaaagttattgtagttattctaattggttctttagtctttatgcttaagagtgtttacacaccacagttgcaatgttaataatatcctgtgtttctatgtgtgcttattattaccagtgagttttgtatcttcagatgatttcttgtttgctcattaacattcttttttttttttttttcagatcaaagaactccctctatcacttcttgtaggacaggtctggtgttgatgaaatccctctgattttggttgtcttggaagttctttatttctcctccatgcttgaaagatattttgccatatatactattctagggcaaaagtttctttccttcagtcctttaaatatgtcatgctactctttcctggcttgtaatgtttccactgaaaagtctgttgccagacatgttggagctctgttgtctgttgtttcttttctcttactgcttttggaattctttatcattgattttttgggaatttgattaactcgcaaaaggtagctttggaggtagtcttccttgggttaaatttgcttggtgttctataaccttcttgtacttgaatgtttatctttctctaggtttgggacattttgttatccctttgaataaacttttctactcctatctctttctctacctcttctttaaagccagtaactcttagtattggccctttcgaggctattttctagatattgtaggtgtgcttcattgttctttatttttcttttgtctcctctgactgtattttcaataagcctgtcttcaagcttagtgattttcttctgcttgatcagttctgctatttaagagactgatgcattcagcagtatgtcagttgcatttttcaaatgtagaatttctgcttgattcttttaaattatttcagtctgttaaatttatctgatagaattctgaattccttctttgttatcttggatttcttcgtgtttcctcaaaacagctgttttgaattctgtctgaaaggtcacatatctctgtttccccaagattggtccccggtgccttattttgtttggtgaggtcatgcttccctagattgtctcaaggcctgtagatgtttgttggtgtctgggcattaaagggttaggtatttattgtagtctttgtggtcttgtcttgttagtgcctttccttgggaacgctttctaggtattcaaagggacttgggctccaaccataattgctgtggtttttgtaaacttgtaggaggtattgtcttgatggtcttagataatatccagaagaattttctgggttaccaggtagagactgctgttcttttcccttactttcctccaaacaagtggaatctctctctctctctctctctctctctgtgctgaaccgcctggaactgggggtgtggtgatacaaacacatccctatggccaccaccactgggactgtggtgggtcaggcctaaagccagcacagcactgggttttgcccaaggcctgctgttaactactacctgactaccacctattttaactcaaggccctagggctctacaataaacaggtggcgaagccagccaggtctgcattcttaccttcagtgctgtgagttccccaaatgctgtctgatttttggttcttgtgatggtgcttttctgtttacagatcgttgttaaaatttggtgctcctgaggtgtggacaaatggcttcaattccaccatcttgctccaccacctctccatctctttttaggaggttaatcagaggaaaagatcatgggtatgtctgccatcctgccaagcagacatgtagtgtttctgattggtgagtgaggaaaggtaaagattgcagtgtaactgataatacaaattttcattttaaatgtctatttttgaggataatgaacatatataatagtaagcagaggagtataatgtaccttcctgagcccaacaccttagctccaatgactatcaacccatggtcactcctgccccattcacatccccatctctttgccttctccctcctctaattgatttgaagcaagtaccagatattacagtgcaaagatagtttaaggaaagttcactgatactcaaattctagtgtactaggtatttttataggttctggaaatacagcagtgaacaaagcaaaactcactgccctcatggagtttacattctgatggtctatcttgataataggatgaataataagtaaaatatgtagtatatttgatattgctgtgttaagggaggaaaaacaaagcatgaaaagggacctgatatttcagggaaagaaactgaaacttagggtggtacagtgaaaggcctcggtgagatgacttctgagtaaaggcctcaagaaagagaggaagctagatttgcagctaactgatggtggagccttttagggccaaatgagtagtgcgtgcagaggcctgaggcaagagcttccctggtggtttggagaacagggatgacaaacttttttcattgcatggtcatagggtgtggagtcttacgagaattaactttcttgagaataatggcaatatgtttttcaaagactgtgacttttgacattggagcctcctggtatttgtgactctggccctgtttggagagctttgtgttaataattcctcatacattatcttagaagtgatcaagctggttgttttactttacaatagaaggtgggaatgcagtagattttaaccaggtgacttaagcactaaagtggatcctatgaacatttaattttcattattaagcaggccaattaatgtatcagtgttttagagatttggggcatcatgcttcttgctttagagaaatgaaaatgcctaaagagtaagcataattccttctctcttaaatttttcctattctttagactgctaatgcctaatgatacagttttaaaagcagtggaactcataatttttcaagaggcaataaaaagaatgttgggataggaagaaaaatgaagcttctgtccagataagacaaagacttctcaccatgttgaaaaacttcattagatcccatttcaagaacacacacatccatacgcaggctcattcctgtgtgaaattcattcacacacaaacatctctgacatatggaggcatatttataagaacttggctgaaatgtcaaatttggcattcactatgtgaacttactatgctacatgctctttgctgcactttagaatttacctggttaaagctctctatttcagttagctacgtagaatgaggttagcaaaaaactgttcctaatcttcttgaatctactcacatcagccagttgagttgaacacttgacacaagttcttttaagagaaagaaaaaggtgtctgtttgatacaatatggaaaaaagaaataccttccttccaccaaccctttctgaagaatccttagtccttcggcagaatactatcaccttcctaagtgctaacttttgggatggatgtagttagtgatggatatcattcacacagtttgattttttagacatggtaaattatataaaatcttcaacttacatttattttccttattctttttcagttataatattttacttgtgcttttggactttttaaaattgattactaaatcattcttaaagagatctgtaaattctgtgccacatatttagccaggtatagagtgctttgaaaatgtaatgtcctaacataagcatactgaatgaactgactgatcatacttgtttcaagagtattgaagtatttaaagacaattcattcgtttccttgaattttcatgaaatgctagattggtttgaaaattttggatgctaatgaagatgtactcaatgaagacatattgtagttgagtagtttggcaaaataacctaatagaattactgttacgttaatatttgctatttctaccaaggaagtaataaatataaaaatatggacttggtgaatgcctagtattaacttactgcattattttacatacacttgtatattaacaaatataattcttagcttaatgaccatttacacccagaagaatagcagaatagaaatagtttattggtgataaaaatatattaaacaaagtgttaatcttgacattttatttcttgttgcttggtaacaatgctgcagtaatgcgagagagttccattatctcaggtacaatggacttcattgcattgtggggtaaaaataccaattacagcaagtcatttgtatgccattatcctcacaaaattttggagctattttttatagtttatatagagatcctaaaagaaagtcattttaataatatatccccctttcttgatggattggtgaattttatcctagctatttttggctttttgtctttataatttttcaggcctcaaatttgtgtttttattaacctgtattatgtaaatccaggcttttaaatgttataaatatgcacattataagtgatacttcatagtccttattgaacatcttttatccttgaccacttaaagaagagagaaatatctgggtggaatttttttgcctcgtgaaaaatagggcatattcctcatccttctctaatatagaacttcctaattcaggacatcaggagagcctgttgaactagtgtggcttgtattaaagagaggctgattcatgttgtatagaacatttttttttctctgtaatattggttcacagttattacttacaaggattgacaaaatacagcccacggcctgtttttatacagtctgagagctaagaatatttttaaattttgaaaagaccattttttaaaaaagtatgtaacagtgtgtaccctgcaaagcctaaaatattatttaatccttcacagaaaaaagtgtgcagacccttcatttacagcataacttctatttctgtagtctgaatatattaaattactcagtatttcttaaaggatcaacatagaactgaaataactgatttgaagacaatgaatagaaaattaattagaataatgtgaatttgtatagatgtcgagaaatgactgcaattttgtgggactggttttggggcttctatgaagggaagatcttgtgcaaaaaatttgtgtatccagctgtagttgctgccatcttttaaaagcatgatgcctctgtcaatagatctgacattaatatgatataattacatattgatggactcattttattagaagcacttgcctttttcttggttatttgacttatacttgacggccagtttctcatgtatagaaatgtgtagcctggccatgtgcagtggctcatgcctgtaatcccagcaatttgggaggcctaggagggtggatcacctgaggtcaggagttcgagaccagttggccagcctggccaacatggtgaaaccccatctctactaaaaatgcaaaaaaaaaaaaattagccaggcatggtggcaagcgcctgtaatcccagctactcgggaggctgaggcaggagaattgcttgaacctgggaggcggaggttgcagtgagaggagattttgccagtgcactccagcctaggcaacaagagcaaaactccatctcaaaaacaaaacaaaacaaaaaaaaattgcacagccagatgaatgtcagtaaccaggatgatgggtggaatcttctccagcctgactagtgtccagcatgtggctgtagctcctgctggctggcagagtttccaagagctacagaaatagtccagggttgaagtcatgctgtgttcttggggtttgggagggccctatgtctctgatttttcatctgtatcatcagcaccttaggaggcggaagaacagtgttggagagactttgaggatggtgaggctgattactctttttttcccccaccagttttctaaactgccttgtagctctctcttttctttttggtcagaaacacttttgtaagacttatttatttcttatttgttggtaaggtaaagcctcaaatcaggaagtttacccagggtagcaatgtgctttcttgtcttgcaccgatcctcttaagcagcagaaaaggattgaaacagccaaggttagtgatgaatggcaagtcaattattttagctagattcatttaactcccctttcttataaacagtgttcagaacttcacacttgagcaccatttccgcagtatcttgtgtttgatattactttgcataatgctttgggcttttcaaatcactttcacatacagtatctcatcggatcctctaatcaccaggtgaagttggaggagaagcagctttattacaatattgtaaatgagaaaactgacatagataaatttcctggactcgatgactgggcagttgaatggcatgtaaaggacacttggaagacttggattaagtcctgagtctctctatgactttctggttgctctgacaatatcgaggctttatttctggatatgtataagtaggaattataaaaatctgaatgtaggtaggtatataggcatttgtaggagcttggattttaagtgcatttggaaaggtcataattttagcttgcgtattgtttgtagaacagactttagaggcataaaggggcagaccaatgaggagactgatgtgatctgggtgagagcttgaatggtggcttggacttgagtggtggagaggaggatagcattaagagatacggtatgttggaagaggaatctatccaacatgcccaggccttagatgtggagagcttggatagaggaaaggtagagattcactcctacacttggcttgagcaatgatacatcacttactgagacggggaaacctgggatgatcctgttggagtgaatcaagagctcgcttaggattgattggcttcttaggcattcaaatggtggtgacgcaggtgcagatggatatattattgtagtgcttagaggggaggtcggaaaggtagttatacaattgggaataattcacaaatacttgagttagggttatggaatggaaaagatcacttagggaaagaagctctgggactaatcctgaggaggcttatcttttttcttttcattttttttttgaacagaatatgagattaagatttgtttctcactacttttgcaaccttagacaaatgactttagaatctcgtcttccttacagcctctgttgtttgcttatttcatgggtttattttgagcatcagtgggatagagcattccagtgtgttttctaaagcttaaaaatgctacatgctcaccttaatccctcccgctgctttgattaataaaccttagatgactgttctcattgacccagtgatgatgactattgaactacattgtaaatggcagctggcaaggcacatcctctgtaacctttccctgtcttccaaagttctttatctgagaaaataaaaattccataatgcctccgattcctaaaatcttagtgcatgatcaaaaaactaaattttgttttaaaaatattgttagcttaaatccttcagaaaactaaccaatatttgaagtccataaaatcaacttaaacatgctgataccttacatcaagcaaaaactgtgatgactcttgaggggaatattatggacaccttcacgagagcaaggttcttataaatctgtcacttcatagcttgagttgtacaccctcaaattgatgacctctctctgcctttgtatttgaaatatggagcattagttaatgacccattttatctctttttatactttggctcaaaagattcacatattttggtttgggatgaagactaaagttatttcctgcttaaaacttgcttgtgctgaataaccactgtgacttttttattctttaagaaagaaaagtttacttagctcatgattttagtgggtacaaagtccaagactgggtagctgtgtctggtgagggcctcatgctgcttccactcatggcctaaattggaggaggagtgggtgtgcacaaagagatcatgtgatgagagaggaggcaagagccatatgacttcttttgaatgaaagtcacatctgttgttcttttggggacataaataaagagggcctcagatactgatgctttctgttcacctgtgggcatacaactccctgaacacagagggacttaaggtccaaaatgtaagttatgtggaaggaagtgttttcttttcttccttatgatagctttgccttattgaatttttatagaattatgaaaatatctttttgtttttggatggaatattttaaaacagttaacagttcctaagactaggaaccaagagttacttaactgttagaatgtaatggtcttctactctgtggtttattccatgaagaaatcaagtccactcatgtctaagactagagtttaccttctctggttcagctttttcaagtttaatgataatacacagtgtttctgccactgagtaacaaagtccacattcagattcttcaaccactcatgtccaaaagtataggtcaccttctctcttattcagcctttgaagtttaatgataatatacagtgtttctgccactgagaacatatttgggttcttcgaagagaattctaaatacaaatcctacctgaggaaagttaaactggaatgtgaagaaccctgctaccttttctgtgccttctgtgaaaaggatctgggtgattcatttaaagaatctattttagtttccttaatagttgcagaaaaggatacaagttttgccatgtattgtgaaaaagttctgttcagttttgaatttcactttaaattttggaaaagctttgccgacacagacaaaactcagaagaaaatttcatcgttattaccaaactcaggcgaatacaggttaactataaaaagctatgagattaagaatgagtttgaaagttttggtgtaatttaactttctctgaggaatttacaaaactcattcatcttgaattgtcttcttagaattggaattagacctttagaaataaaagtagtattaagtagaatctgaaagacatttttataactcagcttctgctataaaaagtattttagctgctgttttatttatagttttttgttcagtgctcttggcatctgaatatgtttgcactcaaaatgttttcacttatttttcctctttggtttatgtttttaatgtacaaggtaatattttatatgtaaattgaggactaggttttataaggagataggaaaatggaatggaaaactttcttaatgaaattcattcccaggaaataggggcagtgaaatggtccaagtagactctatacagctaagatgtgctttacacagagtgtggtagatgctatacttgaaatattttcaataatggtaatataagttgaaggagatatatagcctaataattatgaaaacaacaatagcaacaacttctgtttataccatgcacttacatgtaaagcactttatagtaacccagtgaggtaggttttattgtgtatattttatagaagaacaaatgaggataaggaaagactttaagataacaaaattggtagggggaagagttaagatctaaacatttctttgtgcctctaaagcttatgttctgaagcaaaaacaaatgacggttggtatattttgaggtgcattttacattatgctttgcaatgttaacatttttatctaatttacagtctccttacttgcaggctcatagacctttagctgactgaatttttcagttaacttagtgtagccccaggataatgttaatactttcataaatgcaaaattaagaattgttcagtaatgttaaccttttagaaaatatgaaataggataatctcctaaaagctgtaaaatgagaaccttcacatttaggaagacagaatgtttttttccccccaattgaaaatgaggtagatagtattatatagttgtttgaattcaagatagaaactttaggattctatatagtaactactggtaatgattatttaaaaaatagccacttccaatttcaggcctaacgtgccaggaggttggaagttgccacacccattctcacaataagaaaaaagatgaataaactgaaaaatcaacaattattcttagatccgtcagaggattaaagtcacagggcaaaccactgccacccaaattggagagagacaggctaatacggagaatcacaactgactggagcagaagcctagtagcagaaatctccatgggaaccagtcctggggtagaaaagctcaaactgtaattgatgaattgttggaggctcatgtggacaagtttgagagttagactccagagtggtctggtcttgggaggggcttcatatttctgtgagttttatgtctaggatccctaccagagttttggtgaagaccaaaggaaaatttccttgtgcttctggcaaggggaggggggaaaagtggacattttgaaatatacccagagcgttctctttttaacaaggcctgccttcaagtgaaatgaatgatagtaatgttataagagacaagtgctggggataccatgttttaagatatttgcactacctgtgaagtgatatagtgttatttgaaagagtacttggattaattgtaaatgtatattgcaaactcaagtgtaacaaaaaaagcagaaaaagaattgtatgaaaaagattaattaaaactacagaatgcagaaaagagtggagagcaaaaagaataaagaacaaggacaatgatgagaatagtagcaaatatggtagatattaatccgactaaataatttgaacattactggtccgaacaattaagactcacagtggattaaaaacaagactcagctgtatgttgtctataagaaatccactttaatatacagacacaaattacaagtaaagagatgaatgtaaaaaattattctaacattaatcaaaagaaagctggagcaattaggctgggcacggtggctcagacctgtaatcccagcactttgggaggctaaggcaggtggattggagttcaagagcagcctgatgaacatggtgaaacgccgtctctactaaaaatacaaaaattagccgggcatggtggcacacgcctgtaattctggctacttgggaggctgagtcaggggaatcgcttgaacccgggagttggaggttgcagtgagctgagatcattgaactccagcctgggcaaaagagtgaaatggtctcaaaacacaacaaagcaaaaaaagttggagcagttgtattaatttcagacaaagtagacttcagagcaaggaaaattattagggataaagagggctagtccataatgataaagaggtcagttctccacaaaaacagaaaaattcttagtgtttatggtgtggcagttcttatttctggtctcctcccacccccaaaccactaccgcagaactagcctcatgagcttcagaagtaccagtactggctgcctcctgtcactcccagtaggggtctgaatcccagctctgagaaacccctggccccatcaccagttccatttacttctctttgttcctcctgcagttactagatccgtgtcacctgcgtgcttttttgcctttttggttctcaatttcttatttaaattctattaaaataactgacaaaactaactcaagaaggagtaaagaactaaatgtaagtgtaaaatagaaaactcatcggaaataagaaaaaagtggccatgcttttttagataaaaacatgatccctgagagaaaaacacttgataggttggacttcgttaaaattaaaaactactactctgtggaagacactgtacagggaaaaaaatgacaaactctggtttgggagaagatatttgaaacatgtatcttataaaagactggtgtcaaacatatgcaaaaacaattaaaactcaacaacaagaaaatcaccctatcacaaaataggtaaaatctgaacaggcaccttaccagagaagatacacaaatggcaaataagcatatgagaagatgctcaacatcatatcattagggaattgcaaacctaaatgaaatgccattacacacctattagaatggctaaaagtcagaacactaacaaccaaatgctgacgaggatgtaaaatcacaggcactcaatcattgctggtgagaatgcaaaatgctacagcttctttcgcagtttggtgttttcttatacaaataaacaaactcttaccaaataatccagcaattacactccttggaattaaatcactatgttggttggaatgcttcctgaaagattaataaattgcctatttttgtttccatgtagaatatgtgatagacttgttcatgctctgattctgagccattgttgaattttatatttcatttctcatatttttcctaaacatctaagaaccactttattggcactgtgtactgactttcataaagaggcaatgttttcttcaggaagtgactgcatgtgtgtccctgtgtagataaaaacaatactttggttaaatgtgggagacaggtaattggctttgaagtccatttcagctgcatattgagtgaagtttctagcttaccaaaactacaaattgctactttcagagttgcttggggatgtagtcaacaacatggctattaggtatacaaatgttaaggatttgctacataagacactgtgattgttttagatcatcttacaatctagttgaggtaggactaacctgaaaataagttgtgcatagagcagtgagtgcccaatttagtgataaagatagtaattgctgtgggatcttgatggtggtggtttgctgcgagtgtatggcactaaccccacccaatccctctccacttcttggccttgtttatgcagataaacaagaaaagtaaggtcaattgtgaaggaaggagaagacttaaggcattttacgcttgccatcttgattgacaggtctagggacatttgggtcaggatgggccataatgggatggggagacactttctgcatggaacaaagagacttgagagaaaacatggaagtgtcttggcttgattttctttaattactgtccatacctaatgtttctttttataaaatagggaccattttagttataatatatatttcattacataaaacattaagcatgtttttgcagttcactaatccctaacgaaagatattttaagttatagtaaaacatatcaacaattctattgttggactttcatgttttccatctttcactattaatgctttagtgattattatttttgtgcatgtctgattatttgaccacatttctagaagtagattttctttatatgagtatcaacattttaaggttttggaaagtattgcgaaatcattctctagaaagataatttcaattataacccctcagtgatatataaaagtatcatttggaactactctcaacaacatggatgttatactttaaacacttgataacttgctaggtgaaaaatgccaccctatagttttaactcaatatctttgacaagagacattgaatatttttcatatatttattgactctatttcttttgtgattttgtgtcttattttaatgggaatgtcactattattttattcccaggtgttcttaaacctcccacttagttgaggagttgtgtgagggaagaaaaggtacagggtatggttaaaatgtgtgctctggagccaggcactctagattagaacccagcttcctggagaatcctcctggctgcttgacccaggataagaacttgattgcctgtagttagtagactagaaaaagaagaacattttgaacccagagcagtaaccagttacggaagtaaatgtgggtaagattcccagagagaaggtaaccatggccagcagctatacccacagagccccttcataaaataaggtgtgagtcaagtgctgttgattcattgttttgagatagctctctaaaacttacagtcatgatttctcacaaaataattaacaattttgttgcaaatgaggacatagattgtgtttaaaaaaaaaaaaaaaagaaggtggctcacgcctgttatctcagcactttgggaggctgaggcaggcagatcacctgaggtaaggagttcgagaccagcctggcaaatgtggcgaaaccctgtctctactaaaaatacaaaaattagttggtgtggtggcgcatgcctgtaatcccagctactcaggaggctgaggcaggagaatcgcttgaacccgggaggcggaggttgcagtgagctgagatcctgctgctgcactccagcctgggtaacgagtgaaactccatccccctgcccccccaatcccccccaaaaaaggaagagccagagggcattactagcatattaatggttttagaatgttcatgatactccctcctgaaagattattaaataaggtacactgtcactgatacaaactgaggggatgttctcctaaaaaaaaattatcttaatacaaagaatgacatggattccttttcctaattttgctctcttttggtttaacaacttttgacctacttatcgatttatttcatgtttgtgttaagaatataacttatgattttaaagtcactctgattaagaataatagtggttttccttactccttccagagaccttgtcaaaaaatggtattttttccaacttcaaatatagatctagtctacaaatactgaagtgataattagggcttatgcaagattgcttcatttgaaaaattagttgctttttttctttttctttttttttttttaaacgagtcacttttcaaatctttctggttcaaggacaaagctaaaagaaggcatcttaaagtcatggcttatataaatgatttaagtaagaaatgtgggaaaaagtgataaatatgattcattgaccccttttgttaatttttgtcttataaacacgtttttccatgtattagtgtagtatgagcatgcagcatatggcagcctcctaatattagaacatatgcaaatatctggccttttactaggccccttgaaaatccaggtacacaaccaaaaattaataaaagcgagaaaaggtaattgccaatatgttaaatttttttcttgtgagaagccacaataatcagaagagactgtcccagcatcattagctaaagtgaactctcttgtgaattttttgaagtgtgaaggacgccatatttccttttttgttcagttagctattaccatttctgatagcttttccaaaattaggttcctcattccacagaataaaaattttgaacttctgatgcaatgcttttattnnnnnnnnnnnnnnnnnnnnnnnnnnnnnnnnnnnnnnnnnnnnnnnnnnnnnnnnnnnnnnnnnncttttatttcctgtgtaccctaggtcctttgacaagtaacacatcctcacattctctcatgagatcacatccttccctaccctttgcccttgacattcctactgcctagaatgttctccctctttttgtggctaattttctgcctggttagtggaatgttccctctattattgcacttattttcatgttttattgtgatactctggttacctgtcttctccatgaaactgtgagcactttgtaggaccttgtcttactcatctctgtagtcccagcatgtaacacaatgcttgggacataatagctgctcattaaatgatatttgagtcactgagtcagcaggttcaaaacatacacaacactttgcaggcttagaaatgttctatggattttacttgattgacattatcctgccatggtctaagaaagcaaaaatgccttatgttcagtggttcttcctgatggctttatatttgaggccattgtcagtcctgcattgagagacttgataatgtgccaccagctgttctgtaactgccttccttattactgtgcctagtttcctctgacttctctgggatcattttatctcaaggtgtgccttttaatactgcctggtatagtgtgtctcattcagtaagcttttattactctgcaaaagcagaataagccatatggtagttacctagttatacaaagggttataaagtaatgaattggcaaataaactggccttgtaaattcaacagcctgtttggtcaggaaaggatggatatagcaagtacacaagtacagaggggtattgaagatatgctgcgtggcatggaactaaaatcatgttttgcatttaacagatatgtccagtaagatgacattaatctagagtgttcaatatccagaataattagaaagatactacacaataatgtgcaaactttatggtcttgtaatagaatgtctaggaactagtatagacttaacggtcatgcaagtgctgggaagaatattaggcttcatttacagttcaactttttcattttaaaggtgaaatgactttaggtgattcatgtaagaacatagtattagatgatgttagggctgaaaccacaaatcgatgtcttctgacttcaaatccagtactttctttatatcatactgtctttttttttaactataggaaggctcagtgaaatacatggcattagaatcatatggactaaaatgtcccttactaaatattgacatcaataaattgctgttctttatcaaccattcctactcttcttttaatcatcatacttaagttttcaaatatggtgttgagttttgggaatgagtttatatgccaggaagatattttggatttgggacctcgatcagctttactcatggtagatttcagtcattgtccgaatgatggctattgtcaactataaataatgagattcagaagatatgattaagtatagagtttgagtacagtctgagggtagccacggaggagacactctaaacaaatggggttagcattccaacattgaaaagttaagttttcactcatagaggaacagaaattccagcagtactacaacatttttcatatgagaccagatcatatgttgtagtgatatgactcaaggaagattagtttattacttcataaggagagatagtgatcttaagggggtcttatctctagtgctgtttggtctttctaattatttagtaggaaaaaaaggcagaagttgcagcggcatgccaagtgaccccggctgcatagccacactcctctcaagggtcagaatgatttaaaattccacaagctttaagtttgaattatttaacttaacaccagaattaagacttgccttgctttcccatgatgactagatgctgaaattcagtgagttagaaaagcctggaaccaagtgttgccagcagtaaaactgattgtgcatctccctacttgtactaagagccatttgatcatcatgctaaagtcatagttgaaatgtgataaacatgtttgaatttctttaggacttaaagatctagttttgaaaactgaaccacagagaggaagaaatattttgttttaaagtttatttttccattttatatctacctcatataaatcagggaaaacaaacatggcatcttaattttcttaatgaaatatgtaggattctactctgcttactgctctagagaaatgaaaacgtggagaacatttaaaagatgaaatgaataaagtaaagctcttctaatgcacgtgctaaacaattttaaatttagggactgttgagtcatcctcatgctgaattcaaatcaaatctgttagatttagcagccattaactgtgttctggaaatgctagggtttaacccaatcccattttgcattttatgtgttaagtattgtgttcctgcactatgaagtgcttcagggatgattaacagcctcaaatagtcttagagtaacatttggaaatagtcttagagtaacattttaaattttagttggcattaccaataggcagcctttctgtagctgtaaaaacccaacacgaactttttctcttcctgtttctctatgactctcttcactgaaaaatgttccttgtttaattctattaattatattatgtctccctgttttccttggggtatatgataatggtgtaatttttaaaaactattatagataagactggtgctttgaatgaacatgttagatgtattttaattcctttgggtagatgtattcattttaattatttctctggatttgccacagtcctaataaaatttcttttttaaaagagatatgacaaatgaaatatagatatttagaatattgcctgaatgttattaagtcacacataaagagaagattggcatttctgggcaaacaaaaaatgttagcagctgggcatagtggtgcatgcctgtaatcccagctgctcaggaggctgaggctggagaatctcttgagcccaggaatttgagacaagcctgggcaacataatgagatctcatctcaaaaagtaaaataaaataaaaataaagtgttagtctaatcaatgctggtattttgctattttagcttggtttgagtcagtggaaatgaaaatacttgtcttagactgcttttattttttatttttttaaaacaattcttccacattacaaaaacaattgggatggtatatgaagtaacagttctacttttttcagatcattatgggtcagatgttgtataatataaagatttaatatataagctattaattttgctgctagtcaattttaacaaattgagttatttcagataaagcttttcctctagagttcagagtgttttatccatttttcacatcctgcgttttacaatgagacattgtagagaggaaggactgtttttgttttgtaatgagatacattaggttgaaggtgctatcaccaactttgaggctggacagcaaacagagaaaggaagactctttttatttatttatttatttttattattatactttaagttttagggtacatgtgcacaatgtgcaggttagttacatatgtatacatgtgacatgctggtgcactgcacccactaactcgtcatctagcattaggtatatctcccaatgctatccctcccccctccccgcaccccacaacagtccccagagtgtgatgttccccttcctgtgtccatgtgttctcattgttcaattcccacctatgagtgagaatatgcagtgtttggttttttgttcttgcgatagtttattgagaatgatgatttccaatttcatccatgtccctacaaaggacatgaactcatccttttttatggctgcatagtattccatggtgtatatgtgctacattttcttaatccagtctatcattattggacatttgggttggttctaagtctttgctattgtgaatagagccgcaataaacatacatgtgcacgtgtctatagcagcatggtgtttggaatatttctgtcatgtttaatagtctttgtgctggtggttagctaaacctttctatttgcatttcaaaaaactattaggccaggtattttatgatatgaactttgatccctgctgaagttcattcagttgacactgacccattttatttccctaaccagtagagatcattttctgtcttcattgaattagctattctttctggccttggatcagtttccaatttgataaatgtgctgtttagtttttacctgttttttttttcccaaagatgatttaaaatagcttataagacataaatatacatgatagcatcaattaggaacagagctataagaatgaaaaggaatggtagaactgtacagtgaccctaggattggactaaaaattgatactataatgacaaacatgagtgaggcctgggatgccaaataaaaatcaaagtatttatatagttaatagtacatataaaagaaagctaatgatcagatgaaatacaactattcttgctactacaaccagacagttttatgtcaggcactatgttttaatggtaagaaataactcacttgattgcaagaaagaaaaactgactctttatgactgtggcataaaggtaattggtttgttctaggggcataccattcttggggcatttaaaagagtggttcaactccctgaatatggtttttgtcacctcttttagtaaatacttggaggcatgagcgtcagactgtcttctctgttagagaaagggatgcacccaaacccttgccccttaactataatgctgacttccttatcttcatttaaagccttgtaaatatgttgactgaacagcgtaggacaaagacatcaaaccattagagcaggggtctaggctggagctaggggatgggagtggacagatgtctgtggaataattccatggaatctttcaaaggattttatacctaaagaaacctttgtgtatgtgaattgacccatgagattcttaaagtagtacatttgccctcaaaagataaaaaccacagcactgaagacttccccctaaggctttatcaagccaccatatacttatggttcttcaagtatttgtctacctatctgtacaccagagcatacaccttttctgttttcttccttgccaaatctagtaggtgcttagtttgtatttgttgattttaagtgaatgagctcaagtcacattttcctgctatgtctataagactcttatgtgaagggcttggtcagaggctctgtgaaactacacactgtgcttttttcctggcccacttatgttctagcctgatcacaaattaatgaagatcatatgacatgatttaattgggtggaagacttagactgctgtccaattcttttctctctttatggccatctagaccatgtatataataatccattttagaatactgttgtagattgagccccccttttggaaaggagtatatttgcctctcagttgacacttctaccatttttcgcttgactgtaattctgtgatcgtatcttcaggctctttaagggtcctgggatatagatgttgtgggtctacagcctagtattagtacagagaatctgggtagctcttcttggaattgaatttcttcataatcatactagttctactttctttctccctggtgaagtcaggaaaaaaaataaaattgaactgctctgttttttcctgtcttctgcccaagcagtagtgattatcattttcaagttctccagcagtggcagcaaaaacaaaatcaccccaggagccaccctttccttatcttgagcattttgaggagtcctcatctcattctgattttgtatcttttgatagacctcttaaggtctcttgacttccatttgtcctaggtcatacgtgtctcttttgtgggagccctgataaaatacgaagaaacacaaagctatccatgttgttacattcatttctttatatgcaattctcttcctcatcaatataaccctttttcatattgtcagaatggaagttttgcaatcctcatctttcataagcccatttgtgattttgagtttctgacctcttgatcctgcttctcttttctctgaacttactgaatttttttcttcaaagaccaggatatatttctgtgtacgtttaagattcacttcctggtctatttccaattccaattttacgttgtcatttttttcctcaaaatttctgtcatttctactttaccaagcaatttattcttattcgttagaggtcctgaatcttggtttctctcagtgtttttattctgcaagatagaaatgaccagaaggcaatacagagttatcagcagactgtgatgaatagaagatgttcaaataattggcatctcttatttgagccaatttttgtcacttctgttacaaatataacatctatatctttgggcattatatgaccataagtgtgatattctttctccttttaaactcactttaaatattcctcaccacacttcatgcctaggtctgtggcatcccaggtgttatgcatattttcttggcagaacatgcttttttgttaggtttattttcattggacattgtggaatgtctgttggcatgagctcccatctactcggtttcaatgactatgcaaccatatgtaccaccattttaaaggttgcaaattcattggtagcccctcaacttttcagtctttgtgcatttccttatagacatctaagaccatatgtatctgtctctggcccttttagctttcataccatttttttctgtgtttttgtactggtcctatcattccttagcatgaagcctaagaatatattcactttcttgctcctttggattttttctcttcatttgaatctttgagaaagatgccttacatgctgacctcctctttctctacattgcctcttgtttaaaaaattatttcttttttgatacatgatagacctgtatgttttcagggtacctgtgataatttgacatattcgtataacataaaggtaaaatcagggtaattgggatattcattaccatatttatctattctttatgctaagcacattcaaattattctcttctaggaactttgagaggtacaatagatttttaactatagttatcctatttatctattgaacgtgaggtcttactcacatttcctcttcattttactcattttacttcattttaacatccagagcacctctgcatttaacttgtaacttctcttattgcttattgtctcccccttttatttttctagacttccacagctgctttttttttttttccctctcttttggagttaatgtttctcatgattctagacattattgcttgttgtctgttttttttcttttctttttggcaaaagaagtttcctcctaaacttttttgaaacttaaaatgagtcaggaagaaagcctggaatgtgagtctccctcttcctccccctcaacagcccttactttgtatcgtacacagagttttgcaggtgtgtataatttttcgctaacaccatttagggttgggtccatttttgtgtctataacagattgaggttgtcactaaaataaaataaaaaatgaggacgttattgccttgcagctcctcttttctcttacctgagatataatgtttgccaagcaatcacaaacacattgtcaccaagggatgaattcttatccttctctaagctttaaaataagttttcagttataaagtaggaagagtgcagtgcagagaaagcaatcttttaaaacaaagttcagatcaataacaacatttcctagtgtctatttttctgttaatgactaaagacaagtaccaattagagaagcctcaaacgtctggatttctggttgtagcaagtggtggggcatgagaactattcatagtgccatggagaagtccgggttgttcttagctacctctcttccatcttgatcttgcctgaggatacttacatctgcccattgctttgccctgaggcttttcctttgtcctttattctttattacccatttctaacttcaggaggaaaactctgccatctttagtaagggatcttttatttttatgtttgtcctaaccagctcattttagtcatcattttctcatcaggttttccattaacgcttatgtttaaatcgcctgatctcactagactttttaatcctcccattgctccttccttattgttctcaagatcacacgaaactggcactgaagtcagtcccttcaatagctagcattaagatagttctgcctcttcatttttttttttaaactcttttcatagattgtctgaaaacatgttttcttcttttggtttgtacttcaaatattttctttcttagctattaactctgctaaccaactctgagaaagctttgatttttgtatagacgttttcaatactgttgagtgttgttattttgacaaatgctgcacatgcattttctacagtctgaaagccatttatattaggatgacaaaacatggaattgtttatgtttagctagattcttgcttatcggagttgttttaccaggacatattcattctgttagttctgagagttatgatataattgtccttggtaatgaagctttgtcttgatttggtgttttctgttgaaacattctttgatggaaccaaaagaaaatagtggcgggtttccatcagcattttcagtttaagtgagcaatacttttttttcttccttttttattatgttctttgcccctgctagagggtaaggcaggaagaccaaaggaagctgctgtcacaatcatagcaagagatttgagggcctgaccttttggagcaatattaggcatgaaaaataattcacattattattttcaaatgtgcaggcaagaagggtttgcttagtttagttcataatgtgactgcttttagggtttagaaacttcagtttttcttagactctctattttctttttaacatgccctctttggtacatgtcaaactaattgtgagatttatcacatgctccacttatgattttctagttttagaaacttagtgtttatcacatcttctgaaaaaataacattgtgggtttcagttttgattataaaagtaaaaggaaaacaaaaaccacttgtactattacccagagataacaattcttagcatttccgtgtgtttccttttattttctgtaggtatataaataattgtctatcccaaagtgcatttctataaatttttatttacttatacaaaatcttgcattttatgaaacatgaaattatgagatcattaaatattatgagtgcataatattgattaatcacatggctacaccatgtttatttgaccatttccctattgctgacattaaagttgttttcaattcattattataataaattttgtgattagtgttttcatgaataataaatcttcatgtctatcctcaggatactggattaatgtataaacacatttttaaagtcaagaacttctttgaaggctaaaactgaatatggaaagatgtgaatgagccctaatggctgaaagttccaaccagttgaagaggtagcagtagtgcttagctgctctgcattccccacctccacctcgaatagaaaatactggagcatacagagttttcaaggggaggacatagagtgcagtggcaaggggtcttcggccccactttccctgtctcctcactcatccccagatgcctctctacccagtagttcaacttggatgccgacatattttctgacctttccttggaatttttgtttgatttttctgtttatcaaagaagatagcttttatccaccatgtccttgcctttttcagctatttgtgagcattgcacaataagtaaaatgtcttctgtaagccctggtattcttgcactgtaggaggagcctagtgaaggcatatagtagtagaacagcataagaagggctacttaacctcacagatttccagatttcagtgattagtttaggaaacaaaaatcaatactactatccttgtataagtcagttcatggaagcaaacgtttgttttggacactgtatctgttaagctgagtactcacaacttaaaggtgtgtatgtttgtgtgcgtgcgtgtcaccagaaagctaattctttcaccacaacaatgttgagtttagtttttcttgatccttgttcttttgaactgttttatgttgatagaaaaattgtcttttaaattaattctaaaataacagactaatgtggaggcatttcatattgctatatgaccttattcttggtgaatgactttgattctaattaaattgagtatttctagttattaattaatatttcagttttgaagtttccatattggaattaattatctgtctttaagtaaattatttcagcaattgcagttgtatcacgatcctaggaagctaacaagaataatttacaactgttacaaatagcatttgtatctatatttaaaaagctcttcaattgaccaagcagatgttattacagatttttgtctttgatatgataaatttcccattaatttagaaaatctgtgtttaaggaatgtgctatcattgcatagttgaactgcaatttgtgaaagttcaagctgctgtactgacaaaccatttgacaaatttgtaactgagactcttttaagcaaagactaacttctggagcctaatggtctgtattttctgttcagacgcatacactttaatttcttctcttttgtgggtccaggaggtgtgatagacattacctatatgtatacatatacatacatagatatatgtccatattccgtcatatgtttgcagcctaagttgtatgtgaagttgtgtatactttttaaaaaattaaaaatgttcactttaagctttcactaactttgaaagaaatttctctttgtctaggttgaagaaattgtggatattggagcatttgctccagaagacatccatattcctcagatttatgtacatcgccttataaagggagaaaaatatgagaaaagaattgaggtaattgacttagctgctttgtcagtattcatggatccagttacagagatagtgcatccctggggccattcgagatgatggggaactagagctgagcagaaagtctggtcttggatcttagtaagagcttctcatgtgtctatcatcatggggatatgatggtctatgcctctgtgcaggctgacagtgccttgtcatcacaagatatgtatcaccatgccatgagattctctaggctgtgtctactaggcttctactgtcctaatttatgatctgtagtttttctggctgtcttagaggggagataagaataatcatgtctttggtggttttatccctgctgtagtcttatcttaatgtttgattgttcagaattgtctgtcttgaaggtgctttgcacttttctagagtgtagaatgtcattctaattagcttcaggctgtgggtagctggtgagtatgagattgtggcaaggagtgtaggtaccaggagcattgaaggtattctaaggccagtgtgttagtcccttttgcattgctgtaaaagaatacctgagactgggtaatttataaagaagtttgtttggctcacacttctgtgggctatacgtgaagcatggcaccagcatctgcttctggtcaggacctcaggaagcttttactcagagcagaaggaaaaggggaagcaggcatgtcacaaggcgagagagagagaaggtgccaggctcctttagacaaccagctcgtgtgtaaacgaacagagggagaactcctgcatttccaagggatggcactaagccaattcataagggatctgcatccatgatccaacacttcccactaggccgcatctccaacattggaaagtacatttcaacctgagatttggaggggacacatatctaaatcatcagccagtgagagtagacaatggccaccctaccagaattactgtcatgatttagaagtgtctagggatcagcaacagaatagacatacagtagggtgctagagatacccactaccttgtagatatcaaacaggaagacattttataatacaaaaccagtgtcaggggcccaggaagaaaggatgagacttttgcaaacacgagccagagtttgtgtcaaagagacttaatagaggaaatagtttcctggctggtttctgggtatttctatgattcctgtggtgcatttgtggtaaaaatagtctggactttgcaggtggaaacaggcaattggcagcagcaacacctggtaaacacattctgacagccctgaaaaacacattcccaaagtctgttcctctttcattcttctggccaatccctgagcaccagaggagaatttagttggaagaataacagaaggagcagacagtgtgatagtaacagattatttgcttcaaacagactgaacagcgtatcttcctctttaaacaaatctgaccactttcatttagttcctaaagaattatttctaccatcaaatatcacccatagtattttttaaatatctggtatattgcagatttgtctcataacaatgggagagagctcatctttttttccagtaaaatttatttcagcagtgataaaatacaaagcatacctcaaccacgaataatttatttctgtttaatttaaagcgtttatcaatccggaaagagggagatggggaagccaaatctgctaaacctggagatgacgtaagggaacgaatcatcaagagggccgctcttgagtttgaggatggcatgtatggtatcctttatccttctgagcccgggcaaagacatagcctttgcttttcccatattgatcaggctattagacctcttgcatagtgagtcatctctagtctatggtaacttttaaggtaattaatcaattttttttttttttttacaaaatgtggcatataatccaaaggtgtcaagatacatgacagatatctctttgccttcttgaaacaaaatggcaatcaataatttgcttagctattttctaatacccattagatttcagtacaacttgcatttaatgggagattattgggaaaagagattacccaagatgagtgttttcaaatctcagaattcctagtgataaccagtgctatttactttctgtctatcctgacatttgcatactcattgaaagatccaacttcttaacaacccttttattctcttgacaaagatcctgtgattaccctgttatatctaatattttatgagggtattcaacaaatgattcaaattctgctttagatactttgtcaaaaaaagaggtagagtagacataattaatgcaattaatatttggattttgaatgcatttaaataacaaatctgttcaccattttgctagttttcactacagtagacattgaattatataatacaaataacacatacaaatacagatcgcatatgataaaatgaatgtttgttgaatggtggatacagtgaagccatacttaaaagacctaggacagaaagaatgagagacatgacaaatgtctccattctgtgagcttccctggtccatgaatgtcagtcttccagactgtgatcttgactgggagaacttttcttttttccctttctttttacctctacctcatttttgttcatttttcagtttataccttgtgttatggtgcaaactcacataggggaaaagaatagcatgttgctgctcttccagttcttgtatcagcaaggtgtggtgtcaaccaagttgagttagtaggtaaaagttggtcactggacttctcaacccgtcttatcctgacttaccattgatatttaaacactgactataatactgattttaggtgttctttattcagttattgtattgcctgtgaaaaatatttgcaagtcagtttatgcaagtggtctttccatatctcctactttttttcaacccaaaatacatagacttttttcctccctggtgtttgactttaaaatattaaagaactgagagaatgctataatatgatgaaagagttgaggtaccagacttgtaatttgggttgctctgtcctaaaaacacctgctcataatggaattagtatcctaatgtgttctgtgcattattgagaaataaattacaaataacactatactagactgtgatagaacactagaggtaaacccagtagctataatcatagcttcatagatttactctatccacaagaagtgacctgggtcattgagttgtactgctggcttttgtagtttataatatggcaccatatataaacctcctctggccttgatttgtgaagatttcactgttagaatctcatcagagtgccatcattctttgtactagttctggtgaggtatttgttgtgcagtggtagtggacagtagtgggcagtagttccaggcagtgtgagtatctttgatctgatcagcctgcctatgttgataggcaggattgaacccacaccattgagtagtaatcatcatcactcctgttttgatcatttaaggaagacaattcaacaacctcatttaactctttgatgccttaacaacagctcctttatcgatgagctcaattgtatttgctgaaatttaatttcctccccacttttctttttatgtcacatagaaaattcagttaccaatgaatgttactatagagacccaaaggatctgatatacttttaggcagaaattttggtattgtcagaaaacttttttaaaatttaaaaacggtaactccatttatcaataaagacgatgaaaaacgatctttacttttggcaggagttttgaatagtgaaaatcattctttaaaagtcaagctgtgtttaataaatcagttataatacataaacccaaatttgcagagcacattaatgaaaatgtgcttacatttttgttaaaatgtgacaaatggctagcttctgaggccactactttgatattaatgttactgaaaaagctgactaattagagactttttttttgaaaaattacaaaataatgcgccatgggtgattggagaatatattcatttattacattcagagtaagccacctttaaataaagcttctgttcagatctgtatatgtagaagatttatggtataacttctctaccttttatatgctggaccttaacatcttttttttccagctaatttgggcataggaatccctctcctggccagcaattttatcagcccaaatataactgttcatcttcaaagtgaaaatggagttctgggtttggtaagatgaaaatttgttttctaaaatccagtcttaatgaagaatgagatatttcatgttgtgaaattttttattaaatttttttatttcaatagcttttagggtgcaagtgatttttggttacatggataaattgtataatgctgaaacctgagattttagtggatccgtcccacatagtgaaatctgagttgttgcataaagtgcccaagcttatttttctttttatcatgataaaatatttaatttttcccttaaaatgtaagcaatgtagtattgtattttatgtagtagatggtacgttcctgactctggctttctgactgcgtctcccatgtggaacctgattcagagagacctcatgatttcctgtgtaaactatttctcatccttctgttgttggacaagataatgaaggttgtcaatagttctatgttaaataaaattaagtaagcctcagagtgagaaactgaagagtaaggtttctactttaggacagggacattgtttgagttgattgcctcaaaaagctgtagaagttctcatctcattctccttttgaagctctactgtccaaaaggttaaatttttttcttccttaagattaagcatccagatgagctcagttttcttagttaggccatattttttcattagtataataaaatcatatttttttacttcctgtatgacattttaatttaattaacaatggcagggatttggtttgcctattcataatcttttatttctcagtagataataactgttaatgcaatagaaattatgcatatggaaaatgtattcacaattcaaaataaataatgatcctgagcgtatagttgatactgattgaggcaataatcatgacattttcaaagacacaaaaatgatatatatttggataaaagcagattcatgtggaagttaaagacttgcatttttaaggtgccttagagattatctagagtgatcaaattcctggttttgaagaaaagggaaataaatttgtggattatccatggccagtgtttaaaggaaaatttacatagctctgaacattagttgccacttcagtttaaaggataaatttttggtccctctctagaaagtatgtaaaaatttcacagccaatatttcttcatttttggctccatcttatatagtatgccttttatttttttatagtttcctctcttttcatcgaatatatgtgatattcttaaactacttggcctatttaaatagagttacattataaaaatatatggaaaaatttaaaaactttactgagagtagctgtgcaaaaggaacataaggacataagtatatcaaaacttagatgtagtgaggagtaagattagaaacccaaattcaggcctacattttacaaatcagaaagctaaaactttgcctctccaggtccttctagccaaataatgtgatgtagtttgtattcattaatcctcacagaaaagtttttgaataacattggctgcatagtaggtactaaatttttcctctttgatttttatatttttaagagaatggggtgtcactatgttggccagcctggttttgaactggcctcaagtgatcctcctgcttcagcctcccaaaatgctgagattacaggcatgagccactgccctggcctacattagttttaccgacctatatttctaatacattttcatagtagggactaaataattactttttgttttatggacttgtatttctaatagtatagcatttctttcaaactggtaatttttagaaaatatttttcatttgcccaatcacaactttagtatagaaaagactaacataagaaacagagccatggacacaaccgaattatttttcaaaagtttacctcaagtcttcggatgataaatttatagggtttttagggaagttatttatattatagttctaatatgtgattcagtgagaatcttcatttactaattgaatgtatgttgtatttgacagggtccatatccacgacaacatgaagctgatgcagatcttcatcaatgcaggtaagctcacttatttctagcccttccctttgctattaattttgtgctacataataagagtttggactcaattctttgtcttttcctggagagcactccatggtattcattgttgaggaggagagataagcttttttgaggtctcccctcattcaggaatgaccaagataaaggaggaaatgcagatgaaggcacatttaatggaagagactttgatggatcaatnnnnnnnnnnnnnnnnnnnncccttataggaactgtggcctttggtagagaactcagtcaaatcacagcaacctggttgggtggagagtgtcctctgctgggttgcctgcctgtgcttcccactggcgaatctcaagtcaaagtaggtcagccttctcaggatagagaagggtgggagtgaatccatagcagcaaaaagaaaagatctggtacactggggtttttgttggtggtgatgcttcctattttctagttctcattggagcaggagaggtgcttaaggaggtactctgctggtaagtatgatctagtaatgtaataaatatagttttgttgaactggggactagagccttgtcttctcctttgttcttacaggcatatgctttaccttttattactagccttttctttgactgagatgtagcctcatatattaacagcctagaggaggaagaacaggtcaggtcttttggccatcttcactgcctatgcttgaggcaacactgccaccactttggagccatatgtcatccctggagtgcagctgcccataagaagctaatttttaggttctagcatgattttctgtatccttttattcattctgcccccgcaaaactattattctttattattcttactttgcattcaaaaatagtatgtgtaaatttcagaagacaggtaatatgagctgaacataaaggccagctgccaagtaaaattgatgtttgatacttagaatttttggagtgaaacagcttctggttgaatagttgaattagataacacgactcaactctgaaaggcctactgtgataaagcaatgacatttaaccaaggctgtaatttaattgtactgtaccctttagcaatagctcattgatctgtgaaaatatttgctgcttggtttaattaatttatgatgttagtgagttatttgcaaaatgaataactgcatgttccaaatttcaggcttcagtttataaaacccactttctttggaaaagttgttaactttttcaatgtggttggacagtaggtgtttctgattccatagagcttagaagtagctcagtccaaatgaagccaccaattttatatttccaccaattttatatttcaacttcaacacttgaagtgccacatttacaaactactttacaaagcaagaattcattgcttatgggaagccaagctccaagtcagtttaataatattataagtttttcaaagtcctttttgggatttttgatactttgacacttttgattttaaattaggaaatactttaagctggagagcctagaatataaattggtggtttcctcaattcccaaagttatctgcaagatcaacccattatttgtgttagtttgaaagcattttatggaaatctctttgaatacaaagagttatgtttctggatataattggtatgataaaaattcaaaataataatataactatttccaaggatctcttttaaaaaagtctcataaggttatgtaaaaatgaactaccagttgtatagttttacatggcttagagcatactttttcacatgtattataccattggaacctcaaatgaaaccttgttatacaaattgggaaactgaggtccagaaaattgaagtgatgggttcaagataacattgctagggactgagtttatacccagtctcctgcttgtgacccctggcctttttctctatacactgagttatatctgctgatgacctgacttgcacagaggtgcagacagcagtgctaggaatgttccagaggtcccatcaagatctgggctctaacctagagtaacccaatgcagttgtgaaatttctaagtctcatatttttgcttctgtattgtgcattttgcattcttcatttcttaatgttttcttattttaatatacagtattttaaatgacttaacttttgattaaagttgctttagaaagaataaccatgtttaatatccctggccccctgccatgtcctctctgcactagtcgttttcaatggggtggggtctgattttgcccccagagacatttggcaatgtctgaggacatttttgattgtcacacctgggggagtaacatctagtaggtagaggccagggatgctgataaacatcccacagcaaccaggacagtttccctatccgctggagttaaccagccccaatgctcaatagtgctaagcaggagaaactctgctctagaggtatatgtatcacatctgaagaatcacagggctgcagtctaaagtacagataacatggcattccagatctctgtagtgtttgcaaccaaccattatggctttctgtcttgctgtacccttcaaggatacttttgtgtacccattctggactgctgggtgttttctgattatggctcatactcttctttgcatgtctttgctcttggtgtgtctttcatgagattttattctgctccattccatttttatccccatctccttactgataactttctatcaacattcattatgcctatccttcaagttccagcccatttttcttctccaaatcctactgtagctcagaaatgcccttcccctaaacccacaacatatctagtgtctctctgagaagcatatcacattttgccttgtaattatttgttcatctgtcttgctgtatagtaagttccttttgcttagggcagtgtggtctaagtgtggtccccagacccacagcgtcagcatcactggaaatgttttagaaatgaaattctcagacctcaccacacttactgaattagaaactatgcatttcataaatcttccatgtgattctgatgaatgttaaagtttgcaaaccactagttcagatcacccaaatttggtttataacgctgtttaaggcatatagtaggcatttactattgtgtggatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatttcaattatacagtatagtattaactatagttaatactatatgctgtacattagcatctcagaagttattcttatcactgaagttatttgttgattaaaaaaagaaactgcggtgcatctcctgtgtcattcccttcaaaattgcattccttcttatgttcatgttgattccacagtctctctgtctcagtgacttacagtagcattagattctgacaggtgttaccccagaacttccttcctcctcattcctaagtagtatttagcagaggattgtgaagggaatggggatggcgagaggctggagaggtatggacaatagaggggtgcatttcctgtagaacaggggtccctaacccctgggctgtggaccagtaccggtccatggcctgttaggaaccaggctgcacagcaggaggtgagcagcaggcgagcaaacgagcattaccatctaagcttggccttctctcaaatcatcagcagcattagattctgatagaagcccgactgaacccattgtaaactgtgcatatgagggatctaggttgcccgttccttatgataacctaatgcttgataagctgatgtggaacaacagttttatcctgaaaccatccccatcccccagtctgtggaaaaattgtcttccataaaaccggtctgaggtaccaaaaaggggactgctgctgtagagaatttccaaacaataagaaaactaaaagtggtctgcttttcattatcatcatgcaaaggcaagagcaatgtcagtgacaaaatgctttccaccacaaaaggttcctactgtgtccccccacctgctatgtcactgcattttggtaaagggagcttaagttcttttgggaatggagaagatgtggacctctgttcaccatgatactcttagaaatctaatagccttttctttcttttgtgtgtgtgtgtgtttaggcaaggaaacagttactattcttccaggagcctcttttttctccagcgatgaatcatttgcaatgattagagggtatgtaataacagagcccctcatgtttcagacagtatggaatgagctgagtcatcgtctgagtgtgttagcaaggctctgaaacacagccacatttcccagccagaaaactatcaggagtttgttcggctgcagggtgtgaaattattcacatcgaatgttgggcattgaatatccagcccactgttaggaaaagaacccccaaaatggaatccatgcctttgtgccaaccatactgaaataaacatttctaaggtgctttctgaggattctaacattttcttcaaactgtgttcactttctagctagtgtttgtgttcaagtagtcacattctgcctcactgaaggaaacagtcttcctgtgtacacctgttcatagtttgttattgaaacaatgtatactgtaacttttttttcaaaaagaatttttagtgattatttctctgtcagcatggagctgatctattaggaaatcagttgtgtggtgggggaagcaagtatattttggtggtatgaagttattctaattgctggcaagttcaagcaaaggggacaaaagcttatgaggttcactttattcttcctctttctttctcagtggacacgtcgatctgacaatgctaggagcgatgcaggtttccaaatatggtgacctggctaactggatgatacctgtaagtagacattttttattctgaattatgtttggatcagaataattatattttaaatactaagaaaaagggccatgagatcacgattctttaaaaatgaaatattttaatatatatttcttactagaatcaaattttaattaagtaagcactgagaagtattcagctttgccaatttactgtgcatttgggactaaaagtaggcaaggtcagagccgaaacctcttgcttagaagaaaccaagttagagaagacttaaaaaacagaaaaagggctaattatactctgaaaataagaaatacaaatatttaccataactaaaattttaaactaggaagaacaattaacaagtttgttagcgttgttaattaactttgctaattgttaattctattaatcagtgattgaaatcatcttgattggtcatgtgaccccataaataatcattgtcctctgctatggaattcaaaacctgtgagagtttaatatccttgtgaaatgcacagttgtcatttaatatgaaatgcacagttgtcatttaatagtgacctaaatcaaggaagaaacctcttagaattagctttggaaagaggactgttatcactgacttaattcatgagtgtagttcattatagaccaggatgttgcttcccaagtacgtgcatggaaacaataatgggtatgtttatgattatgagctcattttggctggtagcccggttgctctttgtgtgtgtgtttaaggatttccatatgtttctctatagaacaagctaagaagaatcttgtcaaataactgaggctggtggtctatgataggacagttttcttgaaatctcttaaatttgttttctaataattttttgaggaaggtggattaatgtagttgataacaatgttagagatcatgttagtctagctcatttgatctagagatcatgttagtctagctcatttgatctaatgccacctgaaatgttatgtttaagttttaataattattcaagccctagttttcaaacttggtggtgtattagaatacctcagagttttaagaaattttgatgcctgggttccagcccaggtagtctctaatttaattaatctgggatgtagcctggacactgggtcattcaaagcaactcaggtggttctgatatgtgaccaggtttgagaaccagcatattaaagattgattacaactcacttcattttaaaatgtaagagaaaaacatcattgagccatcataataagaacccttagcaaattgtggattatattgttagtttagttgtaaaaatactgatctttcagaatcagccatagttacaagggttagcagcttttgattgcttcaaaaaaatcagggagggtctcctgagcatcgtacagtgagtcagatagaaagtttgtggaaatacttgtgtaggatattacaatgtatttctgttttcaaattttagaaaagggccatacggggtagtagagtgactataggaaagcaagccctgggttttagcactgactctaccagtaatcaaggtgtgatgttgaacatttcacttatgctctttgggttaaaatgccctcatctataaagtgagggtttgagaacagataattttaggggtctcatttggttctcttagcttagtaggtaagagcaaggccctgtagtgagatagttgtggattaaagtcttatttctgacgcttgctggcagtgtaacttgagctaatttcctatttttcctcatctgtaaaaatgggaatcatataacagtacctactttataggactatatgaaggaatacatgtgacaatgcatacaaagtacatagcacagagcttgacacttagtacctggtaaataggttattgttcttataagaagttgcgggccggacgcagtggctcacgcctgtaatcccagcactttgggaggccgaggcgggtggatcacgaggtcaggagattgagaccatcctggctaacatggtgaaacctcgtctctgctaaaaaatacaaaaaattagccgggcgtggtggcatgcgcttgagtcccagctactcgagaggctgaggcaggagaatggcgtgcacccgggaggcggagcttgcagtgagcagagatcgcgccactgcactccagcctgtgggcgaaagagcgagactccgtctcataaaaaaaaaaataaataaataaaataaaaaagaagttgcggatacctggcaaagaagagaaaagcattgggtcctatgaacaaaagcaatagggttttaaatacatctatttctctagactaatgatttttgaaatcaatttgctcagtggtcctgggtatgaagcagaaatgtgttaaatatcttcttcccttcggggaacatgggcatcttcatatcagtataagatttgtttatattatgatttagcatgtagtaaggctggaagctctcatagtggtagtgtacactatgtagttatttgtaggaaagcttttccaatgcgtaccatatttttacatatcctgttaagattcctgtgaatgattaaaatacaaatgtttattactttatacttttctcaatataacttggagcccacgagttcccaaaggaatggacctagtgggatgaacaactctggagttctgtaggaacatcatggaagtctagttgagaaaaattaagcataagaagtgttcctgggtttggttccactgttttggtaatggaagttggtagtgttacttctgattagcattttttttgttgctttcataactgataatcatttcctaacttctttgtatgtgatgcaccatgtatattttcattgtttgagactcagggcagcttcagaatcaagtccatgaggtttagtttggttttaatttcagccctaccccttacaaattatgtgatctgaagcacatgttttggctaggattaagtgagaagaaaatgaaaagtgaacactgcaagcactctctaaatagtggctattaagtaatgctctattacttaaaattaaagaggaaatatttaccttaaaatacactggtaaaagcgagatgattttacaggagccagtacaacctgcttatcctaagtccctattcaagcaccaaaattaagccctttgaggacacattttttttcttttattggttatggataaagatacagcttaccttccttatgtaatttcagtaagcaatctatttttatttgtcccaaagatttgttgacttatgtaatttaaatatgtttttattgcaagatctggcagtcaagaagctgaaaaattcagctttattatattatttttcatttacttttatctttttcctgagtttaataatctttcaatggctgtgtaagccatgagttctcagcatcatgacattatcatcaatcattatagcatcagattacaataaacattaagccttcagggcaagcaaacggtgtggatgctatttgtcttaccgtttaatagcttcttagtatgcagtgttggtctcatgtacacagatttttaacaattctaccctgagcatccaaaggaggaaaacttgacaaaacagtagttggctccttcaagctcgctgctgattgtgatgatggtaaaaccccaggcaagcgaataaatgatggaaagatgtgcagtccgctgaatctatattcagagctgctctagtgctttctgaatgcctatttttggagaacagctggcattgattattgacttatgaagggaagcagatgtgtatggtcagctatgagagctggttattgaaagcacaaaatagcagcccactggacagggctgcagtacgtgagtggcacaagagccaagagccctcctctatgtggagaggattgaatgaggcattcttatggcaagaaagaatgggacacttttggtgtttttttatttttttccttttctccctcacatttttcacatctttgtgcatttgaaaagaataaatactaattaatgtcatactcctgtgtgctacatgtctgagcacataaaattgattgggttctctagacatgctacctgttttaaataagttaagtcactagtattcctggttataaaactacaagggggtttgtgttgaagattcagtctgtttagttgcatcaattgtaatccaaatgttagtccaaaatatagatatttaaatatattatgacataggtgaggaaataagcataaatctctagacattgttttaactttagtgtattgtccatttggtcctgaggctcaggaaaagaaaaacaggtggaaaatccatatgaggtcatatgaaacttttacaattagtaatgcctttgtcttattagtgtaatgtagtggaaagctcataaaactttggaattagacagacttgagcttaaatactggttctttacttattgatcatgtagtatatcactgttgtagtatattcattggtaaaatgacaatttttaactcatgcttgttctgaggattaaattcgctaattcattcaacatgtattgatctggcatatattaagggtcaggcactgttaaatataaacgacaacgtttttggggatgcagtagttaacaaaacagacaaaattctctgcatttatggagctgatattctaacaggggtcagcaaactgtgttgcatgtaccaaatctggcccactgcctatttttgtaaatttttcttggagcatagccatatccactcatttacgtattgtttatggctgctttaaatagttaggatagaaactgtgtggcttgcaaagcctaaaatatttaccgtttggccctttacagaaaagatttgccaacttctgccttagatcactgatttgaaaccttttttctctaatataagcaagtaacatcctacaaatttttatgttgtttcagtctcttcaaaatactttctaatcttccttgttattttttgtatgacccattgtttatttaaaggtgtgtcagtttccaaatatttggtaattttccacataactttttaaaaatttttcagtttaattcttttgaggtcagaaaacacactttatagtttcagtccttttaaatttgagacttgcttatggcccagaatgtaggctattttagtgactgttccatttgcacttgaatatatattctgctcttgttgggtacagtgttctgtaagtgccaattggatcaaatgggcagttagtattgttcaagtgttctgtgtcttgtcaattactgagagagcagtcttgagatcttcagctataattgtggatttgtctgtttttcctttcagttataccactttttcctttatctgttttagagctgttactacttgcatttatacacatttaagcttacattctcttaatgaattgatctgtcattttgtctcttcaataatattccttttattgaagtctactgtctgatgctgatatagtcactcttcaaagtatgtttctccattcttctgcctgtaacctatgaacacctttatttttaagtaggtttttgtaatcatatagttagattgttatcttataatctctaaatcataattggaggtttagaccatttacaattaatgtagtcatcaatatggttgggtttaaatctatcaggatatttttttttctgtttacttcatctgtcctttttgccctttgatttctttgggatcaattacgtattttttgagtattttatcttcactgttggattactttttagtggcttctctagggtctaccatatacatattttaatcacaatctacttcaagtaatatatcactttatatataatgtaagaattatacaatagtaaacttctgttttctgccttattgtgtgttctttagtgatagttaattctgcatgtgacataaaccttatacttcgctattatttttgctctaaacactcgactatctttttaagtaatctttaaaaatgaggaaaaatcttttatatttttccaacatattttctgtttgttgcactttttctgtgcagagatctagattgccatttgatgtttttttccttctgcttgaaggacatcctttgatgtttgttgtagcacaaattctatagatgtctctcaggttgatctttttcaatatttgcttttaagctgtgttaagattagttgagagtagcctttagttgcagtttaatttatagccccactactgagaaagttttcttcggaggactctgcctgatgctccatatattacaaaatctttcctcactgtttggtaggattgtgaattgttcctagacctgtgttagttttgggcttttttttttttttttttttttttgcctaatgcttgcttaatggttctttttcaggctttgactaatttcttctcatatatgcacatattcatactctgctaaagacttgagaccttcttcctctgcaaatctgagctctcactctgtataatgacctcctttctggtattttcagatctcaaattgtagttgcctcaggctctctgaagccaacaaaattgctgagtttgacttcctgtactgcagcttgcaaattctctccaggcagtaagctgggggaaattgtagacctatcttgttggcttcccttctttcagaaatggtagtcccgtactgtgtgtggtctaatgtccgaaagccactttttcatgtcagtttgatttttctaactgtttaatatcattaataacatgtttgaatttatgtcattgtgtatttactgatggttttcttagtacaaatccctagaaatagaatatctttgtcagtattttagggattttgatatatcacagagttactggccagaaaaattatcccagtttactctcacactgtttctactctattaccaacactggtatcagctttttaaaagctatattattttcttgcgttatttggcatttctttataaagctgctctctgggattgtttaaggggcagccgtaccttactcttcaggagggcatttaatcattttctctcttgttttggagaccttccttttggcttctagcaattatctctcttcaaattccagtgttgctctctttagttatattaaaaaacaacattgataatgagtattctgtgttagtgaatgtatcttaggagatccactgtaacaagcatgtatgtgaatgtgtgtgcatttcttctgtttacaatattttgaacaagctctaaatgtgggatagaataaaatacagctatttttatctcctgtggtactctttaacctattctgttagggaagcttttcctctgctgttaatgaatactcaggctgcatgacatttcagctcactctaggaaaataaacagctcttaagtgactttaattcataaactcagtcttcattcagacattagagggtccattccaaaacagtgaaaaatgctttaataatcattcaaaagcaatgcatctcctcatttttgatctcccagctacagtctgcctgcatttgaagaaggttatatagtatgcttttgctttttctctactcccctcctcttccagctcactgtttggcacccaccaggatcaaaattcaagagaaagggaaggcaaggaaatagggcaggaaagattttacatagcaggagactggtaatcctgtttgctggctccatgatctctggtccataaaaatatttaaagctgatcccttcctctctctgtgtgtgtggagtggggtgagcagttgtctttagagacccccttcttggttcctcctgcagcggctgctcctatgggtgatggctggatgcttccccagcagcttctgactttcctgcggtccacttaacatatagactcttaccggtggagtccctcttcctgggctatcctgttgacaaagcattaacctgttgaggttgttcctctctcacatggcccccatctgggaagcactcacatttcttctactgcctccagtgatagtgtagttacttccgcaaaacagcccctttaattttctcaggtaagagtcaggcagcactccctatctgcactccccatctttcaggctctgatttgtcaatggagtgagcagcaggcatacccttaccccttccttggttgctgagaaatgtaggggtagttagaatacttttcatgaaataaatccttcatacaaaacctttgctattcctatactgtattccttcagcctgctgagggtcccaagagccttgggatgtgcttttgactatttcctttgtaaattctacttctgagcatctatcctacatgctggtatcccctagctcttctatcagttaaaagtgagacagcaagatctcatctaacatctggttaccaaccacttttgctcatgagcctgcctttttttgttgccattaatcctccctatttatcatatttaattctgcacgtgatataaatcttataatactttgctattatttttgctctaaacagtcaactgtcttttaagtaatctttaaaaatgaggaaaaaaactcttcaatatttttccagcatatttgccaattcaagctcatattcagctaagccttggtgcatataagggtgttttccaactatggttctaatacctctaggcagttccccctagcctgttctgttttccacagaggactgtggaagaacccagccaaaccctgtttgtcctaacagggaataaaaatactgacccattgggatggacctttacttcctgtgctgtttggaaaatgcatttaatgccttcagaatttccaggagcaaaatattatttcctcttatacagtgatttaacaaatgggcatgcattttttttagaaaggcaactttttattagtgattcaccaatttaggatgttattagaaacataagctatttattatacttttcttgggtgctatatttggttattcaaaaatacttttatctatgactatctggaaaacatgttgaaaactaatgtttagtttccttatttacacccaatatttttcagactaaaggtatatttagagactgacatatttgacatattcattttgtcaggaaaatttctcttacttgaaagatcctgtcaatgattaaaaactgtgattaaggtttaaaagccacagctaaattctaaatctattttttacaaggagggaactaacaattattaagcacatgtcactggccaggttctgaatatttattgccattttatcctcacagaacactgagttaaatacaaatattcctgttattatagatgaagagattcaggccaagggagttaactattcaagttcacatctgtggcaagtgatgaaaagagaagtggaattacagtcttctttgctcttatgtgcttcacattctgccacaggtacttttggggatatttaactgcctttcagaatggaagcaaaacaacctgcaaaatacataaaaatctgtatagcattctgtaagccttatgaagaaatgattgtcggataaagcctgttgtggtttgaaggatatatgttgagtacatatgactcttattcatggtgggatttttttgtaggtggaccatttgcatgtttgttcttctgcatcccgttttctttaagctttcacccaaattctaaagtctccactgcccagtcacttataattagcctaaatgtcatatatgaagtactttatccattttatttacccattttgttttttataatctaccaatcaaagaattctttggaaaatttcaggccctctacaaagaatgtttataaaattatcttgcaatacttgttaaatgggaaacactgaagcacaattggagaaatatcagaattattgcaaagggaggaatactgaagataatttttaaaaagattaagatccgaaaggaacaaaagcaaattcattagcaagccatctcacccagcctaggccctcacacatgttaacctttgacagaagcaaaaggatatgagaatgtgaaagagtttctccatcttcaacagtcttacagagattttgccttttgattgctacctgagtcttttttaggaggaaagaaaatatttctctccttgctgtgcttcatatgatatattttgaacaactgcttacctctaagactttgactgttcactggaacttgggtatgttcaacacagagactgaaagaaaggtgagctagatacctgattccaaaccatgctgctacactgcctaccagacactcttgtaagaatttaatcaaatattctccatctcctctggtgttgaaaggcagacttctttgcatagagtgggattttggtcatctttgaatcagtcgatctctgtctctctcatgaacaatgaatgagtttgatatttgttataaatatccttttggctaatgatgcatttgtatgactgcagcaggctcttctcattaaacagctcacttaaaaggagaagaagaaacattaaaaatgatagatgaggcttcctagaaacccattattaataatatgataaatcatagtgttgctgatatgacttagcagggaatgaaaccaaagggctaatgattactgctggtgaccctgcagctaaaggctaatgaatcttgaagactaaattttattaaatgactgaatttcacattcccagttggcgaaatctttctctattcttttggtttagagatcatcttgatcaacacttttgagaaaatctttaaattaactctctataaaaatagaatagtaaatgcatacatccagcttagacagttatccacttatggtcagtcttgtttcatctgtactcaacttcccttttcctcagattattttgaagcaaatgctgcacatattctatccataaacatttcggcattatctgaaagattattttcaaatttctttataaaaggattcttttcataaactgcaattctgttatcccacctaacagtaaggaattaaggatataattctttaatatcattcagctataagcaccctaatgttaattgcagaaaacctgaatcaggagaaatgaagtgactcagctcaggctgcaaaactctaattagtagctaagccaatattaggacctatctcttctgtctgtagttttgtagggatgctctttccactacacaggggaaagtttacctttgaaaaacatcccaatacaaagaaccttccatgtttctttcaaatatgcttagaagtggctgtatccaaaaactatcatcaggatgaacagaaaacctacagaatgtgagaaaatatttgcaatctatccatctgaaaaatgactaatatccagagtctggaaggaacttaagcatatttacaaaaaaaaactaaccccattaaaaagtgggcaaaggacatgaacagatacttctcaaaagaagacatacatgggccaagaaataggaaaaaaagctcctggggcagtggctcatgcctgtaatcccagcactttggggggctaaggcaggcggattacttcaggtcaggagttcaagaccagcctggccaacacagtgaaacccgatctttacaaaaatacaaaaatttgctaggcatggtggcatgcacctgtaatctcagcttcttggaaggctgaggcaggagaatcacttgaacccaggaggtggaggttgcactgagctgaggtcacaccactgcactccagcctgggcagcagagcaagactccatttaaaaaaaaaaaaaagctcaacatcactgatcattagagaaatgcaaatcaaaaccagaatgagataccatctcactccagtcacaatgactattactaaaaattaaaaaaaaaaaaaaagatgctggcaagattgtggagaaaaaggaacacttttacactgttggtgggagtgtaaattaattcaaccattttggaagacagtgtggcaattcctcaaagacctagaggcagaaataccatttgactcagcaatcccattgctgggtatatacccatgggaacataaatcattctgttataaagaaacgtgtgtgttatgttcattactgcactgttcacaatagtaaagacatggaatcaacctaaatacccaccaattatagactgaataaagaaaatgtggcacatatataccatgctatactatgcagccatataaagaaacgagatcatgttctttgcagggacctggattgagtcagaagccattatcctcagcaaactaacgcaggaacagaaaaccaaacactgcatattctcacttgtaagtgggagctgaacgatgaaaacacatggacaccactgggggaacaacacatacagagggcctgttggggtatggggggagcgagagtatcaggaagaatagctgatggatgctgggcttaatacctaggtgatgggatgatctatgtggcaaaacaccatggcacacatttacctatgtaacaaacctgcatatcctgcacatgtaccctgctacttaaaataaaagttgaagggaaaaaaaaaaaagcagcagctgtgtccctgcggtcactttatctttctagacctcagcttcttatttgtaaaatgtgatccatggcatagcttttattcaacaaaattaagattttgttttctttttgtattaggtgttgtattaacaatgaagggtagagtggtaagcaaacccaatacagtcctttcctgtacagagaatgtttttatatctatgatgaggttaataagatatgggagacagtaagccggccttggtggctcacacctgtaatcccagcactttgggaggccgagatgggcagatcacgaggtcaggagatcaagaccatcctggctaacatggtgaaaccccgtctctactaaaaaaatacaaaatcagctgggcgtggtggtgggtgcctttagtcccagctacttgggaggctgaggcaggagaatggcgtgaccccaggaggcagagcttgcagtgagccaagatcgcgccactgccctgcagcctaggtgacagagcgagactccgtctcaaaaaaaaaaaaaaatgtgggagacagtactataaggtcagtgcagtacacgaaacatgaaatattttggtttgggaagaattaaatgagtttgcattagttaagtcatcctgtccaggaacatggtatagtttactctccaggtctcattttacctccattacatttgttacattattttatagttcttgtcaatattttgagctgaatagtcaatttcagtttccaaatgtctattgctaatataaaggaaaactgttgatttctatatttcttatacctattcattttactaaattttcttatcagctataataattttaaaaaaattcttagacactctacacaattctcttatctgaaaatattttgaatttaatcattaaaacaatgtaaatagtagtgattgaggaacttgattttgatgaattagagttttaacttaatattatgtttgctgtttgtgcttctagtaaatgtcctttatactgttctaacagtttgcctttactcctttgcttatagtttttaaactgaatggcagttgaatgtagtcagtatgtttccatctgtttaatcacagttcttcaccctgaatttatcaatgtcattatttaaattgatgttgaatcagttttttaatacaaatagtcaatttttaacaatttttaagttattctcgtgccttttcatctcaaattttctcacttcttgtggcaattttgttaatttgcattttccaaaaagcatccatttcttttggattttcaaattcattcacccaaaacatgtcatattcttgtatacctttaatttcctcagactgttattatatcttctctttatcctaatgctgtagatgttcagacttactaattttctttacttttactcactttttaatgttacactagttctacatttgtaaattcaaatgtttactttatttgcagtccttattataaaatcatttaaggctctgtgtttttctgaatataattttaattgcatgtcataatctttgagaaagttcttattttcattaatttctgggtagcttgtaatttcagttttgatttcttttttggcccagtaatttttcataagtgttttttcttcaaattttaaaggcttggaggagttactctttacattgctttttggaatttattgggttttcttggtggccaggtaacttgatttttttttctaaactttacatgaaaataagataattttatgtaagattgagcttgttagttattgtattcggatcttttactttctttgtgtgttagttcttggagacagtgtggtttgtagaaagtgagtaagcatagaattttaaagacctgaattctagttttagctttgttactaacaaattgtgaccttatacagattactttctctctgttggtctaatacagtatggtccagaaaactcactgtgatgatggagacattctatatgtgcttgtacagtatgggagccattagccacatgtggcttttgagtacttgaaatgtggctagtataactggcaaactcaatttctaattttgtttaattcagatttatatagccacatgtggctagtctaacttatcagacagtgcatatatgatctctgaaatcaagttcttggattcaataaatccctaacagaacccaaagctaaaatttaacctctaagctgtggatttacacatttctaaagatgctactatgtaatggggaattttgaatacttagaaaaaaatcgatatttgagaggtggtaaaacttcaacatttttctacctggttcaggcttctaacacgtataagacctagaaataatctacatttaataatttagcctatagtgatcttaaaggctttgaaatgtggagagttattttaatgaggatttgcttctgaaagtcaatgctatggtgaaaatcacattccaatattgcttctgagtatattttacttccttgtcaaaagttgcaaaacacataaaatctaacatatgttcttctcccaaagggcgttggatcaaaaaagaaagacaaattataacttatctagaaactaataaaaactaagaactttgtgtcaaagcttgaggaatacaattaaatttatactcagaataaaaagagaaccttaagtgcttttattacttgcagaaatgatacattgaccgcttctagcttgtgtgcattccttacctgtctaatgcatgtggtggggcattgttgaagaacttgcagcactcgatcatactagcagctgagatgggtatcagcattggaacagatgatcatggttattgttaaggtccagatagagcagttggcttttatttgggggtcatatgacatgtgacatatatccttaaaccctagagtcatcttgataaattcacattatgaaagcaatatgggattgggactgagtgaacatgcgttttccatctccagacctcttctctctaaactgaatgccaggcaaaatcatcagtattttacatttaccgttctctctcccctcttaaccagtgtagtggaattattttaagtaaaacgcagagtttttaactttgtttccagtcaattcaacactacccatattactatttgatagctctagtagatcattggagtatttgtactaatacttgatttatagaaaatttttagataataagatattccatctgtaacttttttacattatccaaatttagctatgtaagtaccaatttctaaatatagttatgaatagaaaattagataatccatctttttacatttgtgcataattaaagtaaatagcttctgcatgaaggcctgacacagactcctcataagctttgactcaagtacatgttttagccattcactatctgtttggcatatttctggattatgattgtagcctaggacagatctaaataaccagaccctgaaaaattaatccacaaatattacaaaaatggctgtattaaaaggcaaaatttttcttttttactgccataacttcatgaaaacaaacttattaacacttagaaactttatctgctaacataattccatcctgaatgtaacttctgcttacaatcatgtagtttttaggaaacttaatttttataaatcatggctttcagtttggcaaaagatgaatggtttatttagaagcacattggaaagctttgtaactttagtcctgaaagatctgactgtatttttagaaattgtacataggacatctctaggcttgctgtgtgcttcttaacaaaattaattaacaccatccaacagattaggaacaataagaaagaaaaatagtgcaataagttcaacataatggacattttaaaataggaagcatcttttatggggattcgattacctctttctggaggctggggaaaagacttcagccagttttttttctgacttgttctgtgacttcaggtgatgtatttagcttttcttcattgaacggttttttttaagacagagtctcactttgtcgcccaggctggagtgcagtggcacgatctcggctcactgcaacctccacctctcgggttcaagcaattcttctgcctcagcctcctaagtagctggcattacaggcatatgccaccatgcccggctaatttttgtatttttagtagggacggggtttgaccatgttggtcaggctggtctcgaactcctgacctcatgatccacccacctcaccctcccaaagtgctgggattacaggcataagccaccgcacccggccccttttttgtaaaggagagcttgttacacattctacaagcacattttaggtgatgaggactatctttatataattgagttgattaaaatatgttcagtatgaacaaagtagatcataacaagaaaaataagaatattaaaaaatagaaatggtacatcatttgtcatagaacagaggtccagtctgtatttccaattttctcacactggtaacaatatggtcaaagaacatcgttttataaagttctaatgatgtgtatgatttttttttccaaagctctatcagaatctaagatgtctagcagcaagataggcttatcaacataatgaattggatagtaaagttttttccattgggaataaaaacaaaaatcccacacatgccgttcttagatttatcttatttattcagagactaactcatgactttgttatgctagcatactctgttctggtaaatgttggattctgcaaagaaataaagttcagttactacaagaaagtaaatcattgttgaacaaagcacagattcatttgactttctcaaattcacttgttttctgagtcagattttgcaaagccgtttagcaacaggcttaaagagttactaggattgctccttactgagggaaatctgagaaccattttgttttcattttgatgaaaaacaaaaaaacacaggaacaggccacatactgagttttttaaataaattttttgttgtaaaaattaaaattagtttagattcacagaaaagctacagagatagtacagagtttccatattccccccacccagttttccaagatccagttcagggtactgcattgcttttagttgtcatagctccctagccttctctgatctgtgccagtttctcagtctttccttgtttttcgtaactttgtcagtcttgaagtattaactggatgtcatatagaatgtcccccaatctggatttgtctgatgtttttctcataattagatgtgggttatgggtttttagaaagaatatcatagaagtagagtgcccttcttatatcaggggttataggatacctacattgcatccctcatgatgataatctttatcacttggtgaaggtagtgcttaccaggtttgctcactatataaaattactagtttttcccttccctacttcgttctctgtggaagcaatttagtacctagtccaccctcaaagatctggagggggattaagctctacctcttggagggaaactgtgataaggaatatattttgtctttgatccccagttcctgacactgagcttctaaaatgtttggaatttcctgagcgatagggccataggagcattttgttattcataataagcccctttcaaccatacctgaatttacgctaatgtgactctcagtgggcccttaagtagcttcaatatggagctgtttgccagacagaccaagacatgattagagggttggaaagttcagccccacacacaatctctaggaaggagagagggtctggagattgagttcagtcaccaatggccaatgacttaatcatgcctatgtaatgaaatgtccataaaaacccctgaacgacaggattctaagtgcttctgggttgctgaacacatcagggctctgggagagtggcatacctgcatacagcatggaagctctgtgctcctgccctcaaaccttgccctatacatctcttccattgggccattccttagttgtatccttcataataaaccaataatagcaagtaaaatgccttcctgaatcctatgagctgttatagcaaattattgaagctgagcgggggttgtagaaacctcttgactttatagctggttcgtcagaggtactggtggcctggacttgctatcagggtttgaaatggggagcagttttgtaagactgaatccttaacttgtgggtcctgtgctaattccaggtagttagggtcagaagtgagttgaattgttgggcactcagctggttacagaattgggtggtgtaaggaaaaaccccacatatttgatgtcagaagtgttgagtataaacagttgaagaagtattatgtattttgcaattcttctggagagaagatttgtctcttctctcccatttatttaatcatatgtttatatcaatatgttctcaagtatgttttatattttggttgtaatacaataccatgtttatgttatttatttattcacttatttatttattttattttttgagacagagtttcactctgtcacccaggctggagtgcagtggcgtgatcttggctcactgcaacctccacctcctgggttcaaacgattctcctgcctcagcctccctagtagcctgggctacaggtgcatgccgccacgcccggctaattttttgtattttgagtagagatggggttttaccgtgttagccaggatgctctcgatctcctgacctcgtgatccacctgcctccacttcccagagtgctgggattacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttccttactttctgctactacaagatgctcatcttatatttcttgtgcccctagagtcaactttttcttcaaaagctaattctctaataagagaacgacatatagaaaaccaagatctgggtgctaggtgtgcttgttgctactgggctatcattgcttctagcccttctcaatggacagagctatgtaatatatgcacacatattaacccatgctcatgcagttttaaataataaacaactttccattttagaccattttcctaaggatagaggaaaaaagtaactccttactgaataacggtctcaaggtggtatcaacagaatgtgttttcttccaaataccagacctagaaaatggcattcttaggattaaaaatagtgacattttagcaattacacctcaccaccaagtattttgccacacttgagttccagatgaatgtgactgaggtcatatctgtcatatagctatatagtaatgttgtaaaaggaataaagtcctctcacttactgtaactcctgcttctcatctgagaatgtactagctttaacatgtaccttaacttaggtccctataaaatgaaatggaagtaactagggtttttattcacagggattttaaaacactgttttttcacacatttaacattcatatctgatattatgaatggtcaacgttactgaaaccatcaagatcagaaatttaaaaggtctcctatgaaattcagggagttgaaacattggcctatcaagaaatgagttaaagtttgtatattcctatatatgctttttacctcttctgatctttctttgtatttcactttgaaaacaattttctattctattctcagtttttcatttttttttggtggaggggtgggggtgggcgggttgcgaagggataaggtctcactctgtagcccaggctggagtgcgttggttggtgcagtcatgactcagtgcagccttgacctcctgggctcaggtgatcctcccacttcagcctcccaagtagctcatactacaggtgcatgcaaccacacccagctaattaatttttttttcttttttcttttttttttttttcgtagagacagggttttaccatgttgcccaggctagtcttgaactcctgggcttcagtgatctgcctgccttggcctcccaaattgctgagattgcaggcttgagccaccatgcccagctgttctcaatagtttgatttctgcactaccaagttcttcaccaaagcttttgtttcactattactttgctctaaagacacatcactttttttcccccatcttatagattgcctggcactgttgacttaaaaagataaggtagaaattaatgctctttgaatctcctgttatatctttcaaaaatattaactttgtggcaaatcgcccaaagtcgttcttttaactggttttggtgttgaaaggagaaactgtgtttttcctgcctgtgatgataggaccctcccagagtgacattgtgcttcagcattctctgttgcctccagagatgggtcattctcacaaggaggatgtgcttttcccttttgggactcagacctgagactcattccatgcactgagtctgtgtggaatgatgttacctaggaggcccatggttctccttgtcctgagagtagggtgtgcattcttagcaaaccggtggttagacttgcctccacatatgaaaagcactgggttcctatttcacagagtaaggcttgcacaggagaacaaattaagactccaacacagagttatcaatttgctgtgaatgtcatagctattaattcccagtaggtacttaagcagtcattaaacggggtcatcaactgaatccagaggacatcttgagataaacagtagttattaatttaatgtagaatcaaaatactttgtattcttccacccagtcctataatacttgcttaatagggcacgtacatttattatacatagcatgatcttttgcaattgctcttaactgctttttttttaacctttaaaatttatcttctgtgttactttctgatcctttctattgtggaaaaaaacactggtaatgatttcaatttattaatgttctttcagtcactctctctctctttttttttttgttttttttaatctcatccacctgtcagtgatggcggtgtaattacattaagtctaattgtgctcttagagctttgcagacagtgggaggaggtgatggagcaagtatgtgctgcccatggttctagttctcattccctcccccttctccccaaccaacccacatcctctttgaggaatcagaaaataaactttctgagaacaagtatttcctgatgacaaaataaatagtaataattccatattccatgtgaacgagttgttgaggagattaatatattttagtacatgcagacacataaatgatgtttttccatttgtattttagtttcctattttgtaatgactattggagacctcctaaaagtataaacctttaaaaaattatgtgatagtaattgtgaccatttaaacctcaccattagaacataggttgaaccaaccatatgaaattcctgtatttgcaggtcatacatgctcctatgtgagcaatttcatatgattctaatgcatttctctcagcgattcagtggaaggaagaaaataacttatccctggatttttaaatatgtaatttattctgtttctgggtagtatacaggcccagaagctccagtgcttagctatattcaataaactcaaataacttagagtacctttttatttatcctgaaacacttggtcatgctctttccatcaatgccttctgtaagaggcctgataaaacaagctgaactcacttagccatattgtctgatgtttgttttcatctctgtagtattatgaatagactctatgaaaactgcaactgcagcttcagaacagagctaggagtacgtttttctcttgctgtccattttcaaaatctaacaaatagatcagagtgttagtctatgtgaccttatacaaagagcttaaccaatccaaagtgccttaataacaacaaaaaaaactttgtcacacattgattgtaccttgagaagagaaaatacattggtttcatagttctaactgttcacttaataaatacttattaatttcttatacagagatggagttaattaccttgtataattaatgacaattttgtatgcattggaattttttcttggagcaatgaggtttcataagtgaactatggagaccctcttgaatggtatttacattttacaaaatgagagaaattggtgtaattaatagctaggaacagaactcatttttcttatttgaagttaattgatttctttaagaatcaaacctattacatttgtgacattttctaacctgcataaagtggtttgtctggactatcttacaatagatgaatgaagactctgatcatggtaataaagtgagtttcacttacatttttgtttgttcaggttcatttgcaatagacaatgtgttagagaaacttgatgtggttttggtatagtttctggtatgaactagtatagatagtttctgtaaagtaattttttattttcaaatattctgcctggagtcagaaaatagcacatttatcaaatctaatgtatacaattatcataaaatcattttgaattgatacacatcagtggttctgttagttatatttattatagtggaatttataaaaatggattttaccctttgtgaatatttgaaagaaaacagaagtggtagttttaggattttagaatttgcattttttatttaatttggcctcagaaacattgagagggcattcaagacctataagctattaaaagcaggagttttgtatgcttagtgaaaagcacagaacacctaacaggtattaagtagatgcttaattaatgattaatagttggggtatccagtttcttaggacttttccttgggtgtcttataaatgatttttctccccacttgaaaaagcaaattcagtgtagttcagatatgtattaaataacatttatttaacattcagccctgaagaagatatttaaaaaatgtccttagtagggtcaattttgaaggacaccatattttcttctctatagctttgcaacttcctgaggtgaagttttaattttacattttattttagccacctctttttttcttcttgctatcattttctctgtaggtaatgtccctagctttgattactctcattagtacaccttaatatctttttgattctgtattttttagaaacaaacttgaagatggaattcagtttacttaaatacatagtgaaaacaagctatcatgtattagcaactgcactgggttgaaggtgaacagggaaggcaaagggctcatagtctaatgagcaagggctgggcgtggtggctcacgcctgtaatcccaacactttgggaggccaaggcaggcggatcacctgaggtcaggagttcgagaccagcctgaccaacatggtgaaaccccgtctctattaaaaataaaaaaattagtggggcatggtgggcgcgtgcctgtaaccccagctacttgggaggctcaggcacaagaatcacttgaatccaggaggcggagatcctgccactgtaccccaacctgggcaacacagcaagactctgtctcaaaaataataatagtaataataataagcaagatgatatcctacatctgtgataggtgattttttttttacttgagtcacggtttctctctgtcgaccaggttggagtccagtggctgctcagcatggccttgatttgctgggctcaagtgattttcctgcctcagcttctcgagtagctgggaccacaggcacacatcatcccatctagtgactttttttttttttttttttggtagagatagggtctttctatattgcccaggctggtcttaaactcccgggcttaagtgatcctcctaccccagcctctaaaatgtccagattacaggtgtgagctaccacacctggccctgtgacaggtggtcttgattaggtggtaaggcacaggcactgattaatcagaacagatgtgagaaatcagaacagatttgagaacagatgtgagcactggtagtcatagctgcatggggtcttggaggctccctattgtgtttttaattattaaattttggggggaagggtggttagagagaagggaggtgtctcataagggagagatcataactacttgtatggccttgtcactacctgccactacaacatcagccctgatcttaaagctgataatgtggtaaattttaaaatgggaatatgcaagtatgctgtgagaggttcctaaaataatcatgtggatagcgtgggacagaggtctgtgaacacttcctgagagaagtcatcatgattgatacataaagaataagccggagctcacttcatagtatgaaggagaaacctcaaggcatgtgggagccatatgctatgtacaagcaactcactattcctggcatggaaatgggaactggggtgtgaggaaatgaagaggggagggtccaggttattacagaccttgaatgccaggctgaggtgcttggactttaccctgaagcgctgaagggttttatgcagaggagcaacgtattcagatgcgcattttagagaggcggtttttgtggctgcaagttggacagagagggacaaagctggacacatgttgaccagtaaggagactactataactctttagggagaaatcatgggaatcttagctaggatgagaaaaggtcaagctcaagaaatgttgggagaagtggagttcttagtagttgagcgactgattggatgtgggttatgagggagaggcaggagacaaggaggtttctgatttggatcttgaggtggatgattggccattaactgagccaggaaatttgcaggtgggtgagatttgcctttatgaagatacttaatttagtttggatcatattgagctgaggcatgtattaatataacagaagtttttatttctcattcacctagaaccaaatgagtatccctaattgtcaggcagctctcttctgtgcagtaattcagggattgagattccttccatcctacagctccaccattttcaacttgtagtttgcggaaggtagaagaatgtggaggattgttcttgcaaggttttatggtccagacctggaagtagtatacatcactttcactttccattgtccagaacttattccatgtgaccaattgtaacttcaaggaaggctggaaaatgtagcctaactatgagctcaggaataaaggaacaattttgggaatcagttaacaggatgtgccacagggtgacagggacacttttggatatcgaagtctgaaacttgcagcaaagaccttagctggaaatgtggttttaggactcatcagagacaggggcagttcatatgatgaaactagatggagtcactcttggagaacaagtaggcaagagctgaggacagagctgttaatttggccaacatataaagtgttctgggaaaaaggatgctaggtagaaaactgaaagcctcaatagcagtaggaggaaccaggaccatagaagcccctaagtggaggatttcaaggagtgaatggaagacactgtgatatgcagtagatagatataggaatgtagacagatatatagtagacactatatatatatatatatatatagatatatatatatatatatatatacacacacatatatattagatactagatagatatatagtagacaccacaaggtgtctactcaatcagatgattaactattagagacgtgactgagtagagttctcacttcaagggcacagtcaagcagaaacaagattttctctctccagggaattagcagagaggagccatggagagaggatggagaaactggagcaatggggctaattgatgacatagagcatccctgagagaacaggaacaagagagcttattaaaataaaaatttgagtttatcagaatactgctcttttgacatgcttttttgaaaagcccttataatgattgataactgatttttattgtaagtaattttgctaacctaacaatagagaatataattatatttctcgttccatattagttggtttacataatcaattcacctgtcctagaaaatgccattaatctttgaaaataactttttttggttttttaaaagaaagtgtaacacagaaaagagaaatattctcatgtaactgtgctataactgctatactaaggcaaattttaagtctcttatttttcctagagaaaggtgtttataacctgttactatatgtttaaattaatgttatctttctcagttttcctctctcctactctttagctaggagcatgcttagaggactatttcttttctagagcattttttaataatggggaagacagatataaagaggcttacatttggattgaggtgggtacttaatgttctggtatttaatattgagcagtaagagctagttttattaataaatcattctacaatgatctttccctttgacttccaatagattcacactttctactatggcatatagcattactttaaaatgcttttaaaattgtttctatatattataaattgtttctcacttaagaccagaatatttagaggtaacatctggaaatgagccattactgtttatgtactaatgataaaggtaacggcaagaatgattttcagtgtgttttgtactttattttaaacagcatttcacagaaccattcaaatgcattcatttttcctttttgtaaaatccttaaaatatcaccaaagatcatgtttacaacttgaattcctgttgttgttgttgtttttttttttttttggagtacaatgtaatattgatactttgatgtgttgactttttaatgttactgaatttataatagtttttctcttactttctttaaaattctagtattaggaaataggatcaaaataggtgaaattattgatttcagcttaaatctattttctagaaaaaagtggatcatcatattcatcttttatttctaattcctatcttggtgcctggtttataatagattctgagtaaatacttgtgaattgaggatacttgaatcagtatctttagaaaggttgtataactgttgtgatggagcatgcggcattgctagctcattttattgcagaatctttccatacttgctatcagggtcaatccttaacagcaaaaagatgagttggctatgaaatgagcatccagcaatcatctctccattatgctagccagaacgcatttcagaactagagttgcatcctttaagaaatgtatgtttgctgatgagattttaaagaaagccatactttgtgtcatgctggcccaatgcttcaatcattcccagaagctcttcttcattataggcctattttccccaagtatcactttccctctgtgacttatttaaagatatatttttagctccttaatctccccattttatcagcttcttgttctgtatgttgaattaggatgttgaattttggggatgaagatgagggatgggggtggactctatattcccctgttcagctattcacttaacttgtagtgctctcatcttctcaaaattctttccatccattcattcactcactcattttattcactcagcaatcatgttttacctctgcaaaatgtcaagcagtgtgttggacatctggatagaaaggtgaattactctgcctaggacagcatctgacatagtcacctcactcagggagcagtagtaaaatgtccccttaagagctttgctcagatccccttctgttgtgcagctataacagttctaatttgacactgaattctcacccttccatataatttgggcaccactttaatatattagtcatactagcttctgtaacaaataaacccttcagtttgagtggcttagcaccctgtgcacttatttttttactcattttgaatggtgcaatgtagttccaaagaagtgggctgtgcaacagatggtcctttaaggaccaaggctgaaggaaactcagccatcttccaaagtcgctttggatgtcagcgtccagattgcagaacgtgaaaaaacatgaactgcatgaaagagatttttgtaggccagagctgaaaatcatagatgtcacctccattttttccattgtctggaactcaggcacatggccacccctaactggaatagagatctgggagatgcaagtggtggggacccaaaagaatgcctagctaagctggagtgaaggatgatgatgcatttcccgcttatgtcagggagtatgccttgtataaccctgttttattttcctcctggtataaatagaacgccttttcttctttttagtaatggactgtttcagaaatcctttgggaattgaaatggagggaaacattttattttctgtttccaatacagtgaacacactaaaagcagaaaaaccagatatttgaaggttttcctgtgacctgctagaaatgctattaaaagatactgctcttatctttcacagtattgctcttaccacctaatgggctacttgtgtgaatcccctcatttgggaatctccctgagctacttccttccctgcctgctttcccagccacagttagcagttgcatcctcagtgttatacctttgttggtttaattcattcatccactcactcatccaaatatttataatggagagaagaagagaaagagggaaggcagggaaagagaacagttgaaattcactgtgatagcattacatactgaatagtataaaggcttagggaaaagacacttatctgtactttgtgataagagagaggtgaaaatgttccttttagaggaaggaagtgtagtctgagtcttttagtattcatggatacttttccttccataggcaacaagcttttccaggagaaggaccttgttttgatctgactctagcaccctagtatacagcaacacttatactagacattcagtaagttgaattgattgaagataagtgaatacatttataaactctatttattacacgtttgcatacatcatctcatacagtgctcaccacagctctatggtaggacagatattcttattcctggtgtacagataatgaacacaaattcagagagatttggtgttttgccattgactcatagttaacaggctagatctcaggtgttctgcatctaatcttgtgcatttttcactcttggaaacaagcattaaatttaagaatcaaaatagtgctttaaaggttgtaacatgtgctttggaaatgagacatcaagccagctgaatctctttgagtgaaggctattcacttatattgagtcaagagtgtttttaacaaaaacagacatgcttggtctaccatgtttcatagtgtgttatattcttgccagcacactggtttgtaccctgcagggcctctatacatatttctaaactaattgacagtaatttaaaatgtataaatcagattcatctaaattgggcaggcttccttcttgttagaggctgtcataagtttttacctatgtaaccattttgtcacaggggacagaatttgcctgtggtatattctaattcagggacttttttttaattcaaagagttgttaactctctagcttggtttctggttttctttggctgctgccttttcattcttccagcgctcgccccctcagtctgccaaggacactatgtatagaaactgagactgcctggatgttcttaccatagcagattgacacattttatcatagggttgctttagtgtcttttgttgctctacaaatctcaaactttctcattagaatttgataggcattgattgcttccatctctgacttatttatattttgtacgatatcaatgttctctacagaaatattatgaccaacttaataaattggccccagtttattagggttgcagctaagaatgaaggcattgcttatagaagtttaaaagtatgcatttccacattatgttctgcttcaaacggtctgaaaccaggctcattttgtactctgcattctctcccctgccaccctcatcccttgtcccccagctgttgccagctgccatctatcttatttactgacagattccaaaccacaaaaatgtggtgactacttcttttcttcatactgctcatctaattcatgttcatgttctgtttcattgacctgtaaaatgtctccaaaatcatggaattcgagaccgtgttttaaagccatgttgtgtgcatttcttgatctccttatagctctaacattatcagaaaggagctaagagccctctaagactttactggcaaatcagcaagaggacttgggctaaaaaataaataaaattttaaggaggtttcagttcaaagacatttctcctcaatatacttgagtaagaatcattttatcatctctggaaacacttgctttttccagaactctgtaagcaggagacagaatagacggatggactttttcagagcatgtggtacatagaaggtggttggtaaaagtataatgaatgaagggatggccagatgatcaaaaatagaatgataatggtgaaatgatcctgaactctgtttctgtgttctgtttttgcttagcaagaatgttttttattttatttttctaagcgcaagataaatgccaagtgttagaaagacagagccacctttcatattagccattactagaaaaacaccattcatgcctcagcctactactacataatggaattttaatctgcaggaaatccaagagtactttagaaagtgcccttaattgaagactcagtagagttgattgtgtttaaaaagaagtggatgtcaggggtgtttggatttcaatctgatagtgtaataatagtaatgtcccagaattctggaaaggtttttaattttttttaatccactgattgtcttattgctaaaatgtcaagaaaatcatattagccacacttaataaaagtgatgtaatgtttatcctgaactttatccttcaaccacagaataatagagtgacagaatattaggttatagaacttcaagcactaagcaatgaaggacaatgagtttttaatgattctagtagcttatttttgcaagttaattttgttctgtcacatacaaaagaagtgaaagatacagagctatttattttttgttttgcaggggaagatggtgaaaggaatgggaggtgctatggatttagtgtccagtgcgaaaaccaaagtggtggtcaccatggagcattctgcaaaggtaacatgtactgtgctccccaaatactgcttttggaaatttgcaatacatcaaaacccagtgtaccaccaggtcacctaactgtggattttattttctctggctcattcaaggtgatagcatttacatttgagagagaaagatgacaaaaacagttacttattatttatttagctaaatggttaactttgagtgaaaccaaacatcagcatgttcttcaaatatttgtcctgcatacctattaaaagtaaaagctttatgcatacatattaaaagtaaaagctttaatatctccaaaggaagtgaaaagatgtctgtatggatgtattgattcaggttttaagatgattatagtggttgctatctgtgcgtgaaatgaaaagccacaacagaacatacatcttaacaacagttattttcaaatggaccatatggccctcaaagctgtgaggtgccgtatccagaagatgttacaaaataatggactaggtgatagctctgaaaggtattatacttttattttgataaatcattaaatatttgagtgcctgttacatgctaggcatgctaggatgtggcagtgaccaaaactggacaaaaattactgatctcatgaagcttacattcagtctttttcctcttccttcacattgcaataataatagctaccattttttagtgtttactgtgtgccaagaatacaccaagctctgtgtatatgtatgggcccatgaacttgatataagtgctcttagtatgtccagaaacagagctttagagaggttaagtaacttgcccgaagttctgttagaactagtagaactctgattagacctggtgtctctgattccaaagcccagttgtctcaccaaggaactatcagtgtaagtttcttccttgttcctgactcagtgtctttggacgaactgagcttaattgccttcctaacctgaacccattggcttctactgattttaaaagttgatattgaatgctttcttcatcttctttgccttctcttcatcctcctttattctttatcattcttagttttaaaatctacctcttctcactttgagacctgctaatctgagtggaaatgacagttcatttgccctctttttgtttagtgatgcagcattatgttaaagcacggaactagaagattcacatcccacctgcttcccctgggaaagtttggttacagagaaatgtatgccacaaaatgattttgttgtgaaaacagctataaatatgtgttatcataaattgagtaaacagtgggaggtgagcagtggtgcataaatatggaataatagaaatggtaccagcacaggtgacttctgagaatgccttgcaaagcatccaaaatacttcatttcagaggcaagaggatgccaagcatgcaaatcaaatccaaatcttttctggaaaataatgtctatttggaaaaaactctttcagactttctttttgttgtgaaccttaatattgacacacgaaggcactgaagttcaacttattttagtttatttttgtgtatttgttttcaaaacattaggcctatattttgcaaattcttttcttccacccaagtcctttctttctcctcagctggaatttctgatagaggaaaataaatgatgccaccaacttcagactagaaatatcttattaaagctttccacagaagaaagatcatattttttacttctttccttctctcagtggggaaattagcactgagttttaaaacagaattggaatgaggtatttttccgtagatagtttcatttcaacaaaccaataaaacaatgtacttatgattaaaataatagtaatgaattattcacagtaaacagttaacctttgaaaaataatcaacagtttctcttctcacacattttacttgtggctctcgaatatgtagctgctactattttgttcacctggactcatggttactggcccagctcaagggaagacagggaacctgctatttcttttttgcatcttttgctttggttaaaagttgagaagagctggaaaagaggtagggaagagagttttttcactcctggtaatctcttcagttaagaatctgttcttttagatatgccaggtaacttctgctgccttatgattaagtgaacagcctaggggagcaatctctagagttttgtaagacatgggagtaaagtttgcaaagaaggattaaaacctgagaaatatagtcttgtattcttgtgctgctgttttgctgttttttttgtttgtttgttttgttttgttttttctgtaagtggatagagctattaactggttttcgggtagggctatctatttccttatcgatagggttacagttaatttgcaggttgtttataaatatagcattgcttggctttgtaaaaatgtgttttttgttgttgttttaataagacaaaggaaactcttgcaaccagttactgcctttagttcagactccagcagcttctaaaacctgagacctggctacctacgggtgctgctctggagtaacacctgccctcagactacctctgcaacgtatgtcaggcacacgggtcagactggcattgtaacttgattttcatttgagcctagacatcagagttacaggcaaagttttgaagtaggcaaagttttttttggtgtccagccacctttcttcttaagcttctttttcatttctaggtatatcttatcttctgccctttaaaaatgtgaagaaaggaaaggagtaacaatctgagtccttaccaggtggaggtgctgtgcttggcactgcatatgcttaatctcattgatcctctgaagtaaggttgagatatgggtattaagaagcttatccaggaaagtgacagagctggaatttgattcagtgtggtgcagcctgtgttcatactgcaccatgccacatcctcacaaagctacctctgcaccagcgtcccacccacatctgccctttcaggaagcttcaggtttttttttttttttttcattttccctggacaaagctctctttgcttaggtgagacttacatcagcaatatgtttaaaagaaaataatccaaaaatctaattatatcttctaatacctatctccatttcttcctttttgcattagactcctccctgttttatctgggcacacagataaacccagtgactggctacatttcctagccttcctgtgcatagatacatccatgctaccaagtttgggtcagtgggatttgagtatttatgatgtatgtaatttctgaggtatgtctttaaagttaaagccaattgcattaaattttctatgccccctctgtctgataaaggccttgactgcagcagcagccttgggtacaaacctgtaaaccatgtgctgcgggttgcagagctgcctccaccacttgtatccatagatagattccccattccttcctttatgggttccctccagaactctttataatgccctctgctctgcagccttctaaggtgccatctgaatctttggtaccaactactatttttcactcagtggctccctccaccacttgtatccatagatagattccccattccttcctttatgggttccctccagaactctttataatgccctctgctctgcagccttctaaggtgccatctgaatctttggtaccaagtactatttttcactcagtggctccttaatcatttttccacactagaatcttctgatcagccatagaactatatttctaacttcctattacacaactccacctggttgttccacagccacctcatctgcaacaaattttgccaactaaatcatcattccccctaaatatgttctgcttatttggcccaactagagaagtgatgatctcccagttatcatttggcagggcatccatggtccctctctgcccctacccctacgtacaccaagcactataaatattgcatcaatgtgactcttgtagtctgctccccactatgtatttctactctgtttatccctgttaaggccttctttacatctgcatagatcactactgcagcattccaaaggtccctgactgctgactgcccctacgtcctggtaatcaagcacacgactgccagattgactagtctaaaactaaagctagatgaagttgttgctatttaaaatctgtaaacatagtcaacactgcttggttctacttagcccatctgcctttgcgattcgctccccagcagcctatctcatccttgcccgcagaacttaaggtctactaagatctacagaaaggcatcatggtgtttcccattcttaggtgtttgtacattcagtgcccactccctctttatctggcttattcctacctctgtaaaatcatagatgaatgagccaatgttttatgaatttgctggtttagttccttctgtcctctcgacattgtgaatgaccaaaggaatattctttgatgttttgtcttgaattttggtaaaattaccttctgagtatgttaatttacttgtttattcagacataaaatatttactgaggacttgatatgtacaaagtactatcataggctctgaggaaatgaaaaaagatatggtccttcaggcagcccagtcttatgggggcagagtcatggaaatcagtacttaagatgaaaggtgagcaaagcagagcctgcagaacctggcatctcattcccagttccattgttggggagcaacaaagaggcttcccatgggatgtatggagtatttgcaggagatctgagggatggggcagcttgacagggattaagtgttgcaggaaataaaagaatagacactggtgtgtgggaggatggtgcatgttaagagatttataattaggtccctctagtcaaagaacaaagcgagaaaggttgagtgggaaaaaatatactcacacttaaacacacacagtggccagagtgatttttttcgccaaaatgtaaatgggatcatgctacttctttgttggctcaaaaaccctcaatggcagctcaaaaaccctcaatgacttcccatctcacttagattcaagtccagagtccttactattgtctccaagacttccatggtttgtagactccccctgctttgccaccccaactgcctctctgaatctgttatctctcttgcccacttaacttcaccctcactcacttcctgaaagtttctagaacatcgtaagaatatcttgccttgggacctttgcatttgttattctttatgcctagaatactttttcctagctatccacatggctcactgcctcacttcactcagactcaaaataccagagaagctttctttgactaccttattatatacaacagaactcttccgtcttcagacgatcctttctcccccttcttcagcagaatgcaaactccatgaagacaggggctctgttataagcaccgagtagaatagagccttatgtacatcatggctcaatacatacttgttgaattaatttttcaagtaatccaccttgaacatatagaaagcacttctaacttttccaagttgttacatgcttctgtctccattttatcattataaccctctcatgagatggttcttgatattttctttctagaggcagaatttcatagaggttaagtaacccaataaaataaaaagtaaaaccaagcccagagtccatgcattctgcctctgggcttccttttccttttgttaagcttttctgctggcaagcaccattaccactaacaacatgaagaatctgttttgttctcaatatcatgtacgggaaacgtgttcctaagtataactttcagaccacaaaaacaaaggaattcagttactgttgtcatttaatggcaacaaacaaagcttggtttcttaattttggagacaaaatgagaactctattactaaaacaggtttagatttttgtattacaataggaggtctggattctgaagggataaaaagaataattgttatgaagttgagaataaacctggtgaatgaaagaataaaccttgtgttttttaatttggattaccttaagcttattagtgttaaaaagtatactcatatagcttcactcactctctcctggcttgtgctgcctttgtcatataaactgtagcgatctttatactcatctgcccatcagaacatatttataattgttgttttatgcaactgtgtttacagtcttgtaaaggaaatgttatatttatgtatgtacctttatgtgtaccaatatttgcttttaggtgaccttttatatttacctttcctgctgttctttatttcttcaccttgattcaaattatagtcaagtatcttttcatttcagcctttaatctgtgtctatagcacaggtctcatatagagctgaaagctatcttatcttgacttcactttttgtggagaagaattataaaaggtaaatggagtttattaatcctgcttattttggatgaaatgtgttatcaaaagccaacaaatatgaaggctttttaaggaaaaccctttcttgggagacatccttcagataattttcagcaacattgaaaagtagctcaaaatgaaagtattcttttcttaggagaattcataattaataagagtttcagctagcttaatttttttctcatttataaaagcgtataattctttcctagcttcaattagaatatacagtagccaggttctgtttggggaaaaaaaattcacctttaaaaactataaatccttacatggttttgcctttttatttctcctttatgatagaaatgcctgcaaaaacgttataaaatgggagaaaaaaagcagaacacagtccaacaactagtaaaactctttaaaatgtgttacagaatttaattaaccttatcactttaaattctttagctttgcatttatgtgcacaagtctccacattttctaaaataaaaaggaaaactaatgctaacagaggctttctaaggtaccacaacagttcatgaatgaaaagagaaagtaattcctgctgacttctgtgctctgccctctggaggttagagatcataggacgcaacctttagaaaaaataagtatgtctatgataatgatttttatgatacagtgtacaagaaatgtatatgatacagtgtataaggggccttctattctaagatctcaaaaccctgaagaccgtttttcaggcaaatggcttgctgtatctactgtttcatttggctagtcttccccttgagaatatacctgtaaccacaaacttttattacctccatatattacctccacatatcatttgtaatagcaaatgttctctgcttctaagttagctgagtctctctactgaagtcctgagtggattgttggaaaccctatagtgtaggcgctgtataaaggtcaatcatatcccatgaggacaaatgcagtgtgagtaatctcattctttccttttattctgtgtaccttgattttctttatttagcaaatccagttcttttctttttttaaaaaaattaaattttttaatttttgtgggcacataataggtgaatatatttatggggtacatgagatgttttgatataggcatatggtgtgaaataatcacactgtggagaatggggtatccatcttctcaagcatgtatcttttgtgttacaaataatccagctacatcagttatagtgatgtgacagtcatgtattttgtaatacagcatttcccattattgtatttgtgtgtgtatgtggtatgcttgatttaagcattgagattaagtgggagaaggaaagagcaagggtgttgataatcaggcttcatccatgatattttggcaagcccaaagatagacctgccattggcttccttgttctaccagacaaagtatttaatattctcttgccaagaatattaaattaaaagaagcccttgtagtccttcttttcagcaaattatggcaagtgcctttaagctttagaagggagcaggtggaagaggtaaaataactataattcactgtttctctcttaactttcacatttgtatgttttgggctacagtcctaaagtgtctttgctgcttccttttatcacacctttatctgtcttcccaaagtcttataagccccgtcatgtgcttctgctagctgtgctgcttctagtgagctcagagatactaggaatgtacgagtacctatcttagaactagaaaggcagcccctagtggtccatagacattagtcacatggcattttatagctcccctctggagttccttgaatcagaaatgcagcctttattgatcactgtagtttgcctaatgttctactcatggctgtacatatgaagaaaaatagtcttagcttagtgagctcagcatctaatggaggtggtggcaagaggtcaacatgtgaagggaggaggaagcacaggagcacctaggagggccacacactggggacacccatgggaacatgactgcagcaccagatgaggatgctggatgaaggttttcctagggaagatggtgtctgagccaactcctgaataggaagggtgttgccgtttgaatctggggtgatgaggtatgtggtggtatgtgttccagctaacaggcagcatgaacaaaagctgaaaggcttggtctttttaggagcaggcaaatcccagaacttgccttctctgtagttgatcattagggctttgccaaagaaagtactgagagaaaaaatacgtgcacacgtgtgtgtctgtgtgtgtgtgtgtgtgtgtgtgtctatgtgtgtgtgtgtgtctatgtgtgtgtgtgtgtgtgtattgcagccacatttaacaagcacttaacagaaaagatgagcatgaaatgaggttttgtataaagcacagtcttaaagatttcaggtgaatgtattgacatgaaatgcaagaaatcattctgttgtgataaagagcttatttggatttgggattaagttcattgcaataacatgaaacttattgttatgatagcaaagggatttattactatttaactagagttgtttaatactgcagaacttaggcccaggattttattcagacatctaaagaattaaagagatcaccaagaagcaagcaatagaaagtactagagtgtttagtcacttgaaaatggtgaattaccctatgtattgctcaagtcctgtaagcgctgaaggagaaagagaaagattagggaagctgatgcaggaaagaaggtagatgttcaccaaaggttgtgatgaagttaataagtaagggcatattgaaatcaggagcctcaggactagtcagttttttttgtttgtttttgtttgtttgtttgagaccagttctctttgttgcccaagctggagtgcaatggcatgagcatagcttactacaacctcctgggctcaagcagtcctcctaccttggcctcctgagtagctggaactacaggcacgcacagacacaactggctaacttttaaaatttttgtagaaatagggtcttgctatgttgcctggggtgttctagaactgctggcctcaagtgatcctcccacctcagcttcccaaagtgctgggattacaggtgtgacccatgccaccatgcacaaagcatttttaatgctatgctttgtatctatttctctgccttttctgacaacccttcatgaggaaggaaagaaatgcaatatataagcatgaatgagatccgcgtaaccctgtatatttgcacctagattcaacccaccctagtttattgcagtttcagaacatttcatttgattcctacaatgatcaggtaaggaggataaagcaaaggataagagagaactatggcacaaagaatttaagggaccacaaaaattgtatggcagaactaagactacaaacctggtctttggactcctagtagagtgctctttgctcccacaccatactgcattcctttactaggatttatttttaaatgctaaaacctcagcacttgttcctcctttgtgagtcactaatatatgcagctgccatagcatactgtagggctcagcccagcatatttagaatagagtgctaacatgggagctagtcatattttggtttcatagctaaccttttattgaatattgaaattgtgacattttaaaatctttctgcatctcattttctttttccttgatctgtgttatgtcctggcactataaatgtgaatggaatcatctagctccattgttctaacaggaatacatttggtgccagtttcttaggagagccatatggtttgcccccaaatttgtgttgtgttttcactagttttatgtgtctcaggaattgtatttaggccattttctacataatcctctgtcagacttcatataggaacttaatttcctcgcaggttttagaaatattaattatggattgtattaaaaacagtaccagctaacattcattaagcactaagtgctggacccttgcatttcatgtagaacttatctaatctttcaaggtagggtggatggagaagcatgggcatgtggctcttacagagacagtggggggcatggccaggttttacacacaggtcctttggctctagcccatgcacttaaccactatgctatagtgtgtatgcagagaatggtctagaaaaaggtctccattggtagggcacagccaattctgtcagttgaaatccttgattcctcctaaaatgaagttgattgttcattaaaatccaagtggctgctctcatgccagatgtagatcttgctcaaataatgagaactaagtaagagctccttgcagaaaatgttcttcagtggctggcagatagttcagtttgtttgaagtcaggcccagaattcattgtgacatgccttgatttatattaaatgtaaggagacctgacaactgtagaagttcgaatatttgtcattaatttcagctgtttaattaatttagcttctgtgtcgtgcagaatttgaaattttaaaagaaaaataattagaagtgaagtgaaaatgaagctttatttctgcaactataaattttcatatacagtaagatctggaaacatatgaattgttttcaaaggtgttatgtcaacttacttcatatgtatttagcaccagttttgtctgaactaaagtaatagtttttttaaaaatctatccaagattcccaatttacctctgtttctcttcccattcattcttacatgcctttattcaaaaactactgaatgtcttttattccctgaactggcttaagtacattaaagccccttaattactagtgcattgctgagttggcaggctatcacaaggaatgaaatcttaatggagtccacctatctgaaattcatagcctctgcccatatacttagcctgacaccagttttgggagagatataaactagatagtaggtgtgcatttaagcaggtaaaacattgagatggctaaggacgatagtggcgtcacatgtggtacattagatccaaaagaaagcaataaaagcattttgtcatttttggagaagatctagaatatgttagagtagctatcagccccaagggagacagtaatttaggctcctggtgcttgactcttaaaaagtagcttaatcatgaacagaagaaaatgatctgaagatcagatcctcagagccaatgtttcaactgtgttcctcagacatgcctcagaggccagttctacattgcaggtgggaggaggggctggaggagggagtcaatgaatgaaaacattttttccacttttagtttttcttaagtcttcctctgccacaataggaaatgaatagatactgtttaaaattgattaatcaagaagtagcatggtaaacatagtattttaaaagtggatataagaagaaaatgtgtagaaacctagaagaaaatgctaaaaaaaaaaaaaaaaaaaaaaaacccaaaaaacacactagaatggattccagttaagagcaagtctaagagtggggaagggaggcaaggcactgctgttttccatgtacatattacttttttaacagataaagtattttttaagaagaggacttacgcatttgtgttctgtatgtgctttgcatcctgcgcagatatctgctcacatttttaaaggagaccattccttggaagggaaaaataatcaggatattagtgacatttcacttcaaatgatacaagggctgaggcttgagaagtcaaatttctggcaggatgtttcccaattaaatcatttctgcctttggccattcatctggcattctctaaattattgcaggtacagaagctgcctccaaaaaaagagtaaaaaatgtaactgtgcaaaaattctgaaagagtctttacttaggagacaatttctctgatagtttctgtttatcctatagttatgccaattctaaataaaaattgctccctaactactctttttgatgttttctttttaaaacagggaaatgcacataaaatcatggagaaatgtacattaccattgactggaaagcaatgtgtcaaccgcattattactgaaaaggtaaaaagtgctttttctactattaccatgttttaagtaagcatttttagaaagttttgttaccttctaagagtgtattacaccagtagtcataggattaatttagtctgtgggcagaacgaataggaaagctcatcaatttaatgtttctaaatgtagaattctttatgtgcaactctttggaaacatgcaaacaaaactgaatcactgtccttggtaactttgacagtgtgctataatcagagaaaagttttattgatctttatattttgactattacagtgtcaggctggatggtgatatatgcaaagttatgaatatattatttctaccttttctaaatcacaagtagaaatttttggattttaagaaattcagtgtaagttgggtttttaattgtttcagtgcaaatcgtagtataggccccacagtaagccaagaaatgtattctgtttcttgcatgctttctgctctcttttatagagtagggtttcaaaacacacagtgactctctagattcttcttactagatggaacatattggtcagtagtacaactgaaagctgctcagaccagagaagcatcaccagcagctgtctgtcatcacccttctgactcagatttgaacctagtatgtcggaatgacttactgcttttaagtcagctgggagggtgtgttttcttgattcagtaccttgaagaagccacaaaacagaattatgtatatcaggttcttttagtgctgttccatttgccaagaacaatagcattagtgtcttggcattaatctgactcgctaacctcactgaggtgtgacagtgagcaccctaaagcaggctttgaagtgggctaggaggcttattattcccagaagccacttttaagggaggttctgtcctaaatgatgccttccccaggactacttatgtggaatgccatgaaggtaacatataaagaacaagataaaggggcagaatattttatcccaccatctattctgaatctttaccatttcttgaatccccctaaaactatgaacagggattgttgaaaagaatccattactttaaagataaaagcaaagcaatcttttaccctgttggttgtttgtttatttttaaataaagtggtagtccttctaaagataattccagaaacattcttcctgtgggtcctctcctccttccatcagccctctcctcatctccacatgtgccctgcccttgttcttaccagttcagttcttctacctgtcatagctcccacttgatcctcagcctccccaaatactacctgtcctttaaacctaatgcattttccctcttcatgatgaagaggttttgcaccatcatagcacacaacaatttattctcatagtggtccactgttcattttggcactcataatctaatgtattcttatgctataacttacattgatatttaactttactatcattttaaaaacttttgaaccagagtgttcccaacagtgtgctacagaaaggaggaaggcagagtctctgtcctaaaggacaacatggaagaagggtgagacaccaaacatccagcctttccagcagtcagagtaattgacatgataaaggccatatggagacacacgccagatgctaatctagggacatagagaaaagctgcccagcagtgtgggcagaggtgtcagggaaagatttttggtgttattaaatacaagcttttaacatatcttgtgaagcatttcacagtatgtaccttttctcctttagcctatttctctctgctttaactttctccctacttgagccatgctaaaatgctgtgaactacattccattcttccctggaccatgttcttttgagactttgcacatcctccttctctgtctggaacattcttcccaccccatccatctagctaatcttccctaatctagctaatctagcaagtcttccctatccctccccaaattttctgggtgcttctctgaatctttgtacttatcctaacttagcacaaaccactatactgaaataaactctaatctctgcctgtctggctcaccattgtttatctaacacttggcacagtgccaacccatactcagtgaatacttatgcttttcttgctgaaaaactggattgaatggtgagcctcgaaagagcagtaggaatttcataagttagaaagccaacaaggaccttctggaaaaaaggaagaaaacatgtagtcacagaggtatgaagaaaacatggcttgtcctataacctgcaagtggaactggttggagcaagggcatggctggattctgaaggctgaggtggaaaaggcagtgaggggtcaaataatggagggatgtagatgtcttgctaagaactgtgggtcttataaggaaggcagtaaggaacccttcagtgattttgttttaaggctggggacacaataaattagatttgcattagaaaaaacactgtaagcttttatgtaaagcggggagaaaagagataaggcagaagccagttaagaggattcatagacctaggcaaaaaatctcaaaattctaaaccataggacagatagagagatttgaaagagatttaggagatggactcgacctaacttgatgaattgcacattgttggtaagacagaggtgattcctaagttttctgactagagagaatagttgacctgtgtatcctttaggaagcccaggactgcaggaggagaaggggaaggataatacaagacatgaataggttcagtttggacagcctcagtgtgatattcttgggaatacccagtcagatattgcaataaacaattggagatttggatctagagctcaaaagagaagtcagtattggaataaacttgcgggtgtcattaacatatggggataattggagccttaattatagatgtatagcaagaatgagtaaagagaagagcatctacgtctggaacttttggtacgttaaagaaaggaaggttgtgtgtttatcgctatgctctgtgcatagtaggtgctcaataaatacttgttgaatgagtaatgagaatgcagtgccattaagagcaatgaaggtctccagccctcactaacagtggactagaatgccattatcagatccagagaaaattccattcagttgccctttgaaagagaatttggaggatgctatgaccctgatttcctagttttgacctgctggaatgaggtaatgaaagatgcgttccttggttctgtttatatgctggattacatttattgatttgcatatgttgaaccaggcttgcatcccagggatgaagcccacttgatcatggtggataagctttttgatgtgctgctggattcggtttgccagtattttattgaggattttttgcatcgatgttcatcagggatgttggtctaaaattctctttttttgttgtgtctctgccaggctttggtgtcaggataatgctggcctcataaaatgagttagggaggattccttctttttctattgattcgagtagttttggaaggaatggtaccagctcctctttgtacctctggtagaattcggctgtgaatccatctggtcctggacgttttttggttggtaagccattaattattgcctcaatttcagagcctgttattggtctattcagagattcaacttcttcctggtttagtcttgggagggtgtatgtgtcgaggaatttatccatttcttctagactttctagtttatttgcgtagaggtgtttatagtattctctgatggtagtttgtatttctgtgggatcggtggtgatatcccctttatcattttttattgcgtctatttgattcttctctctttccttctttattagtcttgctagcggtctatcaattttgttgatcttttcaaaaaaccagctcctggattcactgattttttgaagggttttttgtgtctatttccttcagttctgctctgatcttagttatttcttgccttctgctagcttttgaatgtgtttgctcttgcttctctagttcttttaatcgtgatgttaggatgtcaattttagatcttttctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttgttttttttttacatttgctgaggagtgctttacttccaactatgtgatcagttttggaataggtgtggtgtggtgctgaaaataatgtatattctgttgatttggggtggagagttctgtagtatctattaggtccgcttggtgcagagttgagttcagttcctggatagcgttgttacctttctgtctcgttgatgtgtctaatgttgacagtggaatgtcccattattattgtgtggcagtctaagtctctttgtaggtctctaaggactgggtgctcctgtattgggtgcatatatatttaggatagttagctcttcttgttgaattgatccctttaccattatgtaatggccttctttgtctcttttgatctttgttggcttaaagtctgttttatcagagactaggattgcaacccctgcctttttttgtcagaaccaatgacaaaaaccgcatgattatctcaatagatgcagaaaaggcctttgacaaaattcgacaacacttcatgctaaaaactctcaataaattaggtattgatgggacgtatctcaaaataataagagctatctatgacaaacccacagccaatatcatactgaatgggcaaaaactagaagcatcccctttgaaaactggcacaagacagggatgctttctctcaccactcctattcaacatagtgttggaagttctggccagggcaatcaggcaggagaaggaaacaaagggtattcaattaggaaaagaggaagtcaaattgtccctgtttgcagatgacatgattgtatatctagaaaaccctatcatctcagcccaaaatctccttaagctgataagcaacttcagcaaagtctcaggatacaaaatgaatgtgcagaaatcacaagcattcttatacaccaataacaaacagagagccaaatcatgagtgaactcccattcacaattgcttcaaagagaataaaatacctaggaatccaacttacaagggacctgaaggacctcttcaaaccactgctcaatgaaatagaagaggatacaaacaaatggaagaacattccatgctcatgggtaggaagaatcagtatcgtgaaaatggccatactgcccaaggtaatttatagattcaatgctatccccatcaagctaccaatgactttcttcacagcattggaacaaactactttaaagttcatatggaaccaaaaaagagctcgcatttccaagtcaatactaagctaaaagaacaaagctggaggcatcaggctacctgacttcaaactatactacaaggctacagtaaccaaaacagcatggtactggtaccaaaacagagatatagaccaatggaacagaacagagccctcagaaataatgccacatatgtacaactatctgatctttgacaaacctgacaaaaacaagcaatggggaaaggattccctatttaataaatggtgctgggaaaactggctagccatatgtagaaagctgaaactggatcccttccttgcaccttatacaaaaattaattcaagatggattaaagagttaaatgttagacctaaaaccataaaaaccctagaagaaaacctaggcaacaccattcaggacataggcatgggcgaggacttcatgtgtaaaacaccaaaagcaatggcaacaaaagccaaaattgacaaatgggatctaattaaactaaagagtttctgcacagcaaaagaaactaccatcagagtgaacaggcaacctacagaatgggagaaaatttttacaatctacccatctgacaaagggctaatatccagaatctacaaagaacccaaacaaatttacaagaaaaaatcaaacaaccccatcaaaaagtgggtaaaggatatgaacagacacttctcaaaagaagacatttatgcagccaacagacacatgaaaaaatgctcatcatcactggccatcagagaaatgcaaatcaaagccacaatgagataccatctcacaccagttagaatggcaatcattaaaaagtcaggaaacaacaggtgctggagaggatgtggagaaataagaacacttttacactgttggtgggaccgtaaactagttcagccattgtggaagacagtgtggtgattcctcaaggatctagaattagaaataccatttgacccagccatcccattactgtgtatatacccaaaggattataaatcatgctgctataaagacacatgcacatgtatgtttattgtggcactattcacaatagcaaagacttggaaccaacccaaatgcccatcaatgatagactggattaagaaaatgcggcacatatacaccatggaatactatgcagccataaaaaaggatgagttcatgtcctttgtagggatatggatgaagctggacaccatcattctgatcaaactgtcacaaggacagaaaaccaaacactgcatgttctcataggtgagaattgaacaatgagaacacttggacacagggtggggaacatcacacactggggcctgttgtggggtggggggcaggggaagggatagcattaggagatatacctaatgttaaatgaagagttaatgggtgcagcacaccaacatggcacatgcatacatatgtaacaaacctgcacgttgtgcacgtgtaccctaaaacttaaagtgtaataaaaaaataaagtaaaataaaagaaagatgcattcctcaccagcacctgggctgtgattcactgttacccataatgtaagcttttgtcacggtgataaagtaattaacatttatctcttagacaaagtactttcagtattctggatagttgaacaatttattgtgacttttaggttttagtctccatttttgtcaattttttgtttgcaccttatatcactaaatggaaagtttcctaaatatttcaaaagtaagtttccttttttaaattatagatacttggttttctaatatatctaattaagatttgataaatgtgttaataaggtttttttaaaagcaatgtcaatttgccatagatttactctccctgattactgaagccttaaatttttgataccacagttatcttctctctaaatcatttccatgcctgttcttaataacttaatccagatgctctttttttcttatttgttcttttataaattgacagttgttcagaatgcaagaaaaagcaaatcatatgaatagtgctccagatacattttctgcaaagaaagtgttcattttaaaaaaatttaattgtcattttggaatgaagcaagctaatgagtatacaaacattcctaaattatccatttatttttttcctcttgaaacacacatttctgccaaaaaacttttttggaacataaaatgtacaagcaaaaggaaagtttactgaaatattttgtcttacatttcaaccctcttttccagtaatgtcaaccaggttatctgtgaattcttcagacaaaccaataatgcagttatcactggtcccagcgatgtgtgtttctggggaaaaatattaatcagctggagtcaataatcattccagggctttgatctggcatcacatataagtgagatgttaagctactaaggagtgaaaagtgaaaaaactgcttgtatgctgcccccactgtctcagggatggtgctcagagtatgttttcttatatttgtcctgtatcacaatcttgggaagtacatttttattatatatgtctacagatgcaaagacaggttcactaaaggttgcataacagttgtgcagcagagtggaattctcactgagctcaaaggccagggttcttttctctacgtgttgctgtgtcttgatattaccctcctagttaggagtgtattcaaaaatgacaattcaaggtttgacttccaagccaattgaaaaattggttaagcggtggctcactcctgtaatccttgcatcccaaaggaggccgaggcaggcaggtggatcacctgaggtcaggaatttgagaccagcctgaccaacatggtaaaacctcatctctactaaaaatacaaaaaattagctggatgtggtggggcatgcctgtaatcccagctactcaggaggctgaggcaagagaatcacttgaaccctggaggcagaggttgcagtgagcagagatcgggccattgcactccagcctgggtgacagagtgagactctgtctcaaaaaaaaaaaaaaagattctaggcctgcaaataatagttgaatttaggttaactgtagaggagaggaaagctctgggatgcataacattttagtctgagaaagaggaaactaaccatgagaactgaaagagggtacagtgcttaatatgctggagggtaactatagcatggagctaaagccataggagaagcagttttagctcttaaggtttgagcttcccttcagtaaacaatctgccttgaaataagtgagcctcctgccactgcaagtatctaagcagaacctcattgactatctgagaagaatgttttgaagaattcttgggtggaaggttatattaagtgacctcgtaggtcacttccacttgagttatatttctaagtgtgaaagcatgtgttctaaatcagatacaacaggtggggtctatctgctgaggtcaagccataccaattggcactaccaacacctgatgttacagaccagaatgatggaatgtttcaggtaagattggctttctggtgcttgccctaaatataagcatcttcatttgatttgcatagcaaagggagattcccatgctctctttttgagactatatgttttacaggacttaaggagaatattttaaacagttacttgcatgtctttcaggaccagggtagctatcctcttataattactcctagacacttcagagcaccttcttctgtttcctgtaattctttacccaatatcatttataaacttttttcctgtcattcatgtgctttcaccttccaaatattccctttctctctccctctttcttcattcctttctttgttcaaatcattattaatcactaattgacctttgaccaaaagtgttagacttaacaaaagggaggtagtttttaaaaaactggttgcagtagtaacaaatgccatccatggtcaatgctcatttattttctggcatcaacactgttccacaactaattgctgattagggagttggcatttatcctcaccaaaatatcatagttacagttgacattttttcactgctgatttttcttttgtcctgggtcttgtgtttccttttttttttttttttgagacagagtctggctctgtcgtccaggctggagtgcagtggcgtgatctcggctcactgcaagctccgcctctcgggttcacgccattctcctgcctcagcctcccaagtagctgggactacaggtgcctgccaccatgcccagctaatttttttttttttgtatttttagtagagacggggtttcaccgtgttagccaggatggtctcgatctcctgaccttgtgatccacccacctaagcctaccaaaatgctgggattataggcctgagccaccacacccgacctcgtcgaacttgcgaggttatttctgttttgtgccatataataattattttgatggaaattgtcattgtcctttttcttcccactctgacaggctgtgtttgatgtggacaagaagaaagggttgactctgattgagctctgggaaggcctgacagtggatgacgtacagaagagtactgggtgtgattttgcagtaagtatttctgtgaacaaatccagacacttgtcttatattataggcttgattaatgggtgtttgcaggacatgaaccattaatttgtgatcatttttggagttgacctttacagtgaacaggagtagaaggaagggtgcctctagatgagagcaggtgggaacagagctgtgctctgactcactggccaaggtttggcttaggactcagaagcaggaaggggacacaccaccaggagctgctagaaacaaggttgagcttgagctctaagctactttatgttttgaaggcccttgtaatcccctgttctttggttatatggcagctgtgcttgaacttgattaactgaaaaatgttagccacatatggagaaatgatacttccttatttttaaacccatctatgacttatgactttctctaaattctatgccatatttcatccgttgaaaatattaaaatgttgggcctctgacatcaccaggttagtcatcacaaaacagacatgccctgtatttgaagataagtacataaaacagacttacaaagcagataaatacgtcaggggagtatccgtttaagaaacctccaaatccctttttaaaacagaatattactgagaatataaataattgctctttaatataagtgcttattcataaatcaatcacctagctaatggcattgaaagcatggctcagtctatttgaagttaaccaaaagtaaaactaaaatgtctctgaagaaatgaaggaaagtgtattagtccattctcacagagctaacaaagacagcataagattgggtagtttatagagaaaaagaggtttgatggactcaggtccacatggctggggaggcctcacaatcatggcagaaggtgaaggagaagcaaaggcacgtcttatgtggcagcaagcaagagagtgtgtgcagggaaactgccctttataaaaccatcagatcaaagacttactcactatcacaagaacagcatgtgaaaaacccacccccatgattcagttacctcccaccaggtccctcccgtgacacaaggggattatgggagctccaaatcaagatgagatttgggtggggacacagccaaaccatatcagaaagggatattattctcatacctatttaagaaccaatctaattaaaatgaaatatatttataatgagaagaaaatatgttaatgttacagctacacatcttggagaaactaatttaacaaaagttatttgataagtcatacatatattgtatgtatgtctttcttgtgtactacatgctttgcttgtacctatcagtgcataacacattttttttttaagacggagtcttgttctgttgcccaggctggagtgcagtggcgcgatcttggctcattgcaagctccgcctcccaggttcacaccattctcctgcctcagcctccccagcagctgggactacaggcacatgccgccacgcccggctaattttttgtatttttagtagagatggggtttcaccgtgctagccaggatggtctcgatctcctgaccttgtgatctgcccgcctcggcctcccaaagtgctgggattacaggcgtgagccaccgtgcccggcctacacatttctctaaaaacgatttttgtttcatagttcattatccatataataactgttcctggtactctaccaaggtctttgtctattaactttttttgaatgtccctttggaaaaagaagtctcccagtaatacctttcatgaaaagcacatctttaattagcctttcaataacctcaaggggaaggatatgcttatactttaactatttaggatttctcactccagtgagaaaagcaaacaatctgtattatttttttctatgtggaagaattaacctcttcatcagataacattttcaagatccacagaatgttcagtttttttttgcagcaaaagagaatgtacaaaggaagacctggttatctagttctttttttattcatgtgggtaaataaggaatgaaaatatgagtttttactgttcttgctttgttttccaataaaaggtgctgttccaatggaaaatatctctgtagaccctctcaatttcagtaccatctcttcttttcacagggatatgtaatcttgttttctccaaattaggatgttgagatgaaatgttaatttgtatgtcaatgttgtcctgagaatgaaaaggtatggtatcaatggaaccatccagaggactagcttttgagcatctgacgatcaatggcatctctttacactctgacagatgaaatcacatataacaggttgttttctgtaaggctagagctggagtgccctaattaataaaatgttctacttaatacctggattatcaataaggatacatttaattacaaaagtacattgaagatagcatttctttcttgacaattcagaagacattccatgtcctaatttagaaaatattccctgtggttatcactgcatagctagcattgtactccatatgtgactatacactagttgctcaagttctgtttgagaaaagtccctagaactcagccttcaactggcagtcaacattctagaagggaatgattggccagtgttgcctcataaagaaaaaaaggtaaaatcctagtgcaaaacaatttaaaatgtgttggtaaaagtcctgtatccctaaggatatgggcaagtgaatgggcaaaagctacattatgtggatattagctggttgggaaaatactgggaattccaaagtaaaagactaaatatgacagcatcagataacaggacgtgacaaaattttggttttaggatatcaaaaaagaatgatagtgaaatatttgggcactgttaaaaaaaagaattactaagactttttcatatatatcatagtgttattagccataataaaaaagtggaaaaaatatgatttttaatcacatgaaacataactttaaaaaacctgtaatgactgtcacagttttgttcatgattttgtatcaactgaaagttggagttttccatcggagggcagtatcttgaaggtcatatatgtctggaacttggtagaggctgtggaaattttgttgtagaaatgcaaatattgattatatttctggaacctgaaggttcacacacccaaaataagattctggtcaggagctgtttacagctagagaagccaaccatatgattactctcccttaaaatgtagatgctatgacgatagggactttgctgtttcttggggattgagtgctgaatcccttgagagaaaggagctgaacaggtagaggtaaaagtattactattatacaggctagagtgagggatgtggcctaggtgtacagccacagcaggcttttcagttgtgaaccccacagatacagaggctttggctccccagtgtaggcagcaccagagaaacccaggcctcccacaagggtagccttcattgctgagcttccatccacatggctgagagcaaaacagagcattgctttctaggtgaagacctcaatgaagaggaagagtcatgctgagtttcacatgttaaggttcctctgcccaaataatcatttaattacatcaataagggacacaccggaggtcagggtagttacatgaatagataggtgtccttccacatggaatggaatatgagaagtggggaataaaggctcccctgtccccagcgctattggtagagccttgtatgtatgttcatgctctacaaatgcttgtgatgctgttcagtaatgctttcctatttttaaataactggtaaaaactttaaaaaaatttaccatcttaaccatgtttaagtgtacaatgcagtaatattaagtgtattcacattgttatacaacagatctctagaacttttataacttgcagctctgaaactactcattaaacactaattccacagcctttggcaaccactgtttttgctttctgtttctatcattttgactattctagatacctcatatgagtggagttatacagtatttgcccttttgtgactggcttattttgcttagcataatgtattcagggttcatctgtgttgtagcatgtatgacaggattatcttctttttaaggctgtataatatttcattgtgcatatataccacactttcatgacccactcatctgttggtagacatttgggttgcttccaccacttggctactgtgaatagtgctgcaaagaacatggatgtgcaaatatctctttgacattctgctttgaaattttttagatatataattcagaatttggattgctggatcatatgataattctatttttaattttttgtggaactgccatactgtttcacaatgtttgccccgttttacattcccactgttggtgcacaggggttctaatttctccatatctttgccaacagttatcttctgtttaatagtggccattctaatggctgtgaggtgatatctcattgtggttttgatttgcatttatctggtgatgttctcaaagtttctcatatattctggatgctaatctcttatcagatgatttttgaatgttcttttccatttcataggttgctttttcactgttttctttgacacatggaagtttttaagttcgatatagtcttctgtctgtcttttatgctactagggcccaacattttcacaactaaggaatcctttggcttatttttctcccattgtcctcagattttgaaagaagtctgtctctcaaatatttaaagaatcaaaatgatgtcgtattaaagcttgacaagctaatgagtatgtcaaatttctttattttttggctatacttaacagcatgcagtatgccagttacttgatgggcgaaagtattaggttgatgcaaaagtaattgtggtttaataaatggttttgccattgaaaataacggctttcaattggttatttgggttgtttcttttctgatgaatgcttaagctatgtaaaataggtgtttttataaaccatatgtctgtggacctcttttgaaacaatatttctttgattttatcttcttaacttaaaaaattaaaaatgtattccatatttaaacattatgtgttagaataaacttccagatgtcactagtcatacacccaatgtatgttccatattgagctgtaaaatatgaataaaatagaaccaatttatggttcttgctcccaagagccttggctttattctccaggcaggaatatacctaaaccaccagtggcaaaacaaacaaacaaataaaaaactagtaaaagcaatgtttgttgatatgtttgcagtggaatctgaaagaagctgcagacattccttgcctaattgaataaatttatactctcagtatctactatgaactggcattctaccagagtcaagcaatatacttttgggatattaatgcactgggaagacaaatcattggcttgtcttctatagctaaatcatgtcaccttgtgcttagcctgcagatcacgttggcagaataagctcctttggcttgcatgaatttacaacgttgatgagactgggagaacagaatgagaaatggtggtttagtagatgtttttcattaaaaagcaggcaaagtcagtctatataaagcgttatcttatttttgatgtcatttttcacattgagaatgtaaatgacattaagagctcaaaatagggctgacatgacaaggaaaaggatcagatgtttagttaaaaaaattaatgtgtccagtttctttttaaaggaagtgctatgaagcatctatagaaaatgatttgtagtaaaaaagtttcactaaattgggccaggcacggtggcttacgcctgtaatcccagcactttgggaggctgaggcaggtggatcacctgaggtcgggagttcaagaccagccttaccaacatggagaaaccccgtctctactaaatatacaaaaattagctggtcatggtggcacatgcctgtaatcccagctacttgggaggctaaggcaggagaatcgcttgaacccaggaggcggaggttgcggtgagccaagatcgcgccattgcactccagcctgggcaacaagagcaaaactccgtctcaaaaaaaaaaaaaaaaaaagtttcactaaattatttccacagatgctctgttgtttaaaaaaaagaaagaaaatgaactgtgagatatacttatctaaatactaaatgttattattagtagagttgaaaatctgtgcgtatgtgtgatgttactttttgtctacttattctgtttattttgtctgtatgtctactcttagaaataagtcataatgcgttctcatttaccataagctatataccaaatcatgctgaactttattattattgtttattcttatttattcttttagtagacatttttgccattctggtttaatattttagtacaaaaatggaagacaagacattaactcttgatactatgaagagttaattgtgaagagctaatgcagacatttataaatgaactaaaactatttaaccttatgaaagccaaatgactgcctgttctttcagtttttaatactgatgatttaacctctattaggaacctcccttctagttctttgaaacttatataattatctacttattcattcatttgttcatttatcaatttaagaaaatattgtttattctggaaggtaaaatgctaattgggctcattttgattgccacatctttcagaatttcaaaaagcacccaatttttggtatttcctgcttcccatggggactgttactaactagaacccaatcaatatttgccatgttgaattaaggaatctgaacctggtaccacactttgaaaaatctgtctcagttaaactgaccacttatatttatggttctcctgcaaccggctctaccttaaatatacattcattgtcacttttctctgcttgcagattcgcaggaaagcattgactgttttatacactgaacataattataatcaacatttaattgttttaatgctattacttccatattttaataacttggaatcctcttattgcctttgtatcatttctattctgattatgaaatttccgataagatttatcattgatcatacgtctcttcattaatatgtatttaggtaatccaaagattacataaagcatctttcaacaaaattatgaattggctggatctattttgaggttttggagacttggggtttgtactgcgtcttaagtgaagtctcagaggcatcagtctcggagatcagtgatccatctgacagggggcttggttattgggatcctttgttttcctctgctcctcttccacctgctccttgttgccagccttgttcatccttaatttaggagctaatacaagaaggttgagaactacaaaatacccaaaatgtaaacagaactgttctgtctcaatgtttcaggatggaaaatcatatggaaactccagggaatgtccatggcaaggctgcttgttgcctacatgattgaaatttggaaattaaaaggagagagatttatatcatgcagtttttcataatttgatttttttttcctcttttaccaggtttcaccaaaactcatgccaatgcagcagatcgcaaattgaaatatggatatttgtaccaggctgcgtgtttttcattttaaacacacaagatttaattgaaaggacatcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattattagtcctgaaagaaagataacatatgtgatttttgtggttaggagagttgctgtcatgattgttttttcttcagcctcctctgacttttcttttggggcttcagattttatgattacatcttgtccccctagaacatcccccttcctcccatactgcttttaaacagatgcccaagaaggcaagcaggaatgcctcttgtgggggagggcagggagaaataactagttcaaaccaactatctatctatgctttgcaaagactaaggcgtattataggaagagggctagaaacctaactgattcttctcagttttctcattttaaaacagcccagtattcctttgtatcctcaagggtccttgagaatacttctgttattgagaccctgtgggctacttgtactgtacctcctctcaagccaagaagggctgtgggataatttaccatgaatccttagtagcaatgacagcagagttaaaaaataaaaggtgttttactttcaggctcttgttttggttcagaggagattttaaatattgaatgacacttctacagaacaacggtttttcttctgccaaggctacttcctttaacgaagtgcctttaattcagccttatccaactagggaaaataatgttggacaagtctaggatttgaagagtcagtgaacttttagtgtcagggaataaacatggtgggtagattaggtttgaaaaaaacttccttagaggtatttattctcaatacctgacaggggcccatgggaatgacttcagaagcatcccggataatagatgggtaaaaagtctaggcaccctgaagaacaggtgagacagctggcctctggacagaggtaggcatagtacagtacgatatatcattcctctggtcctaaatatacaaacttattcatgtttttaggtgatgatggtcattgaaactcacttcttttcaggtgtagctacaattgtgtaatgtacaatattagagaaaggacaggctttttatgagtaacacacaccatatataaaacagcctttctggctgaccacatggttaaatgcataccttcccagtactggggggaaaaaatgacccttcttagaatgtgcaagttccatgagagtaatatattgatatgattttgaaaagaattgttgatagttacatcttcaaacttatcattccagtatgcatctttaagataatgtgattctaagtagatgactttatattcttgattaaagagtgctatacatgttaagaaatgcattaaggaatacaataaatattctaaagtgatgtagatcagtgtgactgtcctttatttcacttgggaatggcattgctaaatgtgggaataatgcaacagattgtcagggtagctaacaataaagtcagcacacatcaccacttcttttttttttccttttttttaaattatactttaagttctagggtacatgtgcacaatgtgcaagtttgttacatatgtatacatgtgccatgttggtgtgccaacatgctaatggtgtgccattaactcgtcatttacattaggtatatcttctaatgctatccctccccccttcccccaccccatgacaggccccggtgtgtgatgttccccttcctgtgtccaagggttctcattgttcagttcccacctatgagtgagaacgtgcggtgtttggttgtttgtccttgcaatagtttgctgagaatgacggtttccagcttcatccatgtccctacaaaggacataaactcatccttttttatggctgcatagtattccatggtgtatatgtgccacattttcttgatccagtctatcattgatggacatttgggttggttccaagtctttgctattgtgaatagtgccacaataaacatacgcacatcaccacttctagtcaagttgttgcttttctttttatcttaccagagaaaagatattgttcttctagaaagatcaagtgaacattgagtttcacaacttgctccttgtcagaggctgctatgtttacaaaaatcatttatccaaggcttcatgtgtgaatccttgttcactttttgtgtaacattttcctttactgtacacattagttgcctggtgctgtgagtttatttccattttgaagtggctctagtggtagtctgctcagcatctgttttgctgctcctctggtaacaaaggggtgggcacgtccccaggatttgctacttccggtagctgtccttggtcgacagtggttatacccagagttgtgcatatgaccaaggatgtaccagtttatttctccaacatttaaaaaacagatgagaagtcaactttcttactcctctcgggctatgaagccataagaatgtgaatctgacaccaataccccacatgtctgctacacacatgcacatacctagctgagctccagctggagagaaagaaactgatacacaaaacatggagctgtataggaagtatgtcagtgggggcattctggtggtatttggatagatggttctggaagtgcctaaggccaacttccctccagccgtgcctggatagagttcataaatctttttgcttgagcagagtttttgtcacctgtaagcacagtgaaatcatacagctttggtaattctttttcgccacggtgtctcactctgtcacctaggttggagtgcagtggcacaatcacggctcactgcagccttagcctcctgggctcaagtgattcttccactttagcttcctgagtacctgagactataggtatgcactaccacacttgactaatttattttttgtagaaacggagtgtcactatgctgcccacgcttgcctggaactcctggcctcaagtgatcttcctgcctcagtcacccatagtgctgggattacaggcatgacccaacatgcatgccataattcttgagttctgagagggacctggtctcctagagaagttatgcagaatatgagcaaaactgctcgtacctagtcccagagaacacaagagcatttctgggtatttacagtgagtagggaggttatgagtagaagttcattctcttccaatctcagtatattcagcaaaagtttgggatgttatttcaatggaagtataagcaaaaatttaatcaataaatgggtttctttggcactgacttccttttctcagggtgtgatcttgagtttcttaagcttatttttagatcctccatctttaaaataggggagaatacactgttttccactgtggttctataagatgtaattaaaatatctggctgtaaa

SEQ ID NO: 16067 - DNA, 50217 bp, Human
  misc_feature (1)...(50217): n = A,T,C or G
ttttttttttgagacagggtatggctctgttacccagactggagtgtagtggcacgaccatagctcagtgtaatcttggctcctaggctcaagcgatcctcctgcctcagcctctgtagtagctaggactgcaggcacacaccaccacgcccggctaattgtatttttttattattttgtagagacaaggtctctctatgttgcccaggctggtttcgaactcctggcctcaagcaatcccccttccaaagttctgggattataagcacgagccatcatgcctggcctactgatttcttactgagaaaactgattccacaaaaatcatagactattacaaactgttgtttgaaattgtatcagtaagaataaaacattccactcttgcttggaggacctaagacacagagaagcagtcttgacttccaagccaggtgaaggaaaaaggggtttctgaagacaacacttcccatctatcttaactgtagtattcacggaaacagaacctggggtccatggtggtccagacctgatgttaatgcctttatttgcagctctgctttgcctggggcctctcaaaaacactgcttcatttaaatgtcatcagaactccacacctcccagaaagccctgggttaatttcatccattcctttgtttggtgagatgttccaaggttccttgagcgtgagctcttcttcaaggcagtggattaataaacctgaatctgttgaactctgaatttgtttctgtaggtattaggatgattgggtgagcacaggtagccctggaggttttcatagttcagtccttcattttacaaacaaaaattggggacgagggggaggagttgttactgcagttcttctgcagcacctcagagccacttcctcagagccacttccccgtggaattttatggtactcatcttctaaaactagaaggcaaagtcaactatggagtggtcttccttggatatgaaatgaacaaatttacctaggccttttataaagaccatctttaggctccaggtcagtcattcctccagcactgggattgatgggttccgtatgttcattgcagggaaagtggcgggaattcgctgaacttcgtgggggcggcgagggtgcgggctggatgcaaggtactgggccgctggagtgacagagatgctgtgtgatgggggctgagggctcttccccctcctcaccctactgttccacatttcttcagcaactttcttcattccttaggaaaattttcctttttctttcttattcctgtttccccacatcccactctctcaggaaagagctacccttcattgaaatcttacttttttctggcaacgcgctctaaaaagatgggccaggaatgattccctccacccccagacaaaaatgaaagcaacacttccttttaggaatatagtactttctgtttttaattttaaagctagtcaagtgacacagtgcgagtggagaagaaacaaatctctggctgtgatcaattagctgcaaacaccaccgcaacgggaccagcctagtgatttatttaaacaaacgacattaagtagttaaagcaaaccccttctccctcaaagaaaagaaagctaagtgcgtctgccttagctctggggaattcttcggcggcttgggatggcgggtgggagctgccgccctgcctccccaggaacttctgcgacaggggcagtgcagtaaaatttgaatctgcgaccccgggccaggagtggtggtggaaacagcagcccggccgccgcggcagggtgcgagcgcgcgcaccgattggtcgccgggccgcctggcccactgcgcctgcgcagtcctcctcccgcaccgccctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcggtgagtgacccccgccggcatccctcctcccgcttcttcgggccggcctgtgcggggagtttagggaagtggcagggtgcagaattgaaagggagcggcggtgtccccagccctccccggcggggtttgccggttcagataacccagtggagggagactgcgcagcctcgcgtgcgttcctggatcgcccccaccccagtcttcggcgccgggagacgggaagcgcccagcctcagccctggacactcccccacctggggcaatggaggaacgtccgggcagcaagttcagtgcacgtttgtctgcgtgtgtgtgtgtgtgtgtgtgtgcaattacggatactgttggtgttttggattaaccccaaatttgccattcagaaaatatgtaatgctaatataaagttcggctggtgacattgagctctgagataagccgtagtgtactttagtaaagatgcttagttttatggaaacataaccagtccttgaaccgtattgtttccctctgggagaaggaaaaagcaccaaaaagaggtacaaatattatctatacctccaactttcacccaccactttttgagtgatgaaagacttttcatgttaacaactacaaatggcaaatcgatgattgtagaaagaaatagttgagcttttttttttttgaaacaggatgatcagttttgtttaatctagcagacctagccgactttggttgggtcagataagtgctccgaaagacaaatcgcattcttgctaggttttatgggataacagcctaggaaaaagtattaactttttgtttttgtatcagacagaaagtgttataaaaacaaacttataaaaaagataaaaattgaccagtattagattcatacttctgcagttaaggtctatcttgaagaaaattgttgtttggtaatcccaagaatagtgagatactgtttttttgtaatgaaaaacataactagagttgagtgatcattatcagtgagaccagaatgtgagggtttttaaaggtctgatctctggcattgaaaggtgtgagaaaatagcactcctagttgaaggagattaaaaattaattgtaaagtatggcatacgaaacagtgactaaattatgttgctctttgttggtaatgctatgtagtagaactaactttctacattgttaccatggtatgaaattttaatatgttaatttttcctctaatgtcattctatagttaatactgtattggggctatttaatttggaaatagggcagaggtcacaggagatgggacatggatgattgaaagcattgacactgaagacagactaaagttctttagggttttgatgtgaaagtttctccaaagttcagctccaaaaaatgaattgtcttagctccttggtaggcctttggcaaacaagtcattaggccactaacaattgccaactattactgtgtaaagactgtcaggcgagttctttgttaacaagtccactagaaaaactcgtgtgtaaatgacatcatagcccggcagaggcggagtagttaagcccagtaatccttttcctttgggatggtatattttacatatagtcaggaggcttgcaaggcctggattagttgtcaaacttgaggctattagtttcttaagagtttttgtggtttacagtactcagcttctgcagtggttggcacatcaaacctatttttccgtttacacttgttttaagaatgtcttatttcttcagattttgtgtttacacagatctgtagttatcactatgattctttttgttggaatgctaaaatttaggattcataaaatgtactaagattagaaggtaaactttgatgaggcacaaatacgacatgaactatgaagaaagaactaaaggaaaatgaacaaaggaaacatacatttattctaggtttccattgggaaaaagttgcttataagttccgtttcaaaatttcagtactctatataaatggtaatattaggaataatggatacattgttggtttgtgaatccgtaatgaacagttaacctttaggtaagctgataagcattttagttgttttttggttggttggttgtttttttgagatttttttttttttttgagatatttttgagttttgctcttgttgcccaggctggagtgcagtggggtgatcttggcacactgcaacctccgcctcccgggttcaaacgattctcctgcctcagccgccccagtagctgggattacaggcacgcgctaccacgcccagctaatttttgtatttttagtagagatgggtttcaccatgttggctagggcggtctcgaactcctgacctaaggtgatccacctgtcttggcctcccaaagtgctgggatcacaggcatgagccaccacgcctggcctggttttttttttttttttttaacgtgtaagcaaaaatacattacaactgaataacatagccttaaaaaatgaaaggcaacatgttttggttcattgttttcagaaactagtttcttgcatatagtaacgacattaattattgaggtctcatatttttgttcagttttttaaatgaattatttcattttgtaaaaggttataagagcagccaggaggagcggaattggaaaatctgtgggtaaaatcttctcggtttggttttttcattttactggttcctaatcctgattcataatgaacagtttaggagagaattgctgcaatgcagcatttaaaactaaatttttaaaaacatgatttaagaacattttgtatacaatcttctatttagatcaaaattgaaagaatattgtagtttatgatgttagaagcataatcagtgctcatggagaaagtaatttttaaggattctgattttcttataacttgagtttttaatactttgtctaaacttttttcctgctactcatgtaatcagtgattttaatatgacaccatggcaggcaaatctttcatagtgtttctgtgtatgctgtacagcctttaatacagaatttatttttaattaagtgcttggtgaagtgctataaatgtaacatcgaatgaaatgaattattttatgaaagtctttaagcgatatacatataaactatttgctttaaattagagaacttgttaccgcaaagcaaggaggacagggaaacagtttatgtctttgaaatgagcttgctggaaacaccagaaaaaaatcagtagaaaaaattaggagcttgctaaaaacaccaggaagaaaaatcaataaaaaaattacatctatctatttatgaatcatgaaagtagaatatggttatttgcatcattaagtatctttacaaatcattattccttatatggtacaccgtaaaggctgccaaaaacaagctgtggtagttccgagaaattagaagagaataaaactaattagataatcttgcccagttccttgcctaagcaaaacaacattctcgcttttcaagtgaatgatttggtgtttgaaccttcttgattaccttaagagggaaaaatgaaggagaggagggaaccatcatcacatacctttacagttgtggaatgttagcccactatagtgtttaactaaggaaaatctaatataatacactcccaagtgatctgaaatgatccgctattcagaattccagagaaagacatatccctgccagaagggtgtccttcataaccaaatttggtcttcagtctggtcggtgcatactcaaacaggaatcacttcccttaaggaacctaaggtatgcagttgagatcaacttattcctttttgatttgtccccttaaagcatcaatcagacgtgaatgcatcttgtgacttggagttactagtaatattgaaatctgaaacttgggggatctttgaagacacatgggattaaaagctgcataatgtacatttcgaggctaaaaaccaggtttgaaaaatacagatgtccagatgagtttttctttaatttatttgaaaaatagagatatgccttaattatagaccattagaaataatttttgtgtttcacagagtcttgattttcattccaggaagccagagtcagtaatttatggctagatctttaattaaaacatttgccttacttagtattacaaaatcatcatttggttttgcaatcaagataagactgttttgtcaacttaatgctaagcacttaatttttatttaacaataacttctagaaagataatcactccagtctcaattatttttatgtttgtgtgttaccttttaatagttgccatttatattattttagtaaggttgtagtggtagtttatatatttgcttggagttgataactagagtaagcagcttcataaagtacttctgaaggcaggctttactattaaaactgtttactattatgaagctgtttacattatttctggcatatctcttggtaaatggtttaggggcactattttctattgatgtaaaaattgaggccaggcatggtggatcacgcctgtaatcccagcactttgggaggctgaggcaggtggatcactggaggtcaggagtttgagaccagcctggccaacatggcaaaacctcatctctactaaaaatacaaaaattagccaggcgtggtggcacatgcctgtggtcccagctactcaggagtatatttgtagatacatataaaattctcttgacattacttgatcacttatattagatccaagtgtataacttaacttagtattcaggtttttatctggccttatcctctattactctttgaaccctacagtctgtactaattatttctaaaattgtgttactcatctacaatatctcatatctttatagtcactaaatgaatgtctgctggataaatgagggaaaattactttctttttgcatagaaaaaactattagtatggtttgtttttgggtggcgattgttattttgattgtacttaacgtttgttttcagaattgttcaccatgaatatatcttgtgtcagcagtaaaataatagatttcttttagtcacacctgtagaattgaatgttaattgtttcagtagcatctgagaaaaggatacgttcacatatgtcacaactaaagaataatcagacatcgatgcctattttaaattgatgccaaagtgagatcagcttcttgtatctgtcagtaatgctttcagctttagaggaaaaaccaacagctaatagtggcttaaataaataagaggatgtttttctcacataacaaaaagcctggatataggcccttcacggttcctcactctgttatactttgtcgtccttagctgttgcttttcatcatcctgtttgtcgtatttgcaagatggatgctacagctccaggcattcattccaggaaggagaaagggcagttttagctgagatggtcctttttatcaggataacaacacccttctcagagacctcgaacagaccgccacttcatattattcagagcttggtcatgtgactactagttgcagggagactaggctaacaggtatttggctttccggcctatttattgggaggtagcaagggaaaggggaattgggaatggctttaggagtgtctggttcattgttacttttatttcagactttgaagtggggatgtggagggtagtaggtctttttcagctaagacttaggaagtgttttctaatgttaagggctttttctggggtcatgattgttttgtgttttagggcccaacttccttcctttcctttaggagaaactagagagcaggcagatacttgcaaatacctagaaccccttgcctcttatttttggatacctactctttctcctagattattaaaattgttcctgcaagcatttaaactacctcaggtcttacaagtcttaaaaaaaaaataactttcttagacatacagcagattttctgcaccacttggttacctcccattctttttcaatccattccaatctgacctttgtcattgagtactttttagttttgtcttggcctcacaactgtatttgacataatcactccctccttgaaaattattattttttgacttgcatggacaccactgattttttttttttgttcaatacccctggctccttctcagactatattagtggttctctgagagtggtccatggagtccccagtatcatttctggggtccagaagatcaaagctgttttcagaataagatgatgtctttttaaccgttttgatatttgcatttgatccttgctccttgtacttcaacttaacaacttccattggtttcttgaatgctacactgttctttctgccttaggatctttaagtatcctcccagtgcctagactactttcctacacgaaacctttttcacccttcatgactaatactggggagagtgatgatgagttagttgctgcgtatttttcagttcttaaatattctttctccaagggtgtttccctgatattctgctttcccgtagacttaggttctcctcctatattctctcattgcactttcatagcactcaattgcatgagtcagaattctggtcacttaattttttaatgtctgccccactattatttatgctccactaaagcagagagggaatctcttggttatcattctagcatgtcatctcacattccataagtatttgttaaatgaaagaatggttgaaaagctgttgcaggacaggcatggtggttcacacctgtaatccgagcacttggggaggctgaggcaggaggatctcttgagcccagaagttcaagacaagcctgggcaacatagcatggtggcacatgcctctagtcccagctgctcaggaggctaaggtgggaggatttcttgagcccaggaggttgaggctgcagtaagcagtgattgtgccactgcactccagcctgggtgacagaaccgagaccctgtctcaaaaataaataaataggtatttaaaaaaataaaaatcactcagcaatatttggctgccatagtagtgctaattataattactgggaattataattgtaattactgggccctgggaatgcagcaaagactaaagaccattcttgttttcctggagtttattctaatggatttgtgcatggtgatcccttctacttcaaagattcaatgataccaaattatgcatactaggtatactattttgaggattaaatatattatatgatggcatctgtaaaggttagaaatgttcatttacctttaatttgtatagttgaaacacttttttgtttttcagtccaagccttatgcatttgatcgggtgttccagtcaagcacatctcaagagcaagtgtataatgactgtgcaaagaagattgttaaaggtaaatatattcaacctgctgagttgtctcagcaataagtaaataagtttgtgatcttttctacttactcagcttccttttttcattttaatgcccctttcttctaagttaattgcagaagaaagttgtttaaataataaaaaggtcaaacacaattagtaaatattctattgctcaaattccatgatctaattatatacagtacctaattaaggttattatgagaactatgttacacacttattcttaagagatgcatttctgttagatattcccaggagagtttccaaggtggcagttctagaaagagaacagtatgagaatgaaaacaaaagggctagacacatttctaaaaagtagtggaaaatggcagtctatcattcttccattccattgttattccttccccaaagacttacctatcccttgaggaatttaacaagggttgccaagggtgagaaaagtatgtacattccagttaatactataacttatacaagaatatttataactttatatattctaaaaccattgaattttaaagctgagagagtgctcattgtttatctggagttacttccagttactgtagaaatctgtttaatcaaaggaatggctgttactttgtgatatgatttatttcattttttgacagctgtagttgttacaaagtgcttcttagattgaggcaaaatctgtgttgtggcattcaccacattaaaagaattgggattcagtataaaaataggtggattaggatagcataggagcacagatgctcatcctagtaacaggagataaagtggagttatagaaggtttatagatgaggtgagggagggaaaatgtgtatgtactcattatatcaatttcatattgtctaatacagggagcaaagtcatcatggagatgaggaagggggaagaggttctaggaaaaggcatgaaatggatggattcaggcagtgtgagagtattgccaggcagtattaagggcccactcaaggttagctgctgaaagagttgaatttttgcccatttggagttttgctaggtgagtacaaaagagggaagtgggggacaagagaattgaggatatagtcaaaggagtgattataatggtggaccatgggatctaaggtggttaagttacaggaagaaggatatgagggaggctgaagggcagtgaaaaaaggtggtaacattagtgggttgtagatctcagtggggtcaaagatttgttggaatcagggtactggacggagtaatagaaggtgaatacagacagtccctgacttagaacaacttaaaattgttcgactttacgatggtgcaaaagcaatacacattcaatagaaatattcaatagaaatatttctagtacctgtacaaccattctgtttttcactttcagtatagtattcaataaatcatatgaaatatttaacactttattataaaataggctttgtgttagatggttttgctgaactgtagatcagtgtacgtgttctgagcacatttaaagtaggctaggctaagtaagccatggtgtttggtaggttagatgtgtttgatgcattttcagcttagggtattttcaacttacagaacatttatcaggaagtaaccccatcgtaagttgattagtatctctacttgaaattgagattatggaagcaatgcagttagtaatgaaaaggtaaaggtgttgtcatggagttgacttccgaggtagtaaagaaaggataaggccagacatggtgggtcacacctgtaattccagcactttgggaggctgaggtgggaggattgcttgaggccaggagtttgagaccagcctgggcaacagcgagaccccatctctgtttttaaaataaaaatgaagaaagaataagatcgcagaaaatttggtcaaggagctgagaggccaggttattttagtgggattatctgctacagactttgaaaccaccagtactgttttattacaacagtaatggtattggtgagagagagtgaactgggtactgacatcttcataaaatgaaggggaattaacacttgtaattgtgtaaatgactgcaacaaagaggaacagggtcatcatgttgtaagcatcatgtggttttccagagggatcgatcatagaacacaattttactacattctttgattgagacatacttctgtctcatcagtacagtttaagattacattagctttctaaccaatagaaagttaccgattcatgaattcatgggcaatttgaatatacaggtcttttttgtatctcttgccgccagctttaagccccattccatacttgcactttggagagcaaacctttaaagtgcagattccattttgttcattttagctcttaatcatattttgagttttatactggggatctagtaagttggctgtcagcacatttgataagtctattaaagtgtcaaaggttttgaagtttgaaaaatatgattctaaaccatttataaagtgcttaatgggtcatggtccctaggttaatcttctaaaatgaataagattgttggcagttatttcaatcacactgtttgggtattcagccaacttcagagcctcttacctatacgattggctagtccttagtttgtcaacatactcacaagaaaatgatgaaaaacttgaatccttttatcaagtgatggtgcatgactctagtatttgcccaaagtaccagttgaataaccatatccaaacaggaaatgaggttagttcaaccatagtctttacttaataaaattttggtatacttatttccataatctatcccttttcccattttgaaaatgtaaataacattagtgtcttctattacctttgttctctttggcttttaaaagtaacctacagtagctgtgagatttttatccctggaacgtaatcctccttagtaactagaaacttgggctcatttgaagccattcttttgctatcgtactatccacataaaccttaaagtccctttcaacaatgtttattctgttgttctgttttgaggatcatatttgtggaagatggtagtaaatagaagtacctctgttttaatatcatcagttaatattttctggtctttcctaagcaatgcaggttcattcattcattattttttttctgaatatgactttaaaagttctttttagggccttagtttttattttgttttggtcttaaagttacttatcctggacttttatctttctcatgctgttctcgtgagttctgtctcttctcttgtatatccttagttacacagtctcttaataataggctgatactcagagtttttcaaaatctattgttttttaagtggtacctaaccttaaggaaaagaaaaagatgaagtctgttttcctgacgtttaggatacatgcatctattacttttgttctgttttattactatttgcagttctaagatgaaatcgtttgcttcctgaaatttctcttcttttctcaaaatttcagtcccttcttcatcctgctttactgtttggaactgcgttcaggataatagttcccttctctgtaatatggtaagagtataatctttagaatcagacagtcctagattgaattctaggctctgccactttcttgctgtgtgacttttggcaagttacctaacctttccaagcctccatttcttcttgtgcaaaataggtactaggagttgttaagcacaatacaggtatcagctgctaattgtgtcctctgtcgttgtcttctttttttttttttaaattgagacggagtttcgctcttgttgtccaggctggactgcagtggcgccatcttggctcactgtaacctacctccgcctcccgggttcaagcaattctcctgcctcagcctcctgagtagctgggattacgggcatgcgccaccacaccctgctaatttttgtgttactagtagagacagggttcctccatgttggtcaggctggtcttgaactgccaacctcaggtgatccgcccaccttggcctcccaaagtgctgggatcacaggcgtgagccaccacgcccggcatgtgtcctctgtcttcttagaggacattattaattcaatcagtcgtgtttgtatttgggataaactcatagtctcagctatttctactgtacaaaattagacttccagcaagtgttagaatacaaggtttctatcataatctctttcttcttctatgcaacctttgtaatttatgtcagtatcacctggcgatgatttccttttatctttacccaagtgctctgtaccattttggaggagactgcatgtagtagctggtgggacttgtcctggacaaggatatgaatgtggcagagttaccaataaatacacatatttaaggagaaagatggcgtaggggtaggtcgtgggtacctagggaggtgtgaggacaggaaagcaattaaatacatggtaggttgtacttgggacaatcattgttaaacagattggatgagaagccatggttagaaattgttggtaggcaaagatcagcagaatgatgggccagctgggatttcttttgagatagggatttgatgagcaagttgccagtaatgacctgaaagcagatagtactctctgggtccccgacaagttcactgagaatgcactggctcataattatctggacaagtttataacttgattttatgtagggctattaacattccctatctgtagatttgttagatacaattgttacttttgaataaggtttatccacttgtattctcttgaattctgaatctgagtgatttgtttcccttgtgttaagtagctatttattcattgcccactatatgataagcatctcatcaggtctttgtagatttcctgttttttccaccatggcttcctgacctgaactctctgccgctgtattcacctttggtttttccagatgtagcctaccttgtatttattttggttcctctgctccttgagtatatagtacagtggttaagagcaggtctctggaaccaagtctatttgcatttgcgtctcagcttcatcttactagctgtggagttacaggcaagttatttaacctctctgtgtctcagttttctcatctataaaatgggactaataatagtacagtgcgggctgggcgcagtggctcacgcctgtaatcctagcattttgggaggccgaagtgggcgaatctcctgaggtcaggagttgaagaccagcctggccaacatggtgaaaccctgtctctactaaaaataaaaaattagccgggcatggtagcacatgcctgtaatcccagctacttgggaggctgaggcacgagaattgcttgaacctgggaggcggaggttgcagtgagccgaggttgcagtgagccgaggttgcgccactgcactccagcctgggtgacagagcaagactctgtctcaaaaacaaaaaactaatagtaccgtgcacggggttttgtgatgattaaatacaataatatataaaaaatggttagaacctgactcattgtaagctctcagatgttaatagtaactttatatgatgacttctaattctcagagcttttgcctaagtagtcattttgctggggaggctgaagttcagggagatacaaagtgactttctacaacgtgatgtgctgttatctcactacctaaatatgttttttctgttgatacagtatgaaagaagtaatacttgttcagagttgtccacctctgtttctcataggaatggcaaaagtatatttaaaagggtgagggaggctttagaaagatgctgtacattgatgatggtaataaatattcagcaagcatttgagttcctctggagtgccaggcactgtgttaggagttaaacacggtcctgactttgagttgacaggctagtgagtaaagcagacaggtaaattgatcgaatactcattggtaagtgttatgattaaatgcagatactgtaagaacacataggatgagacttttacccagatattttgggggtgcgttgtggaattgggttagaggaagaggtaaatgtgatacatgaaataattttgctttccttctcaaaaataaaaagattttgaaggaaagtttcaaatgtttggagtctcttaaaatcttcccagggaagttagtaatgatgtctttttttctcattaataaatgtttctgtaggaaatctgttatccacttagttgtgcccatgttggggtttttttttctttttaaaataatgaataaaaacaaggattggcttgcttattagtttacttttcactgttatatgctgtttccaacagaggcttctctttttgttttggcttcctctagaatagaatgtaatttcatagtacctttcttgtcaccaaaaacaaacaacaaacaaaatcctcgaaagccagaaatcaaaggattgcctttttcccccctttgacctaataaaagaatatatttaaatgttaatgtcagaggctagaaaaaaatttcataggagggtcaggtgcaggggcttacttaggcctgtaatcccagcactttgtgaggcttgaggcaggagggttgtttgagcccaggagtttgagatcagcctgggcaacatagcaagaccctgtctctacaaaattttttttagaattagccaggcctggtggcatgtgcctctagtcctggctacttgaagctgaagcaggcagcttactacacccaagaggttgaggctgcagtgaccagtgagctatgattgtgccattgcactctgaacagaggggagaccctgtctcataacattttttttcataggaacttcttggtaattgattttgaggtaggagtgagtgttacactttgtgggtaggataaagaggaaggtcggggtttgtgaggattagctactaattaaccatcaattagtcttgtttctaaaatctcatctgtatgtaaattggcagaggattttttttctttttggtcacataaagctttggagtgtagatgtaatgacatttgagatgtacactgatagaagagattctttattataagcagtggaatttaaaatttgtttcttaattaaccacagaaagcagtctgggtccagagaaaattgcttagatgggtcatcactaagaaaattactgttgttatatatttcctttaatgtctttataaatcctttatgtactaaactttgatggagtctttcatattagcataaagaaaatctgaatctttcttgccactctttccacaaataattttggttttttttttttttttttgagacagagtctcactgtgtcacccaggctggagtgcagtggctcgatctcagctcactgcaacctccttctcctgggctcaggcgatttttgtgccttagtctttcgagtagctgaaattacaggccacgtacagctaattttttttttttttttttgagatggtgtcttactctgtcacccagactggagtgcagtggcgcgatctcggctcactgcaacctccacctgcccggttcaggcaattctcctgcctcagcctcctgagtagctgggactacaggcacgcgccaccaagcccagctaattttttgtatttttagtagagacagggtttcaccatgctgaccaggcttgaactcctgaccttgtgatccgcctgccttggcctcccaaagtgctgtgattacaggagtgagctaccgcacccagccactcccacaatattttattatacagaatttagtatgcaagggttaggaagagggtgtgtgtgtgtgtgtgtgtgtgtgtgttttagggtgttttatacctcactaggaataaacatctgatattttcctgtaacattaagtaattttttttttaaccttttctctaccctgtcatcctgtagtttaagtaatttcttaggaatcttgcttaaggaaaaaatcccctgaactataaaatcttttctcatagatgtacttgaaggatataatggaacaatatttgcatatggacaaacatcctctgggaagacacacacaatggaggtaacgttttataatctgtacttagatgtggtttgcaatacatacagcattcattatttgtgatattatttcaccatgcataaacattttaatttactctttattgccttttctcatacaaataatatacatgtaacatcattgttggaatctaatcagttcctgagtttaaatagtaagggatacctgtatttgagattatatttgagattgttttatcagttagcataaccataaaataaataacattttagacaagaattttttgtcaccctgttatatgggaaattttgaatgcttatgtgttgttgattttatgtagtataaataactttttcctgttctccttggctcctccttcctcaaaataactgtcactcttctctgataagaatgttgccataattatcagtgctgctgttaataatagatgtggacccactatagctttgcttctagaaaacagcctgtgattttctgccactgctaaagagcatctgtttttatcatttatttgagtgtactatattaagtaaatgactgcttcttttagtgtgattcatattactgattttcataaagtcatagagaacaaggacatcctagtatttgcatgaatttgcctcgaagtagaaggaacaatgtagaattatatggaaagaaactaaaacctttttaattatgttcattttacaatgaacattttacaagcatggataatctaaatctagtgattaaatgaagggttaagatctgttggtaacccatgtggttgatgtacagtagtgtgtatgtgtaatagttgaattggattttttaggtatttacagagccgtttccacaaaaatatagttcctgtcctttcttgactataagttgtagattgaaactctttgtttttacttcatattttataatttatttaagaagtctagttttgttttttgtttagggtaaacttcatgatccagaaggcatgggaattattccaagaatagtgcaagatatttttaattatatttactccatggatgaaaatttggaatttcatattaaggtaaattccttgaggaaagattatattttattttacagcaagaataatgttctaaaaaaatagtaaatgctggtttctttaattttaaaaattgtttttctggaaaggtacagttgaaagatcattcaggttagtaaacttggatttttgttcatctgccattagatgaacaggaatgttaactaacgtaaatgattaagtctttagcctccttcaaaaaataaaggaggttgctttactgcagaacttgaaggtttctactacataaaactattctaattcattttagatgaagataatgtaatttatgtccaatgggaagactgcttaaataactaagctaatttggctaatttatgtcttcccattagaatgtgagctatggctggtatgttgataactgtctctctagtctaaacaatgcctagcactcagacctcaatatgcgaataagttatataactttagttgatcggtgtttttttaaatttgccctttaggtttcatattttgaaatatatttggataagataagggacctgttagatggtaagttaaattcttgctaatcagttttaaataacatctgttaattcctttttaataatagatgtgagactatttctttgtaacctatatgaaattgtcttaagttattggaaatagacaaaattttttttcttctaaagttttagttgaatacctttaaatagaataactagtttaaagcgatgtttatgggtacttcttagtagtaattagagcattggactgggagttacataatctgagccctgagttctagtcttctgtcaactgtcaattagatacattgtccttaggcaaatcattgaaccattcagggttaatgttcttgtttataaaatgtgggtggtaggttggagtggtcctaaaattctatattgttgcattggtttctatttacatctcctgctgtgtctgtaaggtctgctttagagcaatgttttaatatgtttttagagttcaactattgctgttaggctgctcaggaaagcctatcagttatttcatatccagtgttaagagttttaggagaatgttgctaacatttgtttttctttctcagtttcaaagaccaacctttcagttcatgaagacaaaaaccgagttccctatgtaaaggtatttatagtacagttgtctagaaaaccctgtaatactttttttttttttttaagacagagtctcactctgtcgcccaggctggagtgcagtggtgcaatctcggctcactgcaacctctgcctccagggttcaagcagttctcctgcctcagcctcttgagtagctgggattacaggcatgcgccaccacgcccagctaatttttgtatttttagtagagacgaagtttcaccatgttggccaggctggtcttgaactcctgacctcgtgatccgcccgcctctgcctcccaaagtgctgggattacaggcgtgagccaattcatttaatatatggaggctcgctctgttgctcaggctggagtgcatggcatggtctcggctcactgcaacctttgcctcccaggctcaagcgattctcctgcctcagcctcccaagtagctaggattacaggcacccgccaccgcgcccggctaatttttgtgtttttattagagaaagggtttcatcatgttggccagacattaacatatttttaaaaattatttcacaggggtgcacagagcgttttgtatgtagtccagatgaagttatggataccatagatgaaggaaaatccaacagacatgtagcagttacaagtaagtagaaaataacactggttaggatttaaaaccagcttaaaatatccttatccaggtgattaattataagattgcttcagggaaattgttaaggggaaatcatgtttgtttatatttgtttgtgtaatttccttgcagatatgaatgaacatagctctaggagtcacagtatatttcttattaatgtcaaacaagagaacacacaaacggaacaaaagctgagtggaaaactttatctggttgatttagctggtagtgaaaaggtaaagtcttcatgtattttgacaaatatttaagcatctttgtaaactttagtttgagttgggagttacgcagggttcattgttgcatcttacttaccaaactggatttggtaacctgagatttgtaaccgctgatgccagtgccttatgatgatatcagctgaataatcagttccaagttactgttgtttgaccatactctagttcaacccataagtggtttctatgacttaagatatgttcatagtgagaactggttcagcatatgttgttataaactttattagatatcccttttctaatttttgatacgtattttatccatattggcagtggggtccctattaaaactggtaactctcgattagtcttttctggtttggttggacttatttctttcctttggattattgtttcattattacaattctatacagtctgattctagtctatatcaaattaagtttgaatgttataatagggacctctgaccatttttgctgttgtgctaattttgtttcttctgcttagaatgatatatctattccgttctactctgaagtcttacacacatctttcaaagattatctaatctgagaaatctcctaagctatttcttcagccaacattgctaatttattgttctgacctatctttaacatagatactagctgggcatggtggcacatgcccgtaataccagctactggggaggctgaggcaggagaattggttgaacccgggaagcggaggttgcagtgagctgggatcaagccactgcactccagcctgggtgacagagtgagactcagtctccaaaaaaaaaacaccacaacatagatatttagatattttatatatttttaaaagaagcagatttgcttatataatgtgtttaaaactcagtctctgttttctaacagttacaacatcaacattatgcattagccaattttagaaggttcctgttttctaatgtagcaaaggggactaacagattaatgaactacaaatttacatttaaattggttattttcaagagtacctacaaactacagataaaatttgatgtctctctaatcaaactcttaagagtagtactcaagaaatggtggtatgcttggcaaataagatcatgaagcttttcatgttcttttttcttttttactggttattgatgacatatgaacattttagaaaatgtaaagaaaattataaacttgtaattttgtttcattcttttgaaatcttatgtataggttagtaaaactggagctgaaggtgctgtgctggatgaagctaaaaacatcaacaagtcactttctgctcttggaaatgttatttctgctttggctgagggtagtgtgagtatacatgtcttctatctccctgttaccttatggggcattatttaaatataggtgtatatgtgtgcctgggtgtgtatgagagagagagagagaaagagagattgagattcaatgtgtttgaatcagtatgtgtaagttagttgtcttttgggagtttattttataataacattttattatactggtcttgttttctttctttgtttttgtatgcagacatatgttccatatcgagatagtaaaatgacaagaatccttcaagattcattaggtggcaactgtagaaccactattgtaatttgctgctctccatcatcatacaatgagtctgaaacaaaatctacactcttatttggccaaaggtttgttgttaagaaagtacaaaacctaaatttagatagaccttttgtttataaaatgtaggaaaatgtgagctgttattccaacctgtacatactgttttgtgctagacacactcagtttgaattgatgacagataatacaaggtgggtctgatttttagactgcttggtttaagttttagtacacattaaagtcagatgtaattttagtcaaatttgtgtgacaagctgtaatttggtattaaagaaaataagcatttgaatcaaataatgaggtcaaagcctggcaaacataatcctctgttaagcctgtagacatgcatgacaggttaatataatctgtatgagatgattaggaaaatcagtaatgatgattccgtctttgactttcaacagtaatttcttaattcagccttgcaaacaaattggaaaaatataggcctttgtcttttatttttagtggtttgttgatttttttttttttaaagctattcacagattttggagcagactcaaatttagttgagttgtaaataacgtcatatgttgcggcttttagtatttagtctaagagattactggacaagcataagtttcttagccatatatacatatattccatatagataaaattaaaaataatttcagtctcatcctttttttcctccaattacatctcttagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggtaataacttaagaatttgtcatcttcagtttgttaaatacagatttagagcatagaaacgtagaaatagttcagcaaaatcagtaagtgactagatcaagaaatttaatagacatcgaaataatttttaaaaaaattaatagaaatcctggagctgaaaaataaaatgagcaaaatgcaagagaccatcagtagtagaattaattaagcagaagaatctgaacttgaagacagattatttgaaaataacacagagaagaaaaagtttgaaagaacgaggctgggtgcactggctcatgcctgtaatcctagcactttgggaggccaaggtgggcagatcacttgaggtcaggagttagagaccagcctggccaacatgttgaaaccccatctctactgaaaacaccaaaattagcctggcatggtgctgagcgcctgtaatcccagctaatcaggagtcttgaggcagtagaattgcttgaaccctggaggcagaggttgcagtgagcctagattgcaccactgcactccagccagggtgacagattgagactctgtctcaaaaaaaaaaaaaaaaatttttaaaggaatgaaattgaaattagctttagacgtcgtttttttattaaccactttattttcttattttaggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggtaggtattgcttgatttaggtctgctttatattaggatactattgacatgggtgtttttattttctaacttttctcatttcagtgctgtgggcacttaggatctttatgcatcttccttgatttctgttaatcttgtaaaaattattgtattaacaaaataaaaagtcataatttcaatttctgtgtggaaactgtatgagcatgtatcttttcttccccctctttttaagctaaaagaactttataaggcagcagtccccaacctttttggcaccagggactggtttcagggaagacagtttttccgtggatcaggtcggggagatggttttgggatgaaacttccaccttggattatcaggcattagattctcataaggatcctctaacctagatctcttgcatgcacagctgataatagagttcgcgctcttaatgatattctaatgctgctgatctggcagaaggcggagctcaagtggtaatgcttgctgctcacctcctgctgtgcttcttggttcctaacaggcttccagtactgctttgtggcctgggggcttggggacccctgttctaatgaaaatttggcattgggtcattgggagcctcaatgataccaattgttagaatcagggctctgaagactccaataaaagatgatgtgagagattaagggaaacacaatagagtggaaataatatcttcctgctttgcatatagaagtaatgtcaatagtatgaataatagcaaactaagaacgtaatagaatggaaggcaagaacaagagtagtaaagagattagaagaaaatattttcttaagttgatatttttaatatattttaagcagagatggcaggttcgaagtacatgaccattataagtattgataattgaaagaaattccttttgttttgccattttcttaaaagagattaaaataagcaatgttgaatttagagaaatggttttgaaatatttctggggagtagtaatcttataacctgtattgggaaacaactagaaccaggttgttagctactggttaaccggatacttcacaattctaggatgaagaaattaaccagcaaagtcaactggtagagaaactgaagacgcaaatgttggatcaggaggaggtgagttgaataccttttacattgcttccagaaaagctttatagttttgttttctgaatcccattgactttgtctttaatagttgtataattttgggtatgactgtctttgtgggaataagaatgtcacatggataaagtgaatttttacttattcatcgtatctacccagatacaatctgttgttcatttctgccatcttttttttcaccctggttcttgacatttctcttcttgtcacttactttggatcctcattttatcttctcacccagcagagcagggggataattgaaaagcagtcctttaaatttttttgtgggggtggtgggcagggtgaagacaaagactgcttcggtaagaaagagatactctccatcagtgaacttaatcctggtcagatcatctttcaactatagcatttcatatttcaactatagcattattcctcaaaggggcactattgatattttgcattggataatttatgttattctgtcctttgtattataggacattaaacattcctggtccctactcctaaatgccattagcattctaccctattattaacactcccacagatttccggatatccctacaggagagccactaatgtggatgattgtggttttctcctaactagtctcttggcatccctgcagttcagattttatgtgctgataccaggttttgtttttgtttttgaggcgaagtcttgctcttgttccccaggctggagtgcagcggcgtgatcttggctcactgcaacctccacctcccaggttcaagcgactcttctgcctcagcctcccgagtagctgggattacaggcgcctgccaccatgcccagctaatttttgtatttttagtagagatggggtttcaccacgttggccaggctggtctccaactcctgacctcaggtgatccacccgcctcggcctcccaaagtgctgtgattacaggtgtgagccactgcacctggctgataccaggtttttccatggcatagcacaaatgtcatcacttgttgctgaaagcaaatctaaaatttttttttttttttttgagacggagtttcactgttgttgcccaggctggagtgctgtggcacagtcgcggctcattgcaacctctgccttctggtttcaagtgattgtcctgcctcagcctcccgagtagctgggattacaggcgcccgccaccacgcctggctaattttttggtatttttagtagagacgggatttcaccatgttggtcaggctggtctcaaactcctgaccttgtgatccgcccgcctcggcctcccaaaatgctgggattacaggcgtgagccaccccgcctggcccaaatctaaatttttaagcaactcttgtagaatgccattttcctttattacattaatttgcatgtgactgcagtcgatctctcctagccaacttctccatgaatgaatactctttcctgtattactaagcactttatctgtcctgtccctctcttatggttctgaccttctatcttgtactgcacttattcatgtgcctatcttctcttctactgtgttccttaaacacagtctttgattttctttctgccttgcagcatccagcacagtgcctgcacatagttgacatttagtaaatctgtttaatgaataaatgttgccacactgaataccatccatatttcactccatttgttcttgacaaatggtgaagcttcatgggtgttttttaaaacctgtatacttttggggaaaataaattattttctgtcctatagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggtaggatatagttttattttcttttttaatgctttagtacaagtattcttaacctaaaaactacttaaataacttacttttctatgtaagtcaaatatcgataacatcaattttcaaggactcgggtttcaacttcatttctttctgtatatgaagccttagaggtggaggaagacagttattttagttcctaaaggtctgttaatatctaatttaaatgctgttttagaggatgtttgctactcctaattttaatttttttaatttagtatatagcatgtagaatctaatgttactactaatgttaaaggaaaaataatttaaagctgctagttgcccaataaagctattagatgattgttcaaacaataaattaaatatgcagtacaaattaaaatgctatttaatcaactgtgaattatttggaatagatgtaaggatatgtaacttaacataatttatgttttacttactgttacatttccactacgtggaacagtgcctttttagcacagtgtagtggttcccaatagatggagatttttttttttttttttgagacaaagtttcactctggttgcccaggctggagtgcaatggcgcaatcttggctcactgcatcctctgcctcctgggttcaatgattctcctgcctcagtctcccgagtagctgggattacaggcgcccgccaccacgcccggctcattttgtatttttagtagcaacagggtttcaccatgttggccaggctggtctcgagctcctgacctcaggtgatccacccacctcagcctcccaaagtgctgggattacaggcgtgagccaccgtgcctggcgactagatggagatttttacttgctgaaaattgatacaggacagacatcaccaacctccaacaatgatgacagaaataatacatagctatgaatgtttcaacatcatcatggaggagctattttgtggttttgttgtggttaatgctagcttcttgtttagaaatcagcatctagagttgcactcaggacccatgtccaccacttatttccctgctcacattaacttgtctaaaagaaagcagtcaacagtacaaaataatgcttttaaaaggtttcctgcccctatgagttccttttctctttttaatctacaaagttacagttagcttgaagttaacattcagtactgtacagatctaagacaccattataactaactcttactgagttgcattattaacaaagctaattgttgtatgaaagaataacaggagttttttacaactctgaaaggtggtccttggccgctgattttagtctttaagacagttatatttatgtttcacttgtggagctgaaatctatcagcattacattgataataggagttagaaatccctagtgtttagcatctgtttatatgcttagacagtgttgctgttcagttagagagtgtctggtaatttaaacaattatggtagaagcatgctatattatgagacttgaagataattggtatcatattgtagattaacctgggtggatacatactctactgatactcagaaacttaaggaaatgacgaactaccataagaaataagcagttggaatgatggcatctttactaaaagatactgatgaaaagtcaataaatggcattacaaatacagtatagtacaggcattacaaatacagaagccccaagcgtttcagattttggaatgtttgcattatacttaccagttgagcatttctaattggcaagtccaaaatgcttcagtgagcattttctttgagcatcatgcaagcactcaaaaagtcccagattttcgagcacttcggagtggggatgctcaccttgtatctgttctgccatatgagttattttaaagtgggcaccaaactgggttggacttttcaaaatttggtgattttgtagctgttaagccagctatgatttgagatttataatgatagtcattaaactcagataatattactttaacactagctcctggataattgcctgtatcatagtattatcacatggattctttccagtgagtaagtatatagaaagtagatgaagaaagcatactaaccatctagaaaagagtgtcattgtaacgttaatttgctgactcactttctaaagataagacataatatagtaataagtgataatcaaatctagttaaatttgaggcttcccatttttagacagaaaatattattcaatcccaggaatttagtgaaataacagaaactgcctgctcttaattgaaaacaatgtggctacttttaccatagcctattaggtctaaaatatattttaagtttgagctgggagcccagaacctggtagatagttcaagaaaaatgaaagcagaaaagacatggtttcgtaagggcttggtgtaaaacttgaaacaccgatgagtatttgatttgaattttcatgtagtagatttaactatactttttgttttgggttctcttaggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaaggtaaatataataactaagtattaaggacaattatctgtatacactggcacttttgtttactactaatagtttgtaaagttcttttcgtattcatgatctcatcctcacaaacagtcgtgtagtagatgttattaaccgcattttaaatagatcaggagagagcaagagaataagggcacccaaataggtaaattcagtaggcggcatttattggacctcatgtttgattctttactataacattttccccaacctgggcaatgtggcgaaaccctgtctctacaaaaaatacaaaaatgagcctggcatggtggcgtgtgcctgtagtcccagctactggggtgggaggattgcttgagcctgggaggtcaaggctgcagtgagctgcaatcgtgcaactgcactccagcctgcacaacagatcaagatgctgtctccagaaaaaaaaaaaattcgtgcttaaaaattacgttaataaatttccataagtgaaatgattggaacaacaattaagattagttcacggaccagacatagtggctcaagcctgtaatcccagcactttgggaggccaaggcaggaggatcacttgagcccaggagttcgagaccagcctgggcaacgtggcaagaccttgtccctacaaaaaatttaaaaattagcctagcatgtaggcatggtgatacatgcctgtagtcccagctattttaagagactgaggcaggaggttaaagatgctgtgaaccatgtttgtgccatggcactccagcctgagcaacagtgagaccctatctggaaaaaaaaaaaaaaaaaagattagctcagggaataaatttataatgaatgggcttgtggttgctttaaatatttaaagaaaagttaaagatgagcactgctttcttaattcttttttattttagtgtgaaaaatttcaaacataatagtagagagaataatacaatgaactctagagttttcagttttcaaaatatgtccatattttctttatacctctttgtcctaatctttttaaagatactaatattggttgttagcattaggcatttgacttggtggtagatttaaaaactaagaccaaagaaccaaactaagactcttaactgaaaaaccatgcatataacatgaaagatttgtatgttgcagtagctgtttagactttacctttttgattaaagcctaattacaatacaaagagagcatatacacttgggtttatattgagagcctactaaaaagcccagtctgttaaccagagttggaactgacgtaaaagttttcaatatggagtacacatttccatcttttgtattgtttaatgttgctgtttgctgttaactgattcttcagtttaaaaatgaagaaaaaatatttttaaaaaatacaaaaagaataaaagataaaatcaacaaaataaaagttactgtttgttgatggaggcaaggattctcatgactcttctcttcatatgttatttcttcagtggactcactatggggccacttgacttgctttcccttcaccatcagtctgaacatttcggccctattctgtttatggtgaagtaatgtgagatgtagagaaatctctaggatggaaaagtacatttatttcatatcgcagaacaccagagagatgttgttcaagatttgctttgtagatttgcaactttttagacaaatcttatattttatgttcaaataattatgatttaagttaaaaagtgtaaagagagagtggaaatggtttatgtttagtggcagagggatgaaatccaggttccatgactactagatttttttttccactataccatagcagtttgaaaataagtcgtctttgcaaatagttattctaattaaaaaaaaaaaaaggatcctcagtatttttgtcattaacaagtaattcttttcctctcatcatatataagctctgttagagcgttactttttttttttttttttttttttttttgagacggaatctcactgtgtctcccaggctggagtgcagtagtgcgatcttggctcactgcaagctccgcctcccgggttcatgccattctcccacctcggcctcccgagtagctaggattacaggcgtgtgccaccacgcctggataattttgtttttgtatttttagtagagatggagtttcaccgtgttagccaggatggtcttgatctcctgacctctttatctgcccacctcggcctcccagagtgctgggattacaggcatgagccactgcgcccggcctgttgttgttcttaagttacagtttacagttttatgttacagtttacaatgattgttgtactcattgtattctatagttgtgtggattttaaggagtgcataatattataggtccggtatttagaatagttcccacaccaccctaacaaattcccagtgtttttgctattcacctctacttcttgaacttctggcaaccactgatgtttttactatctttatagtattgctgtttccaaaatgttatatagttggaatcatacagtatgtatatgtagccctttcagctagtttctttcacttaccagtatgcatttaagattcttccatggcttttcatggcttgatcatttttttaaattactaaattatattccatgatatgaatgtaccatggtttgtttatccattcacctatgtggttactttgaggttttggcaattaatgaacaaagctgctataaacattcatgtgtaggctgagcatggtggctcatgcctgtaatcccgcacttgggaggccgaggcgggcagatcacttgaggctaggagtttgagaccagcctggccaaagtggtgaagtcccatctctacaaaaaataaaaaaactagccaggcatagtggtgcacgcctatagtcccagctatttgggaggctaaggcacgagaattgcttgagcccaggaagtggaggttgcagtgagccaagatggtaccactgcactccttcctaggtgacagagtgagactctgtctccaaaaaaaataataataattcatgtgtaagttattctttggacataaattttcagttcagttgagtaaaaatacctagaagtgctaggttgtacgttatgactatgttagctttgtaaggaactcccaaatggtcttccaaagtggtggaaacattttgcattcctatcagccatgaatgagagtctgctgttccacatcattgccagtgtttgctcttgtcagtttcttgggattttactaatgtatggtgttattttattgtcattttaatttgcagttgtgttttttcttattgttgaggttttctttttctttgagacggagtctcgctctgtcacccaggctggagtgcagtggcgtgattttggcccaccataacctccgcctcctgggttcaagtgattcttctgcctcagcctgccaaatagctgggaacacaggcgcgtaccaccacgcctggttaatttttatatttttagtagagatgggatttcaccatattgtccaggctggtttcgaactcctgactacaggtggtccgcctgcctcagcctcccaaagtgctggtactacaggcatgagccactgcgcctggccctgttgttgagttttgttttgttttattttgagatggagtctcgctctgtcgcctaggttggagtgcagtggcatgatctcggctcactgcaagctcctcttcctgggttcaagcaattcttctgcctcagcctcccgagtagctgggactacaggctcccactaccacacctggctaattttttgtatttttagtagcaaccgggtttcgccatattggccaggctggtcttgaactcctgacctcaggtgatctgcccgcgtcagcctcccaaattgctgggattacaggcgtgagccactgcgcccagcccgcactgtactattattagtcccattttatagatgagaaaactgagacacagagaggttaaataacttgcctgtaactccacagctagtaagatgaagctgagacgcaaatgcaaatagacttggttccagagacctgctcttaaccactgtactatatactcaaggagcagaggaaccaaaataaatacaaggtaggctacatctggaaaaaccaaaggtgaatacagcggcagagagttcaggtcaggaagccatggtggaaaaaacaggaaatctacaaagacctgatgagatgcttatcatatagtgggcaatgaataaatagctacttaacacaagggaaacaaatcactcagattcagaattcaagagaatacaagtgnnnnnnnnnnnnnnnnnnnntttgttttgttttattttgagatggagtctcgctctgtcgcctaggttggagtgcagtggcatgatctcggctcactgcaagctcctcttcctgggttcaagcaattcttctgcctcagcctcccgagtagctgggactacaggctcccactaccacacctggctaattttttgtatttttagtagcaacggggtttcgccatattggccaggctggtcttgaactcctgacctcaggtgatctgcccgcgtcagcctcccaaattgctgggattacaggcgtgagccaccgtacctggcctcctattgttgagttttaagagttcttcggccgggcgcggtggctcacgcctgtaatcccagcactttgggaggccgaggcgggcggatcacgaggtcaggagatcaagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcccgccactgcactccagcctgggcgacagagcgagactccgtctcaaaaaaaaaaaaaaaaaaaaaaaaagagttcttcatatgttttggatataagtcttttatcagatagtgttttgcattatttctctgtgtcttgtttttttttttttgtttttttttttactctcaacgtcattttttgagactaaaaatttttaattttaatgaggtccaacttaccaagttttacattaatagattgtgtttttggtattgtatttaaaaacttgtcaccaaacccaatatcacctagattttctcctatgttaaaagtttttttttcagttttgcatttacatttagatctatgatccatttggagttaatttttctgaaaggggtaaggtgtgtaccaggattcattgtttcacatctggatgtccagttgaagagactgtcctctctccattaaattgcctttgcacctttgtcagagatcagttgactgtattttgtggttttattcctgggctctttattctgttctgttaacctgtttatctgttctttgccagcactgtactgttttgattattatagctttacagtaagttgcatagtgtcaagtcctgtgactttgtttgtccttagtgttgtgctagctattcagggtcttttgactttacatgtaaacttaatcatgtcatctgcacagttttatttcttcctgaaggtgaaggaatatacagtgaccacaattccttctggttgagcttaaagttcatcctttccctgccacctaaacatcctcttgttaaattttaagctgaacgtgcacatgattaacaatgaatttactgaagaggtcctgtaaagaggaagtgaaaaaattgaaagaggcagaatttattagtttggttgtatttttgtgttttctttaggtttacatttatttatttttcttgttggcatgtattaacattattctcagtttttaaaaaaaggaaggcaaaaagtaagctgtatttatttacctttcgttgaaaacagtaataaaagaaaaaaataagatccagactttgtatgaatattgagtaatactaaaatatattttataaaaagattttatagcctaattgggaaaacacacattgaacatttttggctttaattttttattttactttttcctcacagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaagtatgttatagaacaaagtttattcatttttttgaaacagccacatagaaattttatttattatacaagttttcagaaaaatgtgtgtctataggtgaaatttagttgtttttttcctagtctagctgcagtaaatttgaatgatttaactgagttatatttgcctaacataaatatgggttatgtatagaaatttaccagaatgatgtgactggtggtaacttgttaaagacttcagaattccagggtgggcaaaactgcagggaaccagtttcctggcttggcaactgaatgaatggggccattcaccactatcagaatttcacaaggagggaagatggtaacgttagatggtggtatctgtaaaattagtatttcatatttgagtcttcagtgccttagtttgcaagttatgatcaccaatgaattaattgattacattctttaacatttcaaaattggctcctgaatattttagttttaaatattcccaaatttatcatatatagataatgaaatgtttactgtcaaatattcttaaagtgtatgcatatgttttccacttcatatcagtatattttttccaaaagcatgaagccaaaatcaagtcattgactgaataccttcaaaatgtggaacaaaagaaaagacagttggaggaatctgtcgatgccctcagtgaagaactagtccagcttcgagcacaaggtatagcttccaactgtttatgagttacatctgtgttcttattttagtataattgtagtaaacttaatattcacactgaaagaaatagtaggaatatggctgatttcgaatggtaaacaaatcatacatattaatgttgctttgaaacatttttttgttgttgttttgagacggcgtcttcactctgttgcccaggctggagtgcagtggcactatcttgactcactgcaacctccacctcctgggttccagtgattctcctgctgcagcctccctagtagctaggaccacaggcacatgcccccacgcctggctaattttttaccttttttgtagagacagggcttcaccgtgttacgcaggatggtcttgatctcctgacctcgtgatctgcctgccttggcctcccaaagtgctgggattacaggcatgagccactgtgcctgtcaaaacatatatatatatatttttaagattttgtttgaatatggaaatagccaatctggggatttcccacagttacgaagcggggtgtgtgtgtgtgtgtgtgtcttaacataggggacttaggagttatctcatttctttaccattcccttaactaatctgttctggattaggccaaaaaaaaaaaaaccaaacaaaccataaaggaatacataataccaacacaatggatgtaacttgtatactagtctacatgtcattgaacttggagagcaggtgacatttgggtaatttgaagttgaatattgctaaggaaaatgcttattgtaaaatccatttgctccttggtttatatgaggaaccttaaaggcttatttcactcttctattttctctctattcaaacagagaaagtccatgaaatggaaaaggagcacttaaataaggttcagactgcaaatgaagttaaggcaagtttgatgtcacatttctaacagctttaattaatcagtattaattttgattagtctgactttaacatccttttcccccccaaaattttagcaagctgttgaacagcagatccagagccatagagaaactcatcaaaaacagatcagtagtttgagagatgaagtagaagcaaaagcaaaacttattactgatcttcaagagtaagtattatacttctctagttaggaggaaagaatcggttactgatggtcatggtatatattcttattagaaacctgcagttttcatcaaaattacatttttatcttggaaaataaagaattttctcatttatgagtaaaacttctaaattccaggtgaaatttttgaggcttttttttaggtcttttgatctaaattattcagtaaaagaaaaaaatccccaacctaagtctattattgcataccacagtcttctccaaatcctttatttagtttccttttttaaaaaaattcttggctgggtgcagtggctgatggcctgtgaccccagtgctttgggaggctggggtgggaggatcactagaagtcaggagttcaagaccagctgggcaacatagtgagactccatctctacaaaaaataattttttaaattagctgagcttggtggcacatgcctgtagtcccagtgacccaggaggctgtggcacgaggattgcttgagtattggaatctgaggctgaagtgagctatgattgtactacagcctgggtgacagagcgagaccctgactcaaaattcttaactgggaaaaacttttctggaaattctatggattttcaaaggtttttttttttttaagttgtcatcttagtttatctagaagcaatttccctgcctccataaccatgtgcacatacatagagtttatggaagtcagagtttgcaacaatttgagtaggaaccaagaagagaataacataacaaaataatgatgaggtttggggcctaggtcttactatgaatacctgatggaagtaggcataaggattcaggaagatgaaagacagaggagaacagaatcatgatttcaaaccaaaatacgaaaaattttgtatgtccacaagtagccaggtccctttcctcttttcctccatagggtacaggataacagaaaagtccttgatgagattatagaatttaaaagtttggaaattttaatgatgacattgagaaaactgtgatattgatactgtgttaattatttttttctttcgtcagccaaaaccagaaaatgatgttagagcaggaacgtctaagagtagaacatgagaagttgaaagccacagatcaggaaaagagcagaaaactacatgaacttacgtgagtaattgtttttaattaaagtttaaaaataaaagctaaattagaggattataggcattacctttggatatagccagtggatacatattttactttgtatgggctaaaggattttttcttaaatccactgagttggtttgatttatatctaaatacttggaatatatacttgcatttgagtgaaagcaaggtcttatatttcattgtggttaagattaaggtttctctttattaatctgcttgctgtttctttatctccatattacttcaggatccagcataaaaatgaacctaaaacaatatattaagtaacttcgaagattttaagatctaacacaaaaactgagtttttgttaaattttctcttgcataaaagagcattgtggtgtttagccttgccattttgaacagaggttttcatggtttaccttttctcattttctcaaaactcagttttctagaatcttagcaggtagaaagtgcatgattataatttttcacataccttgagtttgtgagacaatttgcaaatcaactgatattgttaggatagttagaacatcaggaccagttcagagtggattatatgaagattctgctaacttgcagctgtaattttgtttagaatacttgtaatgtaaaatattttagtctttgacagtttataatctataattaatcagtatcattttggataaatagcagtataatacatgtggcatattttaaaatataaattatagaactattccttattctttgaattctgccacattttatttcatctcttccattgctatatatggaatgtataacaatagactgttgttttagaaggcatatgaaaattttttgaaattgcaaagctgcagtggctcacacccataatctcagcactttgggaggccagggcaggagaatcagttgagcccagtgtttgagaatcagcctaggcaatatagtgagaccccgtctctacaaaaatttttttagacagggctgattgtacatgcctgtagtcccagctatttgggagacgaggtgaggaggatcacttgagcccaggaggttgaggttgcagtgagcagtgtttgggacagaaactctgtgtcaaaaaaaaaaaaattttttttttgaaagacagcacaggtaaattgtttaaaataggcatcttgtatttatttaaatttaagaatttatcctttcagacacaaaatattttattcaactctcatgctaagtacaattttacagaataaaatttgaaaatatatgtttgttcttctactgttagggttatgcaagatagacgagaacaagcaagacaagacttgaagggtttggaagagacagtggtaagaaaaacatgaaaataaacaggattgggaaatattttgtgggttttttctaccatgattattctaaatttaaagtctgagctccaaaaatatcgctgttcttaatccaaggcaaaagaacttcagactttacacaacctgcgcaaactctttgttcaggacctggctacaagagttaaaaaggtaatgtaactatgccgaggtaggcgtttgcataaatggtgcttacttctaggtaattatttgtattcaaagtgaaataactttacagtcacgtcaatttttgtatagttaagcttagttttttttaatttttttgtaatacttaccttcttttctcagagtgctgagattgattctgatgacaccggaggcagcgctgctcagaagcaaaaaatctcctttcttgaaaataatcttgaacagctcactaaagtgcacaaacaggtactaaagagtatattttctggtagctgcaagatagtaaaaatcaaaaattgaggattggcaagtgagtatttcaatctttcagagtcctcaggaatttttataccctgagccattttatcagaaattatataaagaaaccataagtaacttttagaggagttaatatttttaacaacgttattatcaaaagaggcagtgaaaacatgtattctcattttccctttaggattttaagactgtgcattttcataatttattcatggtaattttgaaatctctactacacaagactgcagttaaagtactgcaaagtcttttggggagagtggtctttttatacctaataccccagtgtgtcagacataatgacgcagttttcatttaaccagattagttgtcttactgaagaaacatagcactatcttgtaatgtattgtctttgcctagtagagggaaagaacaattctccccctaaaaaattaaaggaaattatacctttgtgaataaactagatgtgtgcacgctatgtatagatggatgtattccttgcgtgtttctgcctaaattagataaatgggaaacaatataaaatgcagttttacttttctaaagagcaattatgaaatgctcatactttttcaagtcatcctgttaaatctggaatccttgttttctttgtgtacgtttagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattggttagtagaacacattaaaacctttaaaccttgctcaatttgaatgctttcatttagtggaaaacgtaatccgaattttatgtgttgtcatggtgcatctgtctctattttctaacttagcagagtggcactgttgggaaagaggaataatcacattagcagaaaaagaagataaatgagaactagagaagcaagcaagaatggtcatggaatggagaaactatatagagcaatattattaaagccaagagaattgcaagaaaataagccatcagcaatgatttaacgtttaagaataatcattggtggctgggcgcagcggctcacgcctgtaatcccaacactttgggaggtcgaggcgggtggatcacctgaggtcagaagttcgagaccagcctaacatggtgaaaccctgtctctactaaataaaaaaaattagccaggcatggtggtgaacgcctgtaacccagcaacttgggaggctgaggcaggagaatcgctggaacctgggaagtggagattgcaatgagccgagattgcaatgagccaagattgcaccattgcactccggcctgggtgacgagcgagactccatctcaaaaaacaaacaaacaaacaaacaaaaattggtgcaggaagtgttttttttgtgttttatttatttatttattttttgcttgttttttgagatggagtttcactcttgttgcacaggctggagtgcaatggcgtgatctcggctcactgcaacctctgcctcctgggttcaagcgattctcctgcctcagcctccctagtagctgggattgaaggtgcaagccaccatgcccagctaattttgtatttttagtagagacagggtttctccttgttggtcaggctggtctcgaactcctgacctcagatgatccacctgcctcggcctcccaaagtgctgggattacaggcatgagccactgcccagccattttttttgtttgtttgtttgcttgttttttatgacacagggtcttgcttgtcacccatgctagactgcagtggtgcaattatggctcactgcagccccagcctcccagggtcatgcaatcctcccacctcagccttccaagtagctgggactacaggtgcacgccaccacacctagctaatttttttatattctgtagagacagggttttgccttattgcctagtctggtcttgaattcctggacccaaatgatccacccacctcaggctctcaaagtgctgggattacacaggtatgagccactacgcctggccaggaagatttttaaaggctaagaattgtataggtcctagagaaaaggatgttacagaaaagaaaaagtgatggagaaacaaaaaggcaaagaaaaacaaaacatttgggaatttgttgtgaataagagaagaaaccttaacagtcattgcagtcacatcttaaactttattctaaagtctgtctttatttttcatattagctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtttgttatttatatctggcttttcatatctgtttgtggaaaattggttgttaaataggttttttggttttaaaaaattctcacattagtgttatgatttttttaacttaagcattataaaagtaatttagtttgatctttttgtgtagtttagatcatactatatattcaaatttgtggtcttaattgttttgaaatctagcattggaccatttgtaatagcttttgatactgtgtctaatggatgtaccatggtttataaacattcctttccttttggctagacatgtaattatattaattttttccataattgaaattttcaaaaaccaaaattttcatatatgaaatttgaaacatctttttttttttttctttttctttttgagatggaatctcactcttgtcgcccagcctggagtgcaatggcgtgatctcagctcactgcaacctctggctcctgggttcaagcgatacccctgcctcagcctcccaaactgggattacaggcgcctgccaccatgcctggctaatttttgtgtttttagtagagacgaggggtttcaccatgttggtcaggctggtctcaaactcctgacttcaggcgatctgcccgcctcggcctcccaaagtgctggaattagaggcgtgagccaccgcgcccgacctgaaacatctccttgtattccctaacctgttagagattatttccagaaggttcccagaaatgcaattacaaggaaatatgaacatttttaaggctcttgctacatattaacacattggtttctagaaagactgcaccaaattgcttatgagcccagcttactaacagatttctgagttttatttataattatataagtaatatctgttctttgtagggcataaaacagtcacaaattagaaaaaatctagagatactacacaatatactatctctctctctctctctctctttctggagctttctgtattagtttttaaatttaaaagtttaaactgttgataactattgtaatagactccacttattctactacatatgctgcttcggagcctgcttttttttccggccccctgcccccacaaaccccacacccccctgccccactccgagacggagcctcgttcttgttgcccaggctgacatgcagtggggtgatcttggctcaccgcaacctctgcttcccaggttgaagcgattctcctgcctcagcctcccaagtagctgggattacaggcgtgcaccaccacaccggctaattttgtattttgtagcctgctttttaaacttagcaatatattcggaacactttcttctacaacgtgattggttagtggttgcctaataattggtcatatagcagcaactctgattgtaactaactcttcaggaagtccctgatgtgtgtatgtgctttggaaataaaaaatactagataattatgaaatgatcagctgtttctgacaaatactaaagctagtttattttaatgttgcttgtttatacttcgacattttgcataatactggctctaagttgagtagagaattaagaaatattctgaaggattcacatttctagcaattttaaacgttttgttcacacaatgtaggatttaaaacagtggtagagtgaaaagaacagggactatggagttccatccaagttggaatcctgactacttttatgaacttgagcagataaactttttaatagtttttttctcattctgacttgttttacagtacttcataaaaattatggatttattgcttaactatttaatgaatctctaaaataacatttttctacatagccacaatattatcacacccagtaagattatatttttaatattatttaataccattccatattcagatttttccaatttctttttcactatcctgtacagctggtttgtctaaaccagagtacaattcaggactgctgtttgcgtttagttttatcccttaaatctcttctgatcttgaatgagcaccctctttagtgatattgacttactgagtaggcccagttatcttgagggtataacacctgtgtctgattgtttttatgtgtagtcaccttgttctccctctatttctatgcaaaagcattgattagactcagcataaacatttttgacaaagttatgtcatagataatatgtacttaatatcagtagacatacaatagctggttttcatgataattagagataactcctgtgtttttcccctttggactcatagcagttttattagtaaaatggaagtcattcttaagaattacatgagttggccgggagcagtggctcacacctgtaatcccagcacttgggaggctgaggtgggtgggtcacctcaggtcaggagttcgagaccagcctgaccaacacggagaaaccctgcctctactaaaaatacaaaatcagcagggcgtggtggcacatgcctgtaatcccagctactcgggaggctggggcaggagaatcgcttgaacccaggaggcggagtttgcagtgatccgagatcgtggcattgcactccagcctgggcaacaagagcaaaactccgtctcaaaaaaaaaaaaaaaaaaattacatgagttaagatgttacccagcacacagtattcagtagatgcaagccttttcctacctttctggaagtgggagctgggcaaggggattttcaaagcatagatagaaagtttatcctttttggatattgtcctcacattaaaattcatatgtcaactttaaacttacctcattgtagagagaggacagaccatacttttgttaactattgctgatagcagtaaagtgacaccaggttagcacataagggagggagctaacccagccaaactaggttttcaagacttgaaagttatgatgtaaaaatacaattatttacaggtttgttttgatgctggtccaaagatagtggttcttagttttcaaactcttataatctatcttaaaccatgattggggagtatatgattcacttaagtgataaattgtttaaatgttaaataatttgcactggagtgcagtggcaggatctcggctcactgcaacctctgcttcccgggttcaagcagttctccctgcctcaccctcccgagtagctgggattacaggcgcccactaccacgcctgcctaaggtttttgtatttttactagagacggggttttgccatgttggccaggctggtattgaactcctgaccgcaggtgatctgcctccctcagcctcccaaagtgctcagattacaggtgtgagccactgtgcccggcgagaaatttttttaatgttaagaaaaacatttcaagtcactgtgtttatttttggaaaggatgacatttataatactgatacttttagttcccagttttacatgactagtcttctgccttgcatagtactttaaataggttgcttttctaaatgcataggtaagtaggcagtttaatactactagaattatttatttcactgttacttttcctactgtatacacctcttgtttatccctattcctctcccccttttttttttaaagcttctatgtatataactagtagttgctggttagtgttccttggtttaagaaggtcactgaccactgtctgctggttaaaagattagccgtctttttcttttttaaacaaatacaattcataaatcagcttacccatagctttatttgggagaataaaaacaaagggagggctgacctccctttaaacattactgcttctaaacagttctacttaggtagtatataaaaggaaaccaaatcatttaatattgccatccttctaattttggggaaagtagccacagatgttggctaaaatgtttataataaactgttggcatattttattttgttttattcttcatgattatctcaaacaccaattttgtaaaactaaacatatttactctatgctttctcccatttttaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgtt

SEQ ID NO: 16068 - DNA, 83938 bp, Human
gtggtgccatcttggcttactgcaaactttgcctcccaggatcaagcaattttcatgtttcagcctcccaagtagctgggattacaggcacacaccaccccacccacctaatttttgtatttttagtagagatgaagtttcaccatgttggccaggctggtctcaaactcctggcctcaagtgatccacccacctctgcctcccaaagtgctgggattataggcgtgcgccactgcacctgccctgctacagcatatttgacagattcatactgtttccaaatgtagcccacctgttattagccaagactcacaggaagtgtctttcaggcatggactcatcccatgacatagttacacgagttgtggcatccattcgaatcatcttattacttggcagttctgcatggcctacactccacagcaagctcaggaaaaggtgagatcagtcccattgaagacctcaagttctctgcataaaaaggagaggggccaagaaagtgggtgagagtagataccttttaccacaggtaggaatatcagtagaaaaggtaaggcagtactggagaaaatagctgtatattctgtcttccctcagctccaccccttgctttgctggtctttatatgtgctaatgtttgaaatttgcctataagtaataataatacttataaagtccctttaagaactatatccagagatatctgatgtctttcttctcaaggtggtcatcctcagtctcaaccctggctacacgttagaatgatccgcaaagcttttaaaagcatggatgcagggtctcatcacaagtcaattaacttagagctgagcagacagcgggcagccatcactactgttctcaagagtccccaggtcattctatttttgcagtcagtgctttaagagcagttgtgatgtccacattctctggtgttcccaaaaaggcactgctcttcccacaagtgctgggaagcatgaaatgtgagggggagactatttttcatgggtaggaacaagtttttctgtctcagattctatcttgttgacatgtgtgatgctgagataaggagaccactctttctggtggacgcccttaatgccttcgggagtttacatctcattcttcaaaatgtaccactcggcctataaggaaagccaggattgtaaatgcatttgctcacgtggaaataacctacctagcccatttgcagattaaaaaaaaaatgaagcatctacgtctgtgccatcctttccactaagtgcagttctttactaactttgacttcatgcctccatgagaagcatccacaggcttttttttccccaaaattgcatactccctcatcttccacccaacccctcgagtcttgcaaactaagaactgctgggggtccttcatttttgtttctatttttttgtttttgtttttgtttttgttttgttttgccggaattttgctcttgttgcccaggctggagttcagtggccccacctcggctcaccgcaacctccgcctcccagattcaagcaattctcctgcctcagcctccaaagtagctgggattacaggcacccaccaccatgcctggctaattttttgtatttttagtagagatggggtttcaccatgttggccaggctggtctcgaactcctgacgtcaggtaatccacccacctcagcctcccaacatgctgtgattacaggcgtgagccactgcgcccggcctttgtttccattttcacacagcactgctgcccatcttagggactttagcattcacaggcccattgccccatatctacttgtcaatatgagaaagcaggaggccaagaattacaaaatgattctcctttggttggacttcagtacccaggccacccaaattgacaaaaactctgaatgcagacaaacaatgcttgttccctgtcctctggccctttgcaaataaatgccttaccagacctgccctgccaccccactcgcagccacccagcaagagcagcatgtcagcctgctggagctttgcagttgcaatctgcattttagaaataagcatcctcacagcacagtacacgaccaggtgagtcagttacttttctgcttgtctctggaagtttcctgtaggattagcatctcaaggtcttcttagcagcaaagtacatgacaatgttaatccacatggcaatatacagagccctagaatctaaactttgaaaagagataagaaaatgcatagggtgcatctttatgagttttctgtggaaatgtgctgctgtttctggggatttattttcaacaaggcactcaaatgttaagattgaggtattctttaaatatctggaattataaaataaagcttgttttcaccagtgtatgatgaacctgggtttattagtgcctgatgtctgagaagtttaaaattaaggaaattaatctttccctcactctgcttcaatgcctgacacctttaacatttggatacatcacccttttgcctccacattaggcaaaggttaactattttgtttctttcccttgacatcctgagttgtgttcagaggcatgcattttgtttagggccatttgggatttaggtcatatttcttccattccagaattgcagtgatgcagacctgtcactcatgcttctaccaaagatactttttctcctttttctctgatcctaatcggaattgcaaagcccatggcaagtcatccaggaaacaaatcacccatataataagtttttattgaacagctacactgtacctagaaatggtggaggttagggtcacatgaggcatccttccttccatcctggagtcatcagagtagacatcgacctgtataattcaatacaggatgatccgttctggggagagtactgaaatattcctcacttcaacagtgtggctggggggaaatgtctgcccaagccctgttcctctgctcagacataaccataacctgcttccaattcctcattagtcatttgactcttggtttacccaaatgctgttttgaactttgatgcccgtctccagtacatatttgcctgcctcttggctgcagttggaggccgccattcagcctgggctccactcaacaagtgggttattcacagggctgtatctttcaggagggggcacccagaggtgctacacagatgaacatgggccctggatccagtgctcgaccagacctttccttcatccctcctctttccatattatctgtaaagcattgtaccattcaggaaatatttttgtttagtgggcatctgggcacaaaagggatttggaaaggcagttcctccaagttgctttagctcccttgaacttcacctgaccctttcttaagctaaaaaataataataataattcaaacaacccacattcctagattgcagctcctgctgatcaaaaatgagaggctgtggggaagctttgattgctttgaagtgcgtaccccctgggtcctggccacactcagctgtttcagggaggaccggaaagccccattagctggaccccagctccagcagctgcacggctgagtttggtttggtttcgtgggctcccattgctatgccctcttgagtttgccccggttgccctgctctgaatgctctgtgctttgccctttgacgggggttgaggtcaaaacagagtgttcagagccctcagtcatgaagtgagacgatttgtttgaataatagctaactgaaatttgcaaaataacttttaaaatcctctgaagctagacttcccaggctcaggtcaaggtgcctttacttaccaacagtgtcattttgggcgggttgcttggcctctctgtacctcgcttccctcgtctgtaagatgtggttttatttatgtcctgggactaccataacaaagcaccacaagctggatggcttcaaacaaaagaaatgtattgtctcacagttctggaggttagaagtctgaaatcaaggtgttggcagggccgtgctccctccgatactctgggaagggtccctcctagtttctggtggtggccagcactcccttgtattttattttttggtttcagatcatttcagtctatgtgtctatcatcacatggccatcttcacatcatcttcccattgtgtatgtctttataaaaatgtcccctttttaaaaggacaccagtcatattggattagggcccaccctaacgatgtcattttaacttgattacctctgtaaagaccctatttccaaataaggtcccagtcttatttgacacttaggaccaaataattatctggggttaggacttcaacatacctttcagggttggcgggcaggcacaattcaactcatcacaatggtaatgatagcatctgtctaataaggttttcgttgtgaacattaaacaggtatacatgtaatgtccttatgacatctgtgcctggcgcatggtaagaacttaataaatgccaggtatttaaaaaaaataataaccttcctgtgctttcactttgctatctttcttgtttaggacggaagggttggaattacagctagccttcagggctctcccatggcttgaagacatctcatgccacagctacagtgacctattattactggagaactgtcagggatttctaactattgtttttttcttttttcttttatttttttacaaagattaatgtgcccatgagaactggccatgagggggacatcatctcttatgtttctcaaggtagagcatcaatgtttaaaaccaccatgagagtagaatagtagctcagagcgttgcttctggagccaggtggcctgggttcgatcccagctccacaatttactggctctgcgccttaagtaaattccttaacttctctaaacctgtacctcacctgctaaatgggaataataatgtgtcctgctgtgaggaatacctgagataacaaagacaacatgcttagcacagtgccaggcaaacaggaagtgctctgtgagtgtagctatcattaccttttctctctaacttgtaaataacaaaatatgcacatggttcaaagatcaaaaataaaacaaggtatacattgagtatcttactttccctactcataactttccgtgagatttgtgttattatatgtaaagtatatataaagagtttaaaaacacttcttcgctcccacctcatcctacctctacaggttgtcacatatataagtttctgagtattcttccagtacttattttgtaggttaaaccatagactcatacgtaatcttattctctcccagtcttttgcaaatgatatcatattatatatactattttttactttcttttactttcctttttttttttatttacttcatggcatgtcctggataactttctgagtcaatatgtgggaacttcctcattgtcatagctgattaattcttactgatgaacatttgggtgtttccaatctttcgcactagaaataatgttgcaatgaatatccttgtttatatatcattttgtaagtggttaggtgtacctgaggattaattcccagagtgatctgagtcaaaagataatcactttgtgacagtgctaaaattgccctatttgtattattttgcactttcaccagcagagtaagagtacttgtttctcacagccttgcgacaggaaccacaggccaaccttttgatatttgtcaacttcataggttaaaaaaaaaataggtattttggcacggttttaatttgcctttctcttattgagtcagattgcacatttttttcatacattgaaaggccatatatatgtttttcttcgcgaactattcatttcctttgtccattgttctattgagtctcctgtctttctcttacatatttctatgatcacttcataaattagtctttgtctctgatatgaattacacatatttttcccagtttgtcattcttcctttgactttatgtggtatgttttagtggagttactttcatatttaatttattcttcactttttaaataactaaggagtactagattggggtttagaaggcctgaaagtgactagttacctgggctctggagagaagttgtccgggtttcaattccaactctgccaccaagtagctgctgtctaatctgagggcaattccttaccatctctgtggctcaggtcctcatctttaaagtataataataataataatagtagtagatatctaagggatgatataagaattaagtgagatgataaatacaaaggcttaagggaagaattcgtgacacatataagcactcacaaatgttagcaactattatttaatttattttaattcaatttatctcaacaatctggaaaaatatccaaacattcattaatagaaaagttttggatatctaacaaaccaaagatatttaaaatgtcactttttcctcctactttggttatatttgcctaagtttttcatttttatattccatgcaagtgaacagatatttatttatgaactacatttggccaaataggataatttgtgtatttgtccatttaatacagcaaacagttatcaactttgtcgaatgagccagacgttgtgtcaggaattgcagtataatgttgaacacattacggagggtccctgccctcactgggcttacaatctagtgaggaatgctaacaaggaaatggcaattacaactcagtcaagttcccttgttgcacctcagccaagtgaggcctgtgatgctcctgtgaagcttcaccagtccacttgcataccagcttcctctgctctagcctaatcgagcactttgctccaataatgctgccacttttctcctgcagcatcaatacctcccttttactgaatcaatctcaatgacatacaaacatattttaacttaaaaaaaaatggcacatttctccactttactctagacccactcccttgcatccggtctcgtggtatgaaataccctcttatattctgacaacatcacatctatatctatggtgaaacgccacttatacgccgacatccccacatctatacctatgatgaaataccacttagactctgacaactctcacatctgtatctccagtgcaattgtttccctgagcccagtgaccaattgcttagtcaacatctcttcttgaaaaatctagtaggcatcccaaacataacatgtctggagaatacctattgatttctgtactcgtctctacccaccctgcaccaccattctccaagttacttagattaaaacctgggaatcatacctgagacctctacgtgtgtcattcccacttgcaacttaacagtgagtcctattggtactacatatatatatatatatatatatacacacacacacacatatatatatacacacacatatatatatacacatatatatacacacacacacaatatatatatatatattttttatttatttatttatttatttatttttttgagatggagtctcgctctgccacccaggctggagtgcagtggcgcgatctcggctccctgtaagctccgcctcccgggttcacgccattctcctgtctcagcctccctagtagctgggactacaggcgcccgccaccacgcccggctaattttttgtatttttagtagagacagggtttcaccgttttagccagggtggtctcgatctccttacctcatgatccacccgccttggcctcccaaagtgctgggattacagacgtgagccaccgcgcccggcccggtactatctttaaacatatcccaaacctgattgcttttcgctatctccatgggcacgactcactccagcccaaatcactattatttcttgcctgcctccatttttgtccactccccagtagtcaattctccatccagcaaccacagaaatcattggaaaacacaaacttgtgttacttctgctctccaactcttctaagtattcctagcaagctcagaatcaaatccaaacacctgtccatggcctacaaggtggagctgcacccttccctgttccccagggcatttgcactctctttttggctcactctgctctaacaccatgcttgctgtgcctccaacatgccacatcagggcctttgcacttatttttcccttagcttggaaaactttatccagaccctcacagagcttcctctctaaattcattgaggaccttaatggactatcaccttctactctctttttgttttgcttttttgctgtgtaacaactcattccaaaatagtatcttaaaagaatagcaattatttcttttgctcataaatccaggggttgcctgggctcagctgagcggttctcatggacctcccacataggtgtagtcagatggtggctgcagctggggtcatcttgatggcttattcactcacatgtctgtcacttgggctgggaagactcaatcagctggggagctgaacaactgggtgtctttaggaatatctctctctctctctctccaccccatgctcgtaggtggcttcgtacacagtggtgaaaggctttcaagcaaatatctttagataaaccagcagaatttgcatggccttttgtaacccagccttaaaattcatacagtgttacttcctctgccttctactcatcaaggctgtcacaaaggcccagccaacttcaatagaagcacacataaaccctacttttgatgggaagagtgtcaaagaatttctggacatattttaaaagcaccacaccacctgcgagaggattctttcactgccctccctcccaactccagtcctagggcagtctctatcctcttacccggtctgctttgttttccttcataactcacatgtcttaagaaatattgcatgttgtattttctagcatacttgcttattatatctcacccactagagtgtaggcctcatgatgacaaggacattttctgtcttgcaaccttagccactagaacaatttccgacatgtaccagttcctcagtaaaggttggtgacccttggctcatttaaagcacatgagagaagctctgaaataagacttgagaaatcaggaaaggttcgttaaaaacttaagtgtttgacactgctgttatattatcttttcatcttgacgagttgcatgaactaaagaaactgtgccaaatccattggttaaaaatgtagtcctaattggcttatatttctcccctcaaagaagccacattatcatatttattgaccaaaagattccttcataaagtaagtgctttcctgtctgggcctaccacaaagtatcctggaatttgaggtgctactgaggctttctttttctaaaactggaaacttttcttcatggcaggataataggaccaggcgtatatcaatgactcttcatttgatgcatttctggcccagaggtagatctcctgccatgttgatgtacatcactttgatctaggaagtgactttcaagctgagattgaaacacttggagatacgttttatttgataaacacatttcatctaagaatccagaaagtgctttacaaatacttctccactcagcctaatagcacagcagggtaataggcaggtggtaagtgttgtacatatgcagtccttgaactacaaaagatgatctgctgagtgagttaagtgggctgaggagggggtgttgggctcaaaggatgaaagacagaagaagctattcaagatcacctatgttctttcttagtatttatgcagcatattctttcaataatatattctttttgcatgacttgttattctctgctaaaaattcccatgagttctgccttcactgtgcttccagtgagccaggtagctggcacagtgaaggcaaaacaaccaggtgttaaaacaattttcaatttatttttgcctaatttgacatcatttaggtgtaagcttaaagtaggtccaggcaagcgtcaggctgtcccactgacgtgctttgcctggggctgctatatgtttaaaaatacttgcattcttgtccacttgctgtatctcaagatgtctaaaaggcatgaggctattagatgcagaagttactaaatatgctatgaccactcagcttatttcaaagaggatttaggtttgggggaaaaagccagcacaggagacagggaaacattgcactgaactaagagctaagagttgtcgagtctagacccagttttctactaactgttcaactttggataagtagtgtaattctccatttttagtttcccatctataaaaaagaactagtaatgcttacaaagtttaccaagaaaaggtagagtaaaggttaatgagaaaatgagctttgaaaattgtctagtaaaatgaatagacaaatataagggtttacttaatcaaaatcatttatgagtgttatgggctgatctccccccatcctctgccactaccaccaccatttcatatgttgaagttctaacccccaatacctattaatgtgactgtatattcagttaaggcctttaaaaaggtaattaagttaaaatgaggtcattagggtgggccttaatccaatacgactggtgtccttataagaagaggaaatttgaacacagacaccagggaaggccatgtgaagacacagggagaagatggccatctacaagccaaggagtgggacctcagaaggagtcaacacaaccatatcttgatttcagacttctagcctctagaattgcaaaaaaataaatttctgttgtttaaggcacccagtctgtggtactttgttatggtggccctagaaaactcatacactgagcttaacatccagagaatgtaagtcctagtcccagggcaagagagtgatatgtaagaaccttcctatggtgatagattgaatcattcaaagaatgaattcaagtcacagtccgggagagcaataaaagataaaaggcaaagatctggtgctttctattaagtcccaagcgtgagtcatacttttaataaaaaaaaacaaaaaggagtccttgggttagaagctaagaaggaagtaaataagtgtacacatagtcaacgaggtcctattattattgcaaatcatgttagagaactgtctagaggtaatgccagtatcattggagcagggtctagtcacttacgtgtgggaaagatgaatagccctggttgggttctagatttatccagtaatggactgtaactcactctggagtatttgcagtgagttttaccttccatgcatgattctccagtctgtacagtatcctctgaaccagcattcactgaggcttgtctgagtggcaggtgagaaagatgaggtttctggaaccaaggaagtaatctatcttggggaaatgttgaaacaaaatgttaacatattcatctaagtaaacgacaaatacaaaagtaatagacaaaaacagataatccagttcaaggcaacaacagcactaacactggagaaatcagacattaaaaagattcatagaaatgttaatagagcctagagcaattcctgaaaccaatgatgttccaatgagattcctttacctcctagtgtaatttagttttctatgtacatagcatcttgtctcatatttcatttaattaagtatttactcacttattcactcatttattcattcatcaaatatttattaatttcctattattagctatgcagggggttacaatggtattcaaaataacaaaacaaaacaaaaaccatgatcctcaaactaactagctagagtttacattctagctaaaaatatcagtgagcttggggacatttctgttttgttcagcttgaatatcaaatacctggaacatagtaggtactcagaaaggataccagctcagtgacaattttaggtctatggtggtttcaatcttgggtaatgatataatgagtactcctacacctacttgaggtccacccttcagatatcatggatttccaccagatgttgctaagcagtgtttctcaacattgtttgaacatgagaatcacctgggtaactttttaaaaacattgatgcctagagccaatcctcagagagcttgatttaatcagtatagaatggggatcacaattttacaattcctatttttaatatctaaggattatgatatgtacttggtattgagacccactgctatagggcattaaggtgtatgtgctattgcctcttgatgtggcctgtcagttccagatgaggctgtagttttatggaaacattccagcagagaatttcttagtcatgtggtttcagatatgcactagtactcagacttccaagaaagcaggttcttctagacgttttggcatcccatgtaatacatttttagcctgcaattttagaagatgaagctcatcacacctccagatattctggaaggtgtaggcaagggccaggcttacaaaaatgccacctccagccaggaagcctgccttgcaatccttgctcaaaaaccatgtggatgattccccaggagatcacaccctagagagatacaggcctagatttggccaaaaccccatgactaaggacttccttcctcctctttcaattattcaattattcatttaaaaaaaaacccttcctgagtacctattatgtttcaggtatttgatattcaagctgaacaaaacaggaaagtccccaagctcactggtatttttagctaaaatgtaaactcttactttggggatcatgttttttgttttgttttgttttgaacaccattataactcccatgcttagccaataataggaaattaatatatatttgatgaatagataaatgatgagtgaataattaattcaatgaaatatgagaacaagatgctataagaatatgtatatagaaaactaaattacacggggaggttaaggtggattcccagaaaaatataatgtgtgtccaagatgagatcaatgtagtgaatagtgaatagcatggttaaaagcctgaagacatgagaaaaagtggcttgtcttgaaattttaatgttcagtgtagctggagcttaagtggagtaaagtaaagttggagaattaggaaagggataggccatgtagagctctcaaggcattgtgcttttgtttcctatcacagctgtaacaaattactacaaacttagtggcttaaaacacaaatttattatttaacagatctagaagtcagaaaattgaattaggtttcactaggctaaaatcaaggtgttggcagggccagattcctttctggaggctctaaagaaaaatcatgtccttgctattcccagattctacagctgcctgtgcttcttggctcattgccctcttcttccatcttcagagccagcaacagcaggtggaatcccttttcatgctttgaatttctcctgccttttctgtcttcacatctctctcacccactcttctcctttaaagagcccgtgtaatcagagtgggcccaacaaaataatacaggatgatctccccataatcacatttccaaagccccctttgctgtgtaaggcaacatattcacaggtaccagcaattggaacagggatatctttgagagtcgttattctgcctattgcattatgttaaaaaaaaaaaaacaaaaaaacttagacttcatcacaagagtggtgggaagctactgaaggtttctcgtaactgaatgataagatcaaatttgcatttttaaaagacccctctggatgccttctggaaactgaattagagagtaatttttgtagtcatctaggagatatataatgttggtgtagacaagaaaaacatctgaaagagatgaagagaatggatgggtttgagaatcatttacaagactgtaacagcaaatttttgtggttgactagatggcatagatgaggattggagtgcaggatgagacaagtagcaccaggtctctgattagaatgactgcataaatggaagtgccatttgccaagacaataaatacaagggagaagcatatttgagaggggagaaaaattaacgcactcatttgggaatgcattgagttcagtaagtcatgaagaccttcaagtgcaaggtccaattggaagttgtattcaaaagtttaaagttcaggagagatgtctgggctgctgacttatctctgggtgtctgatatggtttggctctgtgtccctacccaaatctcatgtcaaattgtaattcccatgtgttgaaggacaggcatagtgaaaggtgatttaattatgggagtggacttcccccttgctgttcttgtgatggagttctcgtgagagctggttgtttagaagtatgtagtacttctcccttcactctctgtctcctgccactatgtgaagatgtgcttgcttccccttcacccttccaccatgattgggtttcctgaggcctccccagccatgcctcctatacaatctgtggaactctgtgtcaattcaaccttttttctttagaagttacccagtctcaggtagttctttatagccatgtgagaacagactaatacagaaaattggtaacaagagcgggacattctttaaagatacctgaaaatgtggaattgactttggaactgggtaacaggcagaggttggaagagtttggaggtctcagaagaagacaggaagggaaaatgagagaaaatttggaacttcctagagacttgttgagtgatttgggccaaaatgctgatagtgatatggacaatgaaatccaggctgagatggtctcagatggagatgaggaacttattgggaactagatcaaaggtcctcttgctatattttatcaaagagactggtggtattgtgcccatgctctaggaatctgtggaactttgaacttgagagagatgacttaaggtatctggtagaagaaatttctaagcaacaaagtgttcagaatatggcctggctgcttctaaaatcctatgctcattcgcataagcaaagagaacttatatttaaatgggaaggaatgtgtaaaagtttgggaaatttgcagcctgaccataaggtagaaaagagaaactcattttctggggagaaattccagccagctgcagatatttgcaaaaataaagaggagccaaatgttaatagccaagacaaaggggaaaatgcctccagggcatttcagagacctttgtggtagccccttccatcacaggcttggatatctaggaggtaaaaatgatttcatggactaggcccagggccccactgctctgtgcagccttgggacatgacaccctgcatcacagctgctccaactccaactgtgcctaaaaggggccaagtacagctcaggccattgcttcagagggtacaaacccaagccttggtggcttccacatggtgttgggcctgcaggtgcacagaagggaagagttgaggttggggacctcaacctagatttcagagaatgtatagaaatgcctggatgtccaggcagaagtttgctatagggacggtgcccttgtggagaacctctacttgggcaatgtggaggaaaagtgtcaggtttgagcccctgcacagagtccctactggggcactgcctagtagaactgtgagaaaagggccaccatcctccagaccccagattggtagatccaccaacttgccctgtgtacctggaaaagctgcaggcactcaatgtcagcccatgaaagcagctgcagggtctatacaggcagcggcacagaagcagagctgctccttgcatcagcattccctgaacatgattagtggagtcaaaagagatcattttggagctttaagatttaatgactgtccaactgggttttggacttgcatggtgcctgtagcccctatctcttggctgatttctcttttttggaaagggagcatttaccctatgcctgtaccttgggagtaattaacttgtttttgattttacaggctcataggcagaagggacttgccttgtctcagatgaaactttcaacttggactttttagttaatgctggaataagttaagactctaggggactgttgggaaggcatcactgtgttttcaaatgtgagaagaacatgagattttggacaagccagggtggaatgatatggtttggcactgtgtccccactcatctcccacgttgaattgtaatccccacatgttcaaggaggagcctgtcggaaagtgattaaatcgtggggctggacttcctttttgctgttctcatgatggagttctcatgagacctggttgttaaaaactgtgtagtacttcccccgtcactctctctctcctgatgttatgtgaagatgtacttgcttacccttcacccttctgacatgattgtaagtttctgagaccttcccagtcatgcctcccatacagcctgtggaactgtgagtcaatcaacctcttttctttataagttaccttgtctcaggtagtcctttatagccatgtgagaacagattaatacagtgtcattagcataaacatgaaaaccaaagttctggtgaaaatatagagaaaaataagagagagagagagacatccaaggaaaggatctcgagggaaaattagtatttcaaggactatcagaagaagaggcgcctgcataaaagagtaggagtaccaggcagagaagaaaaaagaaatgaaagaaagaccctataatccaagagaagagagtgtcctgaagagcaacagtggtgaatacattgaatgccatgaagcagtcagtaagataaggactgaaaggaacagtgaggcacatggcagtcatcacggagttgggcaagagcagcgttcacagggcaggagggttgagaagtgttgggatgtaggaaacaagagacgagggtgctcactactttctcaagaaacttggctaaaagaaaagagaatttagaagtaactaaaagggcatgtagagtttgaaggagataagacttgttctttggatgtcagaaagacataaatgtgcttccagcatttattctaagaagtgttattgtgaagggcaggagggagatggtagtggttggaagaaaatgtgtaatcagggatggtgcatgatttgttcattccttggctttttatgtttaatatcacaagcttgaacactttatattacaaatggaaaggagatagtagagagggagagtttaaaaggaaggagatattcaatgaatcagagtctctaaggggagctgggatctagagaatttgaggagagattggcatcacctagtcttttctgtgttttttttttttccttttttgtttattatactttaagttctagggcatatgtgcacaacgtgcacgttggttacatatgtatacatgtgtcatgttggtgtgttgcacccattaactcgtcatttacattgggtatatctcctaatgcgttccttcccccctcccccccaccccacaacatgccccagtgtgtgatgttccccaccctgtgtccaagtgttctcattgctcaatccctacctatgagtgagaacatgcaatgtttggtttttcgtccttgcaatagtttgctgagaatgatggtttccagctttatccatgtccctacaaaggacatgaactcatccttttttatggctgcatagtattctatggtgtatatgtgccatatattcttaatccagtctatcattgatggacatttgggttggttcgaagtctttgctattgtgaatagtgccacaataaacatacgtgtgcatgtgcctttatagcagcatgacttataatcctttgggtatatacccagtaatgggatggctgggtcaaatggtatttctagttctagatccctgaggaatcgccacactgagttccacaatggttgaactagtttacagtcccaccaacagtgtaaaagtgttcctatttctccacatcctctccagcaccagttgtttcctgactttttaatgattgccattctaactggtgtgagatggtatctcgttgtggttttgatttgcgtttctctgatggctagtgatgatgagcattttttcatgtgtctgttggttgcataaatgtcttcttttgagaagtgtctgttcatatcctttgcccactttttgatggggttgtttgcttttttcttgtaaatttatttgagttctttgtagattctggatattagccctttgtcagatgagtagattgcaaaaattttctcccattctgtaggttgcctgttcgctctgatggtagtttcttttgctgtgcagatgctctttagtttaattagatcccatttgtcaattttggcttttgttgccattgcttttggtgttttagacatgaagtccttgcccatgcctatgtcctgaatggtattgcctgggttttcttctaaggtttttatggttttaggtctaacatgtaagcctttaatccatcttgaattaatttttgtataaggtgtaaggaggggatccaatttcagctttctacatatggctagccagttttcctagcacaatttattaaatagggaatcctttccccatttcttgtttttctcaggtttgtcaaagatcagatagttgtagatgtgtggtattatttctgagggctccattctgttccattggtctatatctctgttttggtaccagtaccatgctgttttggttactgtagccttgtagtacagtttgaagtcaggtagcatgatgtctccagctttgttcttttggcttaggattatcttggtaatgagggctcttttgtggttccatatgaactttaaagtagtttttccaattctatgaagaaagtcattggtagcttgatagggatggcattgaatctataaattaccttgggcagtatggccattttcacgatattgattcttcctatccatgagcatggaatgttcttccatttatttgcatcctcttattttgctgagcagtggtttgtagttctctttgaagaggtcctccacatcctttgtaagttggattcctgggtattttattctctttgaagcaattgtgaatgggagttcactcatgatttggctctctgtttgtctgttattggtgtgtaagaatgcttgggatttttgcacattgattttgtatcctgagactttgctgaagttgcttatcagcttaaggagatttggggctgagacaagggagttttctaaatatacagtcgtgtcatctgcaaacagggacaatttgacttcctcttttcctaattgaataccctttatttctttctcctgccttattgccctggccagaacttccaacactatgttgaataggggtggtgagagagggcatccctgtcttttgccagttttcaaagggaatgcttccagtttttgcccattcagtatgatattggctgtgggtttgtcataaatagctcttattatttttagatacgtcccatcaatacctaatttatagagagtttttagcatgaagggctgttgaattttgtcaaaggccttttctgcatctattgagataatcatgtggtttttgtctttgtttctgtttatatgctggattacgtttattgatttgcatatgttgaaccagccttgcatcccagggatgaagcccacttgatcatggtggataagctttttgatgtgttgctggattcggtttgccagtattttattgaggatttttgcatcaatgttcatcagagatattggtctaaaattctctttttttgttgtgtctttgccagactttggtatcaggatgatgctggcctcataaaatgagttagggaggattccctctttttctattgattggaatagtttcagaaagagtggtagcagctcctccttgtacctctggtagaattcagctgtgaatccatctggtcctggactttttttggttggtaggctattaattattgtctcaatttcagagcctgttattggtctattcagggattcaacttcttcctggtttagtcttgggagagtgtatgtgtccaagaatttatccatttcttctagattttctagtttatttgtgtagtggtatttatagtattctctgatggtagtttgtatttctgtgggatcagtggtgatatcccctttgtcattttttgttgcatctatttgattcttctctcttttcttctttattagtcttgctagtggtctatcaattttgttgatcttttcagaaaaccagctcctggattcattaattttttgaagggttttttgtgtctctatgtccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactcctttgaatgtgtcccagacattctggtatgttgtgtctttgttctcattggtttcaaagaacatctttatttctggcttcatttcgttatgtaccctgtagtcattcagaagcaggttgttcagtttccatgtagttgagtggttttgaatgagcttcttattcctgagttctagttggattgcactgtggtctgagagacagtttgttataatttctgttcttttacattttctgaggagtgctttacttccaactgtgtcgtcaaatttgagataagtgcgatgtggtgctgagaatgtatattctgttgatttggggtggaaagttctgtagatgtctattaggtccacttggtgcagagctgagttaaattcctggatatccttgttaactttctgtctcactgatctgtctaatgttgacagtggggtgttaaaatctcccattattattgtgtgggagtctaagtctctttgtagatctctaaggacttgccttatgaatctgggtgctcctgtattgggtgcatatgtatttaggatagttagctcttcttgttgaattgctccctttaccgttatgtaatggccttctttgtctcttttgatcttttttggtttaaagtctgttttatcagagactacgattacaacccctgcctttttttgtttttcatttgcttggtagatcttcctccatccctttactttgagcctatgtgtgtctctgcacataagatgggtctcctgaatacagcacactgatgggtcttgactctttatccaatttgccagtctgtgtcttttaattggcgcatttagcccattttgcatttaaggttaatattgttatgtgtgaatttgatcctgtcattatgatgatagctggttattttgctcattagttgatgcagtttcttcctggcattgatgatctttacaatttgccatgtttttgcagtggctggtactggttgtttcttttcatgtttggtgcttccttcaggagctcctgtagggcagggctggtggtgacaaaatctctctgcatttgcttgtctgtaaagtattatatttctccttcacttatgaagcttagtttggctggatatgaaattctgggttgaaaattcttttctttaagaatgttgaatattgcccccactctcttctggcttgtagagtttctgctgagagatctgctgttagtctgatgggtttccctttatgggtaagctgacctttctctctgactgcccttaacattttttccttcatttcagctttggtaaatctgacaattatgtgtcttggagttgctcttctcgaggagtatctttgtggcattctctgtatttcctgaacttgaatgttggcctgctgtgctaggttggggaagttctcctggataatatcctgcagagtgttttccaacttggttccattctccctgtcactttcaggtacaccaatcagacatagatttgatcttttcacatagtcccatatttcttggaggctttgttcatttctttttatccttttgtctctaaacttctcttctcacttcatttcattcatttgatcttcaatcactgataccctttcttccagttgatcgaatcagctactgaagcttgtgcattcatcacgtagttctcgtgccatggttttcagctccatcaggtcatttaaggacttctctacagtggttattctagttagccatttgtctaatcttttttcaatgttttagcttctttgcattgggttcgaacttcctcctttagctcagataagtctgatcgtctgtagccttcttctctcatctcatcaaagtcattctccatccacctttgttccattgctggtgaggagctgtgttcctttggagggggagaggtgctctgatttttagaattttcagcttttctgctctgtttttcccccatctttgtggttttatctacctttggtctttgatgatggtgacgtacagatgggggttctggtgtggatgtcctttctgtttgttagttttccttctagcagtcatgatcctcagctgcaggtgtgttggagtttgccagaggtccactccagtaccgtgtttgctgggtatcagtggcggaggctgcagaacagcgaattttgctgaacagcaaatgttgctgcctgatcgttcctctggaagcttcatatcagaggggtacccagccatgtgaggtgtcagtctgcccctactggggggtgcctcccagttaggctacttggggatcagggtcccacttgaggaggcagtctgtccattctcagatctcaaactccatgctgggagaaccactactctcttcaaagctgtcaggcagggacatttaagtctgcagaggtttctgctgccttttatttggctatgccctacccccagaggtggactctacagaggcaggcaggcctccttgagctgtggtgggctccacccagttcgagcttcctggctgctttgtttacatattcaagcctcagcaatggcgggcgcccctccccagcctcgctgcccttgcagtttgatctcagactgctatgctagcaatgagcaagtctccatgggcctgggaccctctgagccaggtgcaggatataatctcctagtgtgctgtttgctaagaccgttggaaaagcacagtattggggtggaagtgacccgattttccaggtgctgtctgtcaccccttccctttggtaggaaagggaattccctgaccccttgcacttcccgggtgaggcgatgccttgccctgcttcagcacacactcagtgggctgcacccactgtcctgcccccactgtctgatgagccccagtgagatgaacccggtacctcagttggaaatgcagaaatcacctgacttctccgtcactcacgctgggagctgtaaacgagctgttcctgttcagctagccttttctgtggtttaagaggcctaactataggaaggatcagtgtcaggtcaggcaagtagaggtagggaatttgtaggattcttgttgggtggtttctggttctgatgtgttttcttttttttgtaattatcctgggtgatgtttcaaccagaagagactcaaatggtgaaccaacggagaaaggaaagttcaaagccagaaaagccttgctgagcagtgggcctaggggtggaaagggaggcataagtgccaaaatatatgatgttaaaactcagaaagatcaggaataagtcctgaagtgaagtgtgaagtggcaaggcatccagtttagggcatacagaataccagagaggggaaacctgatttatgaggtgcccgctacaggaatggctgggcctgggctggctggcttaaatttgcaagagaatgaggtaacttagcctcaccagattcttgggaggggtggggtatggtggatgggaaggaagacacacaaaaaaataaaatcagatttctggcttcattatgttcataatctagttggaaatataagattaatctatgtaaaacacctggaaagatgctttgctagttttcctcattgccgttgttttgttgtttcaaatatttgcattcctgggaagttaaaagttaacttacaatacagacaagaattaacaaaaagatgagttgaaaatacaaaacagcatgcaattgagggtgaaatgagagatatagtaaaaagataagtggtataatttgagaggggataaagtacaaaatgaactgtgtttatgaagacttcttggaaacagatatacacaatggtcattataaactgggatgttctgttatcttagttatgacccagagctaacagaaagcagtggctctgcatcacacatagactgcagaatgagcccctggagtgaatggtcacaatgcgatccttgtctcagacaaatggtaagtgttcatctcccttccccactgacctccccaaatggaaactgtattgctagcctctccagaaaaatgattatgaggcagggagccccacaactgagttccaaacccagaaagagagataaacatttaaatgtatgttgctaacttttccaggaaatctttatgttgtacagaatactaaatgagtgtccagaggaatcatctgtataagaggctgccaaacctagaatgcagagtgttaccctaaataacatcagtgacttcttccaccacttctatcttaaaaccattgactcattgcagggatatagttgtatggatgcacctttagaccataccctttttttggcattagaaattctaatcattccaactgatattgtgcagtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggtaatctttgtgcttgaattgctcattgtggctttctgtgtgccttcctgaatgaaaagaaaaaaaaaagcatatgcttctggacacttggatttccaagcgtgaaaggccccaaaagaggccatctatatattctgtacaaagaactcaaatgtgtttttctgatacctcacctccagggttaaaatgcatttgataacttcagaaagaaagagaaaatttgacattagatacattgagtctctcctgattttgattgcaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggtgtgtattttacttgtactttttcagatgaaaatgagtgaaaatgatctccatctctctcattgtgatagactggtagaagcatttgtgcgagggacataggtgatacagctgatgggtctgtattatttttgaactacctttaagcttaaaggaagtgctaaataagcatctcaggataatttggacaaattgcctgccctcagtaggggtctgtagagtggactagatgatcaagatgttagataattgtctctcagtggagcaagagatgaaatctctcatttaggaacctctgggagaccacagcaacattgacatgatatgttaacatttggaatgaatttccaatacgagatctagcaattcaattcaaatatttgcattgctgggaaggctgtcttccattggaacttctcctggatcttgggagtttccagcattctggagctgacccaggaggaatgtgatcagaggaagtagttttgatgccagaggatgattatgttgaggttctggttctcattatagagagctgacatttcactcattttccatacaaaacctaggggctctggacagatggctgtaagctcagatgggatgtcttggagtttagaactcaggattatacagaatagagactatatgcagagagattcggttctattctgttctgttccatatatagtcagagggcatcctaggaatatctactacacagcctctcttactcactctgagctgtttttggtaaaggtggatttgttgctatttttggtaaaggtggatttgttggaaaattgtccccaacaaagacatggtcattcttccacccagtagtatattgaaagagatggtatatggctttatttcctcacctataatgtaatgtgtctctttatgctcataattcctgtgcctgggtcatagtaggtgctcagtaaatacttggtaggtggatacattggctaattattaattaatgaatatcctttaactactttctaaaatattgtcaattggcatcatgtaagactgaatttcttttcccggataggactccagtcccgggtatggagatgaggagaggaaaaaagacaggggtgatggtaagagcaaggctggtagaagggtaaggcagtggttctcaatcagtggtaatttttcccccagcagacatttgacgatatctgcggcgggtcacgcctgtaatctcagcaatttgggaggccgaggcaggcggatcacgaagtcaggagatcgagaccatcctggctaacacggtgaaaacccatctctactaaaaatacaaaaaatcagcagggcatggtggtgggtgcctgtagtcccagctacttgggaggctgaggcaggagaatggtgtgaacccaggaggcacagcttgcagtgagccgagatcatgccactgcactccagcctgggcgacagagcaagactccatctcaaaaaaaaaaaaaaaaaaaaaaaaagagagaaaagacagtatctggagaccattgtagctgtgacatcttggagggggtgagaatggggagtgctattggcatgtagtgggtggaggccagagatgatgctaagcataggacagcctgacccaaagcgtcagtgccgaggttgagaaaccctacacaaagttactaggcagttcctatgataagacctctataaagtttagctaatgaaggagatgtctcctctctctaagccaaatgaaacttctacttcttaaatctaggtaagaaaaatatcccaggataccaagagtcaggcaccagataaagcatttcacgtgcccttcatgcactttataaaatcttgttcaagcagcattcaaaattacttacagtgcctttggcccttagcctaaaggtgggaatctcaaatcaaatggatggtcttaggcccctaagttctgcaggccctcttagtaaattttaggcagtaaatggcatgggagttttcccaaatcttataactagatcatggtgtgctcaaatggtcctgattctttttatttatttcctcagggaaagattgtgagtccatggtgaaagcccattactactttattttgctttaattgggatccaagaaacaactttctttttaatctaaataaaacagcttaacatatgttatttattctcattcaatgcaaatttatagtttgtcttataggaaaagaatatagaaatattggcccatttagctgaaaaacaatcattcataatctattggtttcctttgttcagggaaaagaaaaatttgttgcatagcatttgtcagagagtttcataatgaagcagggctagctaggaattcttaaatacctcacgctttaccacagtcagggttggtgttaggaaccatcccacagctgagtcttcaaggctgtgtaagaaggtggtgccctagctatggggaaaggtcagctgcagaaatggaaaatgaagtaggtcttgatagaatcagtccatcaacattttttaattaaattccccattaccatgagtaataacctatgttaaatttagtcttcatgaaacctattgttctatgacgactttcatttgcataatactttaaacttttcaaaatatttttccacactgtatctccatagattttccaaataatactgggagattgttagaggaggtattatattcattttatagataagaactgagtgaaataaataaggccatttgactgattagttctagtagagctgaaacaagtttctctgagtctcataaaactatatttttctaccataccaccttaccctctcctccttaaaaccccaaccaacacccacagcggttccctcacatcactacaaaatccgtaagtcttaacttcgacaccttaacttcaaagcaaaactaaccttaaaaaatgaaactccttaagtagctacttatcacacaaatatttgaattaaggaatataggagagtggtataaatcagtaattaatatttaggaagaggtttcaaaacaacatatattgttatatttgtaatattctttcataccattaatgttgcatgtttactcactacaaacctccagtattcttatatggagctgtggattctttgtgaaatagaggtaataggagtacactccctaatcatagcaacatgcttataaactacatctacccaattcattctggacaacctcaaaaagtcctatcaatagtcacatacagttagattcttctacatgtgaaagtcacaagcactcatggtaattaatttatactgttttcatttgaaggcctctcacatctatgttcttatgccaggagaattgagttgtatcacaaatgtttcagcctcttatttgtaggcatctgagattctccagaagtgtttggggaaatcccccaacccatcttgcattcattgaaaaggcatacatccagccagctgtaagtgatatgcaaggaattattttttgtgatctaagcataacaccacttctgtgaagggagctttctcttcagttcacctggtaaattggaactgcccgtggttctagatgcaggtgtgaaagcaggcatctataagcactgccaaagaacatattctttttttatttcccaggtgatgactttccatccatgagaagtgttcatgtttcttggcagaaaaaattggcttattctggactagactggctgtctctgtagtagtggaaccaagtccaaagcttttgaaacatttcttcctttgttgtgctttagactgtggatcaacttcattttaactttccagatgggtccagccaactggccaatttgatgatctataaaacaataaccttcaaactaggatatgcataccatggggtgcacaaaaactttccaagggcagacaaataagtcttaaggtaatagtttcctcaactattaattatgtagctaagctaatagtaaatcctcaacttccatacgtacatgtttttcacaaaattaataagcatgacaattcagctgcattcaagctgtcaggcccattctcctttcttgcttttttaaacaatcacttacttcttactttttaagagcagagtatactcctcacccatctcacactcacattttactatagagaggaaaaaaaaaacaagacacaactccaaatgttagcactcaactggactctgacaccttgaagttttgtgatctctaattctttttatcaacactgaaagattacctaatcaacttttagataatggagcataaaaataatttttgatgaaagatcactaactatgggatctctttttggtatataactcagaaaaagggattaaaattgtgtgacattgttataataaaatttcttttattcttatctacttatttatgtgagtaaaacttctcagcacttacaactataaaaatgaaaagtaggactcaaattgatactgaacactgtctcttcctagcaccatgaatgaatgaatgaagtaatattcattcatggatgtgggaaccaacatattaatttaaaaagaagactcattcatttcattaagatagctttccaataaaattttacttacagtaatgatttttaaaaatttaagatacctatatatggcactattaataaagaatttttaatacttagaccctatggtcaaagagtatttaatatttttaaatttcaattaatatctttttggtacagaaaagtatgacaagacaatcaataaaaactttaaaaaataaactatattacattaggttaaaattctgtgagggaaatggaatagaaatgtggattcaagaataaaaaggggcatagagtatataggaagtctgtgtgccttctgttcacttttgctgtgaacctaaagctgctctaaaaagtaaagcctattaaaaaaataaataaaaaggaataaaaataactaaaaaatttccaactgttagaaaaatatcaatgctgtgtgacccagcatcactacagcatttatatttattgattttatctttaaagtggtaaaataattatatgttaaagtacaaataatgacaacattattaggaattatattctttgcatctacttaatcttaagatgaaaaatattagatgtcacgctaaaaatgtgcaggaaagtataatttatcaaaattcctttatagcggagacaaacagagtatctgaagaccattaccctcataacatgccatttccgtctctgagctcttacccacacatttctcctgcactagccccatcccaatttacccacccctcaaaacccatatcaaatctttcttctaaaactcttttaatgaccctcccatggtgatttcctcctccagaagactcaatgtgtaaagcactcacatgtacccctcatttggcacaagtacaatcctccctttctacccatcagggatcggttccaggacctcccacatgtacaaaactttcaggatgctcaagtccctgatataaaatgacatagtattcgcacatacctatgtacatcctcctgtactctttaaatcatctctgggttatttataacacctgatacagtgtaaatgccatataaattgttgctatactacaagagaaaaaaagtttgtacgtgcttatcatgtacatttttttccaaatgtttttaatccatgattggttgaatccacaggcacagagcccacagatatggagggctgattgtgtattcttccttggcctagtttttgaaattggtgattttatgttctactccttaatttgaacacaatttgcatggaagcagagagtgaatataaactgtcttaatattcccccctgctaattgcaaacactgtacaacacatagatatagtagtcacctaagagctaatcatcaatataaacaaaagttgatttcattgttcactgaaaataaagaggtacaatgtctctgttaaagtagccacaccagatatgtagttcactatcatataaagaaaatgtagctgagatcttgtttaagaaacaacccaggtcatttgcttccagtattttatgtcttactggtggagagcttgtgtcaaaaccttagtgatacaaaaataagtgtttatttcttttttttttttttcccaaggcagaagaatttttcttagtacagaacaaaatgaaaagtctcccatgtctacttctttctacacagacagagcaaccatctgatttctcaatcttttccccacctttcccctttttctattccacaaaactgccattgccatcatggcccgttctcaatgagctgctgggcacacctcccagatggggtggcggccgggcagaggggctcctcacttcccagtaggggcggccgggcagaggcgcccctcacctcccggacggggtggctggccaggcggggggctgaccgccccacctccctcccggactgggcggctggccgggcagaggggctcctcacttcccagtaggggtggccaggcagaggcgcccctcacctcccagacggggcagctggccgggcggggggctgacccccccacctccctcccggacggggcggctggcctggcgggggctgacccccacctccctcccggacggggtggctgcctggcagagacgctcctcacttcccagatggggtgtcagccaggcggaggggctcctcacttctcagacggggcggctgccgggcggaggggctcctcacttctcagacggggcggttgccaggcagagggtctcctcacttctcagatggggcggccgggcagagacgctcctctcctcccagacggggttgcggccgggcagaggcgcttctcacatcccagacggggcggcagggctgaggcgctccccacatctcagatgatgggccgctgggcagagacgctcctcacttcctagatgggatggcggccgggaagaggcgctcctcacttcctaggtgggatggcggccgggcagagaggctcctcactttccagactgggcagccaggcagaggggctcctcacatcccagacgatgggcggccaggcagagacgctcctcacttcccagacggggtggcggccgggcagaggctgcaatctcggcactttgcggggccaaggcaggcggctgggaggtggaggctgcagcgagccgagatcacgccactgcactccagcctgggcaccattgagcactgagttaacgagactctgtctgcaatcccggcaactcaggaggccaaagctggcggatcactcgcggttaggagctggagaccgcccggccaacacagcgaaaccccgtctccaccaaaaaaatacgaaaaccagtcaggcgtggcggtgcgcgcctgcaatcgcaggcactcggcaggctgaggcaggagaatcaggcagggaggctgcagtgagccaagatggcggcagtacagtccagctgccgctcggcatgagagggagaccgtggaaagagagggagaggggagaccatggaaaggggagagggagacggagagggagacggagagggagagggagagggagagggagatataagtgtttatttctcacaaggctgggcttcactgggagcttcacctcaagctgcaacagctgggtggttctgcttttcactgggatcactgggatagccaggttgaaggggcagcagctacccattagaagcccttttcaaggcaatggcacaaatacacgaaagcaaaagcaatgaatgaggcctcttcattcccatgctttgaactggcccactgtcactctcaactacatgccattggcttaaagtaagtcacatggccaagcacaaagccactagggagggaagtatactttgccggtgatgaggtcatggcaagggtgtacatgcagagatgggtaaaggattgggacaaaaattttaatttatcatgaggaataaggtgtttaaaaaaataaatcaaatatataatgtttttttcttttttctcatattcaaattaataggtctaatttttgaccctatattagaactttaaggccatagcatttttcatgaaaggtattttggtgggacaggcagtgggaggtggtcaattttatctatatgtcagccttgaggaagatattcatgcatcagtttcttaacttgccttccattaaagttgaaccattttagattcactttggaacttcgtagattcaaagtttatgtaaaatgtgctatttatataaagatgttgtttttaactaacccactaccagtaggaaaccctttcaattatttctcttgcataagccatgggtttacagtaaactacccactctttgacaaattggtcttaaaaccaacatccagatttgtaatccagttcattggagttaggaatgtggcctagggcaatggaagagtttgtgtttttgtttttgtaccaaggtaagttatagatttgatcctcaaacctattggcctccctggcttggggccgtttattccagatacagcctagacagcaatgactgtgttcctccaatgaacagaggtatatttcacaaggaaataactgcttctagttcatatattgtttctaagcctacaagtaaaattaaacttttttaaaagctaaataaaatttatatttatgaatgaaagcttgccaaataaaaatattttgctatgggaaaaaatagaacttttgagaatgccttgccaggatgctaaaatttttgtgttcatcttggagagcataacgggaataatataagcctggagggaatgaggttcttgacaagcaatgagacagctggaggaaaaggcttaagtttaaagagaatggggtgagtgagagaaagccccaatgttgattcatagatgaaaaattacatgcacatgttatattggccccctgagatgctctgttctcaaataatttaaatagttggtattacagcatcagttattggttcactaagggaggttaggtaagagttacagcagtgaagttaaaactccaggaaccagatggtcccatgtgccttacttattgcatttctttcattgcactctaaacagtgccttagttgcctaaaagagttcataagcctctcctaaggtatgctttctgccagagacactgagccaaggtgaacaggctcttgcttctgttcctgattatagcacacacatattgggtgacggtgacatgaactgaagctgtctcactttttccagctacagagggctgccttgcattgtgttgtggtatttccacttctgatactactctgttcattctcaggatcaacattttagggatggatcccctaagcacaccttttgacaatgagttctacaatggactctgtaaccgggatcgggatggaaacactctgacatactaccgaagaccttggaacgtggcttctttgatctatgaagtaagtctcctcggaggaaaacacattgttcaacttttggctgaaaaattgcttaaataagtttagtaccaaacaatgtgaaaaactcagtagaataataatttcacatgaacacaagacttaaagaagaggcgatgtagtttggatctctttagaaacatacaattgtgtcttctcaatcctcagtaacatgcacctagtgataaagatgtggcaaatacctagactccataaaaagaattatctcaggatctaacataactaaaaattaaatcagtgctgatttaagtagtgataacactgcttacgtgctacttgagttttgctgttattgtttgctagcctcctgatgaaaactcatctttgcgttggttttccttcagcatccgcctatgaagagcctgcttgactaatgtgagtggctattttcactcaccttaaactcctctacctcttgaaaatgatttataaaaatgatttttactctacacaacactattccaaacttagctatctttcttaaagtcacctaattctctagaacaatgacagactgtagccctccaccattaaaaggattaatatttatcacctttagaaattctttctttgttccaagcaaaatataatgaagaataataataagcttgctctgacccaggagctacaagagtctgtttcttaaagtggtcccattggtaaagaagagccacaaggtctgccttattcagttattacagggctcttattgttatcagtcccaccagtttgaaaaatgtgtatgcttttaaataagcattactttctgaaaatatcataaatcagtctctacatattgcagccagaagcaatcatgttttctcatgaatgctaaagactgtcatatcttgaccatttgactggcatgttttttttcacatgtagtcatgtttcttatacctataagtcagaatatgtcagttgccaaaaaatctgaggaaatcttttgggctgttggttttccccaataatgccaggttaaacttctttaagcacagatttttgtgatggaaagatgacaattatttttaaaaagtattacatacattctcctttcttaaatagaaaataccaaacatggtcaccttggtcattgctgatgggagaagggctattgttgtgttgatttagtttgtttggagtttagtctgcattttacggttttcctgtcttcaccactgtgatcagctcttagcttctccagaggggtaataacttgtacgacatagaatagtgacggctaggggctgcccaggactgatcttgaagccacgtttggaaaggaagcactgctttcccttatccataaccctggaaacacatgtgtttcagcatttcagaatgtttggtattttagaaaggtgatgtggtgtgatataaatcacaatggagtttggagcagcatcacataatctaacacatcaatatttctgtagcaaaactaatctatgttcatatatggtgggaaaaatgaagactatagataccttttactagttcaggtgagattaatacccccaaaagagtttgatgtcaagcttattagaaagaagataggaattgtggacttgaatatttatttgatgccaactggggcagtgggagttgaataggggttggctaaggcctccacatcactccgttgctgctcccactgctgataatccccttattcaaatctgttatggtcttggaaaataagtagccaaactcattattattatacataaaagaacacaaacttacatgaggggaaatatctactttaactccttagagatgatttttttctttaattcctactacttaatgaaatatgtcatttactttctcatgtgtatcagtagtacctgaaggcaaattatacatattatacttctttatagcttattaccaataccaactccatataatcctcaccagtttttgttggatgaaataattttttaactcttgccttagttacttattggcaataatttattggctttcatttttgacagaattatactggtccatcataacatgggaatgcacctaaataatgacatcttattctcatccattcatactctctcatttagggtcttttgtctctaatgggctgtggttctagagccactctgcttaggttgaaatcccacctctgccccttagtgctgtaaaatctcaggcaaattacttatcatcattgtgcctcagtttctttatctataaaatagaaataataatgcctacctcatggagataaatgggtctaaatatgtgaaacactcagaaagtcactggcatatagcaagccctcagtaaatattagctattattcattttagagtataattagttaaagacttagccaaagctaggtacataattagtggtcacacagcaggtcaagacttactgaccactttataaattagcagtaatgaccaagaacaactgtagaagtaaaaaggggaggggggagtgatgattgcgtttataacttaggtccttttctacttacttttctttggttgtttcttcacttttgttgttgaataacaatttgtaagcctaaatcaggtttcaggtgttcattataattcttcttaaatctgagtctccatgaaaatgtaagatttgggagatgaacaaaaatttgcaaaatgcacacagattataagcatagttttcgccccaatcctgccaaaatcctgggtgacttcaatatcatgtggactgccaagtatttcttgttgcctcataacttcctataccatttcactacagccactctcatttctagccacctaacccttggctttgtctttaccagaactttgctgtctctgaaatttgaaaatccaacttttaaccctctcatcttatcacagttgtctaacctctcagctctcaccctcatttatgcccacaaacctcttcttggcctcatctagaccttcagtctttttggaatctttttttctcctggtatatcttgctcttcctactttaaattattttgttcatccaagctagatccattttgactacatttgccaatattagcaatgtccttgtttccattcctcctacaatccagaaaaactctgatttggcatgaaccttattgttttctgccctacttgtaaacttacactgctgaacactaaagagaatattatgctcacacaaaaacagctagcattataatttcaactgagtcctccacattgttcagtaggtccgtaacaccttctcaggctttcctcattctcgttcttcacatgagcaggctcaatctttcagcaacaccctcaagcctcttactcttactcaccattttgatcctgggttcagcagatgacattagctccaacttgacagagaatacccaagtcataggcaggagctttcacagttgtttcttcaaagttattctgtgtacttactttgctactcagtccctctttacatcctattctctcagtaggaagttattctttctcttccctagcctggatcccactccaagtacattgctagacattctgctaagcctccactcaacctttccctctttttccttccactctggccttcatatataaatctttttcaagggtctcatctataaagaaacaaatgaagaaacctctgccatctctatatacccatgttgtctacacttgctatctcaacatatgtgcattgcatttattccccactctctgttatcttgtgtctatgcatttttcaaccctcttcaagtctatctcaagcttattttgagctcccttttggagaatccttaaatagtattgaactctttccagagttcctacattgcttcactgatttctctctatatattcttcttgagtgatttccttttcctcttctcctatggcttcagttttcactctattctgattgcatgcaaatcctatatttccagcccacatctctctctgaactagatgcttgtatatccagttgtctgccattgtcacagagtcaacatacctacagctgataaccaatcttactcccaatttcctgcttcttgctcttgaattctctgtcttggtaagtggaaataatatcaacctagtcatcaaactcaaaacctgaaatccctccttaagacattctttacagactcatttccctcaaaacccacaatatccaatcaatcttcaagttctattattataatctcctttaaatctgtttcttattccccattcccactgccactgccttaagctcccatcacttctcatgtaggaatgactcaaaatagtgttcttagtttacagcctctagcttttctcaacttcaattcattccccacatttcagtgtaaaaataataaatctgatcattctccttgaagcttaaatttggtgagtgtctatctatagcctgcagtgtagtagtcaatctccttggcaaggagtacaaagtgatccctgatctgatttttgattgccactccaccctcagctttctcctctgaatcctccatcttctaaaatgcttctcctacaaataaatgcaatatgctttgattttttctctatttggtatatattttgctgtataatacgtgctttttggttgctatctcacccttttatttaccacagaatactgaaaaactatattgtatactatgctagataaatgcctattgaatgaataaaaaattcatgccagcatattaacactgtaagttaatatttctaatgatggcaaaaaacaaatatttaattggaattgccattaaagttgacagcaaaattgcaagcagaggcttaatacacattccaactattctttctactgacaacttaagcccatttagaaaatctagcagcagataaagcttattacatacctggttatttgtcctatgttgatgtttctcaagtggaaaatatgtagtctttccctatagaaactgctatcttgaaagggactctgttctacaaataaactcatgcattcagggttgaagtcataggcaggggttaaatcatgaaggcactcatgtgccataataaatacactgagcatagtcctgagcataatgagggagccactccggagagcaaaaccctgagagtttcattttagaactttgtgttttgtggaaataaattttaagggaacaagaccagaggtaatgagaacagaaggaggctattttatggtccaagaagcagatgacaaaaggctaatctgggtctgtaatagtagagatgaagaagaagagataaaatccagcatatttaagaattaagaaattattaataaattggagacagtatagcatatgatcaatcacaaggttctgaattaagattctctgggtttaaattttggtaacttcctccacttaccacctatgtgaatttaggcaacttagttacatttcctggatctcaatttccatgataaaatcgtatgataatagtatacacttcacagggtttcagaaagattaaatgtgttaataactgtgaagtgattagaatagtgcctatcacaaactaaattttctatagatggaccctataaaaatggaaagaaaaaaaaccccacacaaacaaccagtgaattataggccatcaaaagagatgtgggaagttggatgtgcaggaaatctaccaaagaaggagtgggttctaagaagataatgattcgaatgctggtaattttgagtttgagggtctatatgaaattagatggagttatcctacaacaaggagattatttgaatcaaaatggagagaatgatctaaattgtaaaaagagatctaggtgttaattaacatacacatgatcattgcatctttttttttttttttttttttgagatggagtctcgctctgttgcccaggctggagtgcagtggcgcaatctcagctcactgcaatcactgcctccagggtttaaacgattctcctgcctcagcctcctgagtagctgggatttgaggcgtgcgccaccgtgctcagctaatttttgtattttagtagagatgggatttcaccatgttggtcaggctggtctctaactcctgacatcatgatccgcctgcctcggcctcccaaagtgctaggattacaggcgtgagcaaccgcgcctggcgatcattgcattcttgagggtgcctgagattaccaaagaagtgtacaatgagggagaagagaagaacatagagactgaagtcctagagcacacaaacgtttaagatttaggcacagaaaaaatattctatagataatagagatggattgtacttgttatcctttactgtcatattaccccaaaacttaatggctaaagggttaagaatgtgacagtagcttggctagatggttctggcagaggggtgcctcaagaggttacaatgaatctgttgttcataggtttcttctctcaattagtgagagatggctttgataataataactaatatgtggtttatggttttattatccatttgtacaaataaaattttaatgacatcttcaacagttttctctacttactctctatttacaactgctctccaaacctccacaacttgaactctgaaatatttcttgatcgtgtctatctcttccatttttagtgccataagcaatgtttatttcttttcaaggagtattatatgaacaaattcttaaacaggataacttcaactgacccttataatatgtctggcctcctagaacatgcaagccccttgatcttctctctctgaatctagcttctccaacatctgtttattcagtactcataaagaaacttgcttccatctttgtgtttttctgctttctgtaatcttgccccttggtctctcgtccaagacttttgcttttctctctatgatggttacaagtattggtctatttctgaatgcttaacattgagcctagacttcttttcgcatggatggatttttccatttcccaattcagctttcattcctatgctttctgggatgactccatcctcagagtttcaggctgtactcgccactaccattctggcatagtgagaaaagctaccttttcttgagccattcaacaacatcctaattgataccctgaccaacaatctgttatatctgaaagtggccctctacgctgctgagttgataattgccttatgccatttcctttctagtcatttcacatacaagtgcaggtgcctacaaattacaccccctctatcagaaagcatggtgccaccagtattgttcttttttctcaagattgctttggccattcgagattttctgtggttccatacaaaatttaggattgttctttttatttctgtggaaaatgacataaaattatgatagggattgcattgagtctgcagatcatattgggcagtgttgctattttaacaatattaattcttccaatccacgaatattggatatctttccattgatttgtatattttccatttctttcatcaatgttttatgaatttcatcatacagctctttcacctccttggttaaatttattcctaagtgttttattctttttaattctgtagtaaatggtatttttaaaagtttcttttttagatggtttgtagctagtgagtagaaatgcaacagacttttgcatgttgattttgtatcctgcaactttactgaatttgttagttctaacattttttgtcttgttttgttttttgggtggtgtctttagggttttttacataaaagaatatcatctgcagacaattttacttcttcctttctgagttaaatgccttttatctctttcttttgcataattgctctaagacttctagtactattttgaacagagatacaatgggcatccttgtcttgttcctgacgtctgataaaaagtttcagttttaaccactgagtataatggtcaatgtgggcttgttgtatatggcctttattatgtcgagatacattccttctatacctaatttgttgagagtttttctaatctttaaatgacgttgaattttattgactgctttttctacatctattgagatgatcatataatttttatccttcattccattaatgtggtgtatcacaattattgatttgcatatgttaaactatctttgcatcctagatataaatctcacttgatcattgtgtatgatcattttaatatatttctgaatttagtttgtttatattttattgaagatatatatacatatatgttcatcagggatattggcttgtaattttcttttcttgcagtgttcttgtctggctttgatatcagggtaatgctggtcttataaaatgaatttggaaatattccctcttcttcaattctttggaatattttaagaaagtctaggattagttcttctttaaatatctggtagacttcatcactgatgccttcagattctgggcttttctttcatgggagactttttgtagtactgattcaatctttttagtcattattggtctgcattttctatttcttcataattcagtcttgatagattgtatgtttctaggaatgtatccatctcttccaggttattcaatttctttgtgcataatttttcatagtaatatcttatgtttatttatatttctgtggtatcagttgtacagctgtccctcagtatctatgaggaattggtcccaggaccactcacaaatagctaaatccttagatgctcatataacatggtgtggtatttgcatataccctatgctcagcctccagtataatttaaatcatctctagattacttagaatacctaagtgatgtaagtgctatttatatagttgttatactgtaatgtttagaagataatgacaagggaaatagtttgtacatgttcagtacaaatgcaaccattgcaggcccaactacatttgtgatccaatgatggttgaatccacggatgcaaaacctgcagatatgaagagccaacagtaatgtctcctctttcatttctgattttatttgagttttctcatttcttcctgagttagcctagctaaaggtttgttcattttgtttcttttttaaaaaacaaactcttggttttgttggccttttctgttgtttttctactacctattttatttatttctgctctgatctttattattctcttacttcaattgactttagtttagtaagcttagtttgcccttcagtttttagttccttaagatgtaacaatagattatttgagaaattcttttttgatgtaagcatttattactataaacttttctgttagaactgcttatgctgcattccataagttctggaatgttttcatttttatttattttaagatatttttaaacttttaatctcttcattgacttatttattgttcaggaacatgttaatttttccatatttgtgaatttcccaaaatttctcctgttattgatttctagcttcataccattgtgatcaaaagagatccttaatattattttaatattcttaaaatgtttaagacttgttttatggcctaatatacgatctgtccacgagaatgttccatgtgtgcttgataaaaacatgtattatgttactttggatggaatgttctgtgtatatttgttaggtccatttggactaaagagtagttcagttccaatgtttccttaataattttctctccagatgacctgcctattgttgaacgtggagtattaagaagtcccctactattttattgcagtttgtctctcctttcagatctattaacatttactttatacatttaggtgctctgatgttgggtgtctagaaatttaaatatcctctggcaaaattgaccccttcattattatatagtgattttctttgtcccttcttgcagtttttaacaagtcaaaattttatctggtatgtttagctatccctgctctattttggcacttaaaggtgaagtgagtctcataggcagcatatataatagttgggacctgctttttaatccatttagctactctgcatctcttgattgagtacatttaagataattatcggtaggtaaggacttaccactgccatttttttcattgttttctggttgttttgtatgttctttctggctatttctttctctcttgctatcttcctttgtgattagataattttctgtactgatatgctttaattctttgcttttatgttttctgtgtctattataggtgtttgctttgtggttttcatgagttaccatgcagcttacataaaatatctatagttataataggctattttaaactgttagcaacataaattcaatcacatttttaaaacttctacacttttcctccccacattttgtttttgatgtcacaattaacatctttttatattgtgtattccttaactattatagctattattatatctaatagtgtggtcttttaattttcatactacagatatacttgatttgtacatcatcaatatggtgtgagagtattctgaatttgactatgtacttaattttaccagtgaattttataatttcataaattttttatgttatgaattatcattcttttctttcaacttgaagaactccctttagcatttcttataggaaggtctagaggtaatgaacttccacagcttttgtgtctctgggaaattttttattccttcatcatttatgaaggtcagaattgccaagtatactattcttgattggcagtttatttttctttcaatactcttgaatatatcatctcactctctcctggattcaaggcttttgctgaaacatctgctagtaatcttatgtgagctccctcatatgtgacgagttgttcttctcttgttttcaaaattctccttattgtatgacttttgagtttgattataatatgtctaagtgaagatctcttcatatatagtctatttggggttctttgggattcatggacctgggtgctccttttttttctccacattggggaaacttgctgtcattatttctttaaataagttttctacacttttgtgtttctctcttccttctggggcaccataatacatatactggttcacttgatggtgccccatagttcccacaggacttcttcactatttcttttttattttttgtttttctgattggtaatttcaaatgaactgtctttgagctcatgattctttcttctgtgtgatagaatctgctattgaatctcactatgaaatttttcagctctgttctttaactccctaattatgttctttaactccctaaatttggttgtttgtgtttttttatgctttctttctctctattgaacttctaattttgttcatgtatttttttcctgatttcatctagtcttctgtctgtattctcatgtagctcactgagcttctttaagctgattattttgaattcattatcaggcagtttgtaaatttccacttctttagggtcagttaccagtgctttattttgttcctttggtgatgccatgtttccctgattatgtgtgatctttgtgaccatgcatatctatgcctttgaagaagtaagcacttattccattccttacagactaactgcagcagggataacccttcattaatcagtgtgtccagagattctgggcaagtcatctggcatggtccacaagcaggcttgatgctggagtccttgggtagacgtgattggttccttggttcactggggaaggcctggagcttgggtctgctggaatgagcctggtgcctgtatccatagaggtcaacctagcactggagtctacagaagtgggcctggatcctgggtccagtgggtccactggatcttgaggctgtaaggaccatcctggaggctgaactcatgaaggctggcctggagcctggggccaatagggctggctttgcactgggatggccctagaggctggatccctggtctcgcgcctgattttgggatttgcagtggccattctggcactgggtgaaactggagcctgagtctgtagtgaccagcctttgagactgagtcccaggtgctggcctggtgcttgaggtcatggaagctggcctgaagctgaggtgtacgggtgctgacctggcattgggttatagctggagtcttagtctgcaagtaaaatcctgagtctagggctacagagaccagcctcattctgggcctgtctaaagcctgagttgaggctggaaactttgtctgtgaaactggcctcgggcctgaggccatggaggctggcctggcactggttaagcctggaccctatatctatagggtgctgggatgtaactagagtcaaaggctgaagttttatttaataagtaattataaaagaagtggttttcattttattttgttttaaaagaggagccagaaaagcttgtagcaaaaatatttgttagtctgttatatcaggaggggctttcctaaagaagtgatgtttcaggtaagacttgaaataggagtgggaattaatcaacctgaggcctatgttttgtgtgtatgtgtgaaagggagtgtgtgtgatgtctgtgctatgggagggttggggggaaagagtaagagaacattctagaaagaaaaagcagcataaaagggacttatggtaagaacagcatgggttgtggaacagctggatggctgacacacagttagggagagattgactagaaataaatctagtttagactatattaaagtcattagaaatacattagaaagatctaagtagggaagtggcaatggttagtttgcttttccctgttatgctaggcagtttcttcaacatgtcttgttttaaagataactatatacatttcagtcttttcatgagacagtaataactttaggtttctcatgcagaacaaccactcaatactaaatccagtccatgacactgtctgaagatacaggtgtccccttcccagacaagagttatacctaattcagaagatttctgaaaagggaactgaaccacttatataacaagtctctcactgacaacaacctgacaatagccaagttggcaaaaaaaaaaaaaagttctaattgaaattttagtgttgaaggaatatacctcaaaatagtaagagctatatatgaaaaacccacagccaatatcaccctgaatgggcaaaagttggaagcattctccttgaaaaccagcacaagacaaggatgctctctctgatgactcctattcaacatagtattggaaattctggccagtgcaatcaggcaggggaaagaaataaagggtattcaaatacgaagagagaaagtcaaattatctttgtttgcagatgaccagatgacatgatcctatatttagaaaaccccgttgtctcagcccagaggcttcttaagcttataagctacttcagcaaagtctcaggatgcaaaattaatgggcaaaaattgctaccattcctatataccaacaacaggcaagcagagaaccaaatcataaattaactcccattcacgattgctaaaaaaaaaacccataaaatacctaggaatacagctaacaaagcaagtgaaggacctcttcaagaactacaaactactgctcaaggaaatcagagaggacataagcaaatggaaaaacatttcatgctcacagacaggaagaatcaatattgtgaaaatggccatactgcccaaagtaatttatagattcaatgctattaccattaaactaccactgacattgttcatggaattagaaaaaaaaaaaccattttaaaattcatgtggaaacaaaaaagagcctatatagccaagataattctaagcaaaaagaacagagctggaggcgtcacactgcctgacttcgaactatagtacaaggctacggtaatcaaaatagcatggtactggtgcaaaaacagacacatagaccaatggaacacaatagagaactcagaaataagactgcacacctacaaccatctaatcttcaacaactctgaccaaaacaagcaatgggaaaaggattccctatttaataaatagtgctgggagaactggctagccatatgcagacaattgaaactggaccccttcgttacatgttatacaaaaattaactcaagatggactaaagacttatatgtaaaaccaaaagctatagaaatcctagaagaaaatctgggcaataccattcaggacacaggcatgggcaaagatttcataaaatgccaaagcaattgcaacaaaaacaaaaattgacaaacgggatccagttaaactaaagagcttctgcacggcaaaagaaactaacatcagagtgaacaggcaacctatataataggtgaaaatttttgcaatctatccatctgacaaagatccaatatccagagtctatgaggaacttaaacaaatttacaggaaaaaaacaaacgaccccattaaaaagtgggcaaaggatatgaacagacacttctcaaaagaagacattcatgtggccaacaaacatatgaaaaaaagcttaacatcactgatcattagagaaatgcaaatcaaaaccacaatgagataccatctcaaaccagtcagaatgacaattattaaaaagtcaaaaacaacagatgttggcaaggttatagaggaaaaggaacgcttttacagtgttggtgggtgtgtaaattggttcaactattgtggaagacagtgtgccaattcttcaaagatctagaagcagaaataccatttgatccagcaatcccaatactgagtatatatccaaaagaatagaaatcattctattataaagatacatgcatgcatatgttcattgcagcactatccacaatagcaaagacttggaatcaacccaaacgcccatcaatgatagagtggataaagaaaatgtggtacatatacaccatggaatactatgcagccataaaaaggaacaagatcacgtcctttgcagggacttggatggagctggaagccattatcatcagcacattaacataggaacagaaaaccaaacacctcatgttctcacttgtaagtgggagctgaatgatcagaacacatggacacgttagggaaaaaacactcactggggcctgttgggggtaggggtgacagagcatcaggaggaatagctaatggatgttgggcttaatacctgggtgatgggttgatctgtgcagcaaaccaccatagcacatgtttacctatgtagcaaacctgcacatcctgcacatgtaccccagaacttaaagtaagttgaaaaaaaagtttgctatactataagtccttcgtatgcattatctcactgaatttttataagaacctttgtgctaggtatgatgaatatccctgttttatagactaagaatcatactaagcacatagagattattgcataatcacttcaaagtgacagagtctgtatttgaaccccaggaatctgactccatcacttttgctcttaactcctttgttctactgcctttcaaagaattgtttgacttctctttggttctgttctgcttgtttttccttttgtttcgtatcttgtttttaacaacacttttttattctcttttagaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggtaagacaaaacagttaatataggaatatagaaaggttccaaactacccagactctttaagtattttgagcaaatagaaatcataaaaaggaaaagaaacatggatcaaattctcaaatatgtagctagcacgtcagaaagaatactaactggagaaaagtctgatagaatctttggcagtggtaaatgaataatatgtttggtggtagtgagcagaaaatgcgtattaagaatttagagcattttttgactgagattgtggtaatataccattcaatttatatgatcatcagaattttaatgaagaattatactgaagaattctggtaattcattgcaatgccttacctagaatgatcactgtttattaactacaaactgtgtctctaaagaaatgatgctatgaaattatacacatgcacataaaattggtctgattattttgtaatcatacgtttgagactttgaaaatgtgatttttaaaatatttgaaccagattttgaagtttgttctaccactcttggaataaatataaaatatactctctgtaatcagcatgacgccagtaaaatgctcattcttccttttctgataccacagtcacttatttagacaagcttctcccacattaacaataataattcactcttagtacttatatgatgcctaactatgtaattgttttgtatgggtctgtacattacctctctatttacatgcatacccactcaagtgtacaggtggaaaattctttaaatcattcaacaaatatttaattgtgacctatctggcctaggtacttagaatatatttgtgaaccaagctgatgaaaatttgtgtcctcatggagttgaaaactccacagaaagagacagccaaaaataatacatataatagcaaaaaagaagtaatatggtatttagaaagtattaagttctgtgggatacaaggaaaattagagtaacatgaaggaaagcagggatgcctgtaggtggcatgattaaaaaggaagctcaggcttagcttcatggagatgagaagtaaccaaagctttggaggagaggagatagccaaagagtaagatttcagattatttatctgacggaaggaactgttagagaagtctctaatgtaggaaaaacctggtgtgataaaagttagtcaaattgaatcagaaggataaaaagttagaaaagttaccttgaatcagatcatgaagaacttaaaagtccactcagtgtggctttttttctgagtgacatgggaggtcacttgagggtttttaattttaatttaatttaatttaatttaatttatttattttgagatagatttttgctcttgttgcccaggctgcagtacaatggtgtgatcttggcccaccacaacttccgcctcccaggtacaagcaattctcctgcctcagcctcccgagtagctgggattacaggcatgcaccaccacgcctggctaattttgtatttttagtagaaatggggtttctccatgtttgtcaggctggtctcgaactaccaacctcaggtgatccacccgtctcggcctcccaaagtgctgggattacaggtgtgagccaccgcgcccagcctacttgagggtttttaatagaagattgacattctctattatattttaaatgattactcaaggtattttgtcaagaagagatcataggtgctaagagccaaagcaaggagtcttgctaaaaattactgaaggaatccaggtgagacatgatggtagttcagataggacaattatagagtcaaacataagtccaaggtttttggcctgagcaactagaaaaatggagttgctgatggagaaagcttcagatagagcagatttggagagggagaccagtaattaaattttagttaggttaagtttgaggtgtttattagacatccaattgacaatgccaagtaggagttggtgttttgaggctggagtttgggaaaaagacctggaattgagctatacattgacttgttgacttcgtcatggggtcactaacagagttagtgtacatagaaaatagaatacaatcaaataccaaacttcctgaatttcaatagaaaacaagtaaaagaaaccaaaaagtgcccaagaactttgctacttagagtgtggtctatggaacagcagcatcagcatcgctgggaggctagaatcttagactgtgctccagaattgcattttacctgactcagtgttgcattttaacaagattctctaggtggtttgttcacattttatagtttgagaagcactggcctagaagacaagaaaataatctctattaagaagaagagagtgatgaactgtgtcaattgtgctaacatgtcaaagaagatgagggctaagaagatgaggctaagaagtgatcataggctttaggattatgaaagtcattggagaccttgataagagacattttgttggagtagtgaggtcagaagcatgaataatttagatttaagaaaaacagggaaggggagaattcaaaatatacagtatagaaaactgaataaattttgcttctagtgagggcaaagaaatgggtagtggctggtcaggcaagcgaggccaagggaaactttttgttgctttaagatagaagaaacaactgcatatttggatgataatgagctaagagctacctttgaagtaaattgacccaaagaacatcacatgtctttcttaccccaaatcccaagatatacctcccagttttagcaaaactgaaaagaaatccaaatatgctttgaataaggcatatttgagaattcttgtgcaagtcaggagatgaagagctcatatgacctataacatacaggctaagatttttattaaagactggatcacccactgtcacctaaagttaaatcatgatgacaacaatgtgctttaagaagacagacagtttggtatgatattcatatactgcaagatatacctttaaaaagaaataaaatattttaaactcccacataatcatcatatgttaaccacagctgttaggagaccctcaaaagatccatttgcaaaattgtgggtgtcaattgtagtttagttttcatcaggacaagctatggcattgaatcacacagttcactgccctagttttctccgggaaaggtaagccatcagccctggccctggaaacatttaactgttgagttgcttaggctgacttgagttccacgtctcaaaatattgtctgtcctgtctctgtcattaaaaattgagagggtggactgaaagggacaaggagacctgagatctaggtttttagtaccaatgctgtcaagtattattcatatgttttgggacaaataacttgatatctttaaattagttttctcatctgcataatagcaagattgggctttattgataatgtctccatttccttccactgttgtttttaaaacaacttagtgaggtataatttcataaaataaaatgcaaagattttaagtgtatagtttcatgagttttgataattatgtacattagagtagccatctcctttagcaagagaatattttaaatgttttaacatagaagacacagcagcatatttagatggaaattatttaagatctatgtttaaaatacattgagttaaagaacatcacaccaagaaaattccatcatgaagagacactcaggcttcttaccccaagaaaaattccttatgcccttttccgttccctaccacctaagaggtgaccactgaccagatttatctgaccacagcttagttttgcctagtctagaacttcatataaatggaattatataggatatactcctctatgtctgacttcttttactcagtataatatttttgagatttatttatgttgttacatgtatcagtagttttattttcctttttattgatgattagtattccattgtattaatatgctatggttgtttattgatttctctcttgatggacatttgagatgttttcaattttaagctattctgactaatgctgccatgaaattcttatacagatacttttgtgaacaaaatttttattaggtaaatatgtaggagtggaattgctggctggtcataagcaaatgtgtgcttaacactatgggaaagtgccacacagttcttcaaagtggctgtctaattttaccagtaatgtaggagagttttagtcactgcacattctcatcagtagttggtgttgatagtattttacatttagcccttctggtggattagagtggtatctcatggtcactgctaaaacatttagtgcctatggaagttctaaatttcataaattttcatttgaaatggtggataaaacacatgtttctcttcttcatctgctctacaacacaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtatgcctagaaatagagctctgacttcaaatactgttttgaccaaacattattttgttcaccaacctgtttcaatggttaaagtcttaagaatacaaagccctgtaacctgctcctttgagaggactctcttcctgccctttggcacctaaaaccctgttaaatagcaaattgacttccatctcaaacaagctgacttggtcatactctactcaacagtagcactgagagatggatccattgtattgcagcttcacatctattagaaggtggtacttttagtgaaatactaaacaaaaggtgaaagaaagtacagacataatttgtataacctacttcttaatcaatagactagttcaatttctatatcacagttatcttccagagtatacttcaatattggagggaaaatattgttctaaattttcttttagagggaaaagaagaagcagtgttatcatataaatctaacatcttaaagcaagggtggaaaattagttttacctcatgtgatgacacttctcattatatggtggtggttgaattgggctcatgttaagtaggtttctggtcatggggaaatcatggggaaaagggccatggttaattatcaatgtctgtcatgggtagaagataggcctactgatacatagttatcagcctggcctaaagggttcgtctaagtcttttaagaaaaaagtaaatgcaaagtgactatattaataagttgtaatcattcatgttgtgagtaattatggctagttataatattccttaaggaggtgatggatgccaggatgcttcctctctgcccttgtaactataggtgtgtctcttagggaggaaagcgttgctaaaaaccactttaatggcttttacggggtcagtgtcaaggtatcaggtgttaagtgaagggtggaatgtaactgtgacgtaaaagcctgatattctccccaaggtcagcaaatactttatggataacaaaacatgacatagccagaaccagctggtcttgatgcctcagtcttgttttgggcagagagaagctttcccgggggggagtggaatgtaatgttacttagcttacactttcacagggctatatccacagcatagtgaagttgctgtgagctccacctggaagctatattgatggagatatcacgtaagggaagggtacaagaggacacaggtcttgagtaacttgaaaatgagaagagaaaggcttatgagtggtgatcaaaacacaaagaaatcttcagactaggagttgttttgatgaaaaagctccataggaagagatctttaatcctgaataactcagaagctacttaccttctggccttaatagacaaggatcatcaggtcaattctagtgactttgaagaggaagtgctctttctcacttctccagtgccaatatctgagaaccaagccatgtcctccacctcaatttaagatgtctggacatgagtgtccactgctaaggcagagaatctgagccctttagggtcacccaggttatctttcaccctcatcttcagaagcagagtcctcacacttcttaaggataaggttagaaatctagaattacggatttctagtattgtcttcgatttttatcctctctcttcccttcccatgggaaatgccacctgataatttctaagttctcactaattgtgggtgcatgagaaatatttgataggtgaataaacgcctaaatgcccccagatgtctacccctgatactccttgtagaaccccatgattaacctcatttcatttttttctttcctttttcataaagcattttgactcccagaacaaataatcacaaattcgtgtgtatgtgtgtgtgtgtgtgtttgcatgtatgaaataaatgataaataacggcaaaaactgacattgtcagtgaactgtggtctgggatgtttacccttaaaatagaggaataattattttttttatgaattgcaaaaacagataataactgatagactttgaaaatattaggatttttctttctagtaactgtttgggcatctacacaccataatgagtcagcttccaagactgatatctaccaagtagcattcataggatgaaaacaaagtgaccacatacatcagccatctgtccaaagcgatgaaccagctacattaaggatgaactgagtcttccaaagaggatcaggagatgttgatgtatctcatccaaattatgaagttgatacagagaagtgcttagtagctagacaactctgggttcaaatccaaacttactagctgagtaatgagccattagtaggttattcaactgctctgcaattccatattttcatctgtacaatgaggacaatatggacttacttcataaggccagtgtgaggattaaattagttaaagcacacaaaatgcttagaaggatgccagacacatgataagcattcaatatatgttagacattgttgtcccttttctatgatattacagataaaagactttactataaccaccatagtctgacctatatccctttaaaccatgtggtagacttaatgtgtcctttgccattaagttgacaagcaaagtcaaaaggaggtcactataatctaatatgaggacaaagcaggacagacatgatggcacatttgaatttagtcatggtgtataggaacctaagtaaggatgttgcttgaaaatagcaaaattggaatttatttgtgatgttggtagacattatctaataattttcaaataaattcattaaacaggtgttgaactaaaagacataaagagatgccttgggtatcatctggatgtatctctggctttctctgaaatctctgttggagctgaatttaataaagatgattgtgtaaagaggggagagggtagagctggtaagtgtggcctcacttgttagattttataaagcctgagggtagatgtcaatgagcactgccctcttgcaatgagccctcttaattgtctgtcctctttgtgcttaaaaactatcttacatttaaagcggttttcaaaccactataaacaccgatagcgcatggacatgtattcaccagtatcactattgtgccagttgtacagtacacaactcaagggggtgtgattcacacggtagtcattttagacttgtatatttattatggcaatagtaaaaaagtatcttcataaaaagtttcctttcttcaccctaattttaacaaagcttccaaataagcaagcgacaatgttcgtgcatccattaacaaaggacaaggccaaaaccatttccccaactccaccttccatctaaattgaaatccctaattcatccttaactttaaattggtgcctaaccttttcaaaaatacaaatatgtttggtataaatattacttcctactgttaatctttagcagatttacaagcatgaattagtgctagagttctcaacttttcctctaatcagaaatacctgagaacatttttaaaatacaaatgcttaaagctcacctttaaaggaagagtcaactggtagtggggaggcaaaagtgaggaaaaacctgatatatttaaaagcataccaaccaataatatgtgtccatgattgaaaaaccaatgatgaagtagtggaaaaaagctgaatttgccattatacggtataatttctatatttggtccttaagctaactgtgtgatctctgactagtcactccacctctctaagtttccaatttctcttctataaaaatgaagaggggatgacaaaaattatcttgaaattcctttccagttttaaaaattcacagctgtaaaagacttacaaagttttgttaaaagtggcttcatctacagagagacactgagggaaacgatgggtaggatttgggagtggaaagaaatgttacttttcactttattcttttttgaactcttctttttgtaatattaaaacatatcaaagcaaatgtacacaatataattatgaaggtaagtttgcaaaagaaaatatatattacacccaaagtcatatttagttcccgtgagtacatgtttgtatgtgaggagctgtgaatttatcagtgtatctagaccatgggtatcatttttattttttaaaagagatgacagaaatctacaactggttactaatgtaaatttccattgtagatttgaggtgaaaaaatgcataagcaatatttacaattaaaatttaataaatacattaggctgtattttactaaaaggactcaataaatgtttatcatatgtccttttgataactggcttctctttaaacttcttctgcttctctttaaatcttccttctctcctcagtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaagtaagaaacgtgtttattttcaaacagaagactgtgtcatttttttattaaatgtcacattgtttcaggtgaactgttagcttcatctgaaagagacgtgaacattcagatacactcccatttcttccccaaaaggaggcatggcatagagaaaaggcatggtgtagagtcagaccatcctggctgacttcctgtctctgtctctcactatgtgtgggatgttttctgacctctacaacactgaattctctaggactccatctttgttctgagaatttaacgaaattgcttatatagagcatacagcacacactgtaacaagataggtactcacatatgattagttccctcccgtcggcccctggctgttcttgccttcccgtggtgttccactatcacgtctaacacaggagaattgtatttactaagtgtctttttttttttttttttttttgagacagagtctcactgtgtcacccaggctggagtgcagtggtgcaatctcagctcactgcaacctccgccttccgagttcaagtgattctcatgcctcagcctcctcagtagctgggattacagatgcgcaccaccacatcgagctaattttcttgtatttttagtagagacagggtttcgccatgttggccaggctggtctcaaactcctggcctcaagtgatctgcctgcctcagccttccaaagtcctgggattacagacgtgagcccccatgcctggcctaagggtctttatgaaagaaatgttcataaagtctacaagaaaataagactaacggtgaacaattcttatggtcagtagatttttttcctttttctatcttgattataatagttttcagcttacaaaccctttgggagttcatagtcaagttcttattcctagacaaaaaaaaatgtgttatcattgtaaagatataaatgacaatgttatttagcctcatctttctttccccaagctgcctaaaactagtatgcatttttctttacttcttttactggtactattagtaagtgctttttttctacttacctttataactttcaattttcgccgtatgttttacaatttgctttcctcaggtcacatttatttttgactgctccctactccagtttgattaacttgagttacagaaattttaacattttcataggactagttattggagaattttattcctttattctattttattgtctttaaagaatgagtgaaaccactatctcctttatgtgaagaaggaactcagaaactgaaaatttttataatctattctccctttatgttatagaaatacagccgttcatagatatgcaatgtatttatgagttaaaatattttgtcccaaagtaggacaaaaagggggaaaaaagctggtgaaattccatgtatgaaattaaaatcagaggatgcctctttgatcttattaaatttaaatctaacacaaattcattatcttgaactcagtaaaataagtttatgttggaagatcttaaataagaaaaaaaatgggtgatttaggtgaatatttacatcgaggtgaacatcccaggaggcttattttctcatctctacaaagcaaattcaactgtctttctacaaattcaagagtgttctctgaagaggtcttaataatagttcagcacgttctagagataattttttaaatctcaagtaaataaggcagctgctgaagatttactactagatttattaaaactattcaaagaccctcatcaactttgttggtgcagtcctgctgtatggatgcacaatatagtttatcccatttttagggacaaccatttacttccccaaattttcaggttggtaggcattccatttagactatctgtataagtttctttcttgataaactggaaggctggccttttcatatcaacattctacctaaggaaatggtagctatagttagttcactatggaccactttttaaatttatcttcttgtagaaagagttgaggaaaagcaaaattatgggttttgttgactttgtatgacttttaagtctctgaagaaacatgagatatagttaaatttgatcttgaattagattccaagttattttactctcataattcaggtagaagtggacctctggttaacttgtagctatttccaggagacaattacacaatctatgatcactaattcattttcaggaatttgaagcattatgttgtctgcagatgacatgttcaaacataggggatagtcttttgaagaattactagaacctctccccacccaccctaaactataaactggtcaatattaaatcttctgtagcaaattaaagcaattatctaggtatttatgttgcaaactgattatcttggaggaaagaccagaaaggtgactgtaagctctcacttaatattatcaataggttcttggaaactgtgaccttaaccaaaatgacctgtaacaaaaccaattttaccatacgctaatgaatgggttaagttcctgtagtgtatttctggtcacaaaaacatcaccaaacttctaaataaaaactgaaacacttctaatattaaattttgaaatatatgtaagctattcacacattttaaaaagattaataaaaacaagtaagataatgatttacctgtttattctagttcagggtagtctatcccagcagctcagggtgcaaagcaggaatcagccatggacagagcaccgtctcaacacaaggcaaactccacacacccacactcactgagactaggaccatatagacacactgatttgtctagcatgactatctttgggatgcgggaggaaacaagcagaaccagagaaagcccacacaaacatggggagaatgtcaaaatccctatgcagacagtgaccccagctgagaattgatttttttctcaatattacaaagaaatgaccttgaatgaaataacattctgggacctgctgttttactctaagtggaatgctgtatgaatatgttactgagattttctaagtaaactatgtggtaaaatatatatgttataaatatatagtatatataattataaatataatttataaaatactataaaataatatagtttataaaatctataaatacagttatatatttttccgtactaaagtaactatagccatgctctgttaggtagaacctgtggttttgaggccccatttgtctgctttgtcaaacccaaaaccacttcttgaggaatgtcttggcccagcccaaaaatctctccttggcctttctccatgcagaggacataggctggccctctctttcagtacttacttttgtcatggtcttcagcttccatgaaagtatattaattctattgccaacttgcctgaatgttaacacaagtggttctacagtttaactcaacagaatagctgcactttgttttcctcttaaacctactgctacaaattagttattaaaatgtcagctaagagaaattacatttattatagattgcctggaagatataaagattattatttcttctagagcaatagcagcaagatgagtacagctacaatattggcttcctgtaaagttttgtttttccattattagaaacaaagttatgtaatctactgttttatttactaaaaggttgttatgtaatgctgtgtcctctttatgagactcataagaaatattactctttaatctcattttgtttctcttgggaatcaggtgagttcttctacctgattggtaagaaatgcatgagatcagtaaattcacctgtgtcttactcaatgcactagaaaatgaagctaaatttgtgacctacttcatgcaaatggatgggtcctcctggcatgaatgtagttcatttttgttgcttttgcctccatcttgctttttctgttctcagttctcctttcccatttccctcaaccactcatatgtctatatgttaagctgtattagttcttccagagttacatgatgtagtaattcatgaattaattaacccgtcatttttgctctattgtgtaactgttagcagttatgaaccagatgttaaagagcatcaatattttaaagggttgtagtaccagtgaaaatcatttctaactctcttgtttagggataaaaaacaacactcattctatcaacaaactacagttggtatacatagtttattttggatgtctgaaggaaatctccacctatttattattaaactatattatcaacttatttatactttaccacttttatggtagattatatcctaccataaatatatcaacacatggtagaaagatagagttatgtagtataggagaaaaagtaaaatcattttcttacttaatagaagataaaagttcatcagaaaaagatggaacccttcaggaaaacttcaaaaagtacattttaattttcctttgtcctcctgtggaatttttaactccaggatttgaagctcctctgaaactattgccattgcatgtccttcatctttaactcttccaacactgtttatacatttaatccaaattgtatttccttcatgaccctctattcctgtatcttagactgtctggccttgactttcctttgaagggtataacaagatgaatttctttaaaaaaaaatcaaaataattctaccacatgcctatgttgtttgtgccaatgtgacaatgttggtgagaggtttccttctttcaaataaatatgacatggttgaaatctgaatcctatatactatatactaattcataaaagactacactggtgaacagttatgctgactttgtagaagttcttgatatattccatatatgagcatattcacaactaaagttttgcaaatatcttctcccactaaagaatttcatctttaatggtgtttttgatacagatgtcctcttatgtactttttattttgaactaattttagacacagcaaaattacacaaatagtgcagatagtaatattgcagaagtagtattgcagaagtaatattgcagaatagtacagagagtaatattgcagaaatagtagagagaattcacttataagcttcatctcccagctcctaatgttagtaatttacataagcatagtaaaattatcaaaatcagaaaattcacactgagtaattagctaaagcacaggttttgtacaaatttcacaagtttttcccttaaccttttttttttcctgtttcaggatccaatctagggtcccacattgcatttagttgtcacatctctttactgtctcccaatctgttataggtcttcagactttcctagtctttctcaaccttgacactttttatgaggactggtcagttatcacgtcaaatgtctcccaatttagcattcaagtaggttaaggttatgcatatttggcaagaatactacagaagtaatgttctgttattctcagtgcatcatattatgggttatgatgttgatgatttttttattttgacttagttaaatgtatctttctattcactatagttagtgcttttaatgtttgaattaaagttgtttcctacctcaaggccttgatactttcctatgtattatccttcaacagctttattattttgcttttatatttagatctacaatattaaacttggtctcactaaaataaggaatacacgaaaaatattaactctcatcatttttatttcatattacactgagtcctagccagtgaaataaagcaagaaaaataaataaaatacctaaggactgcaaggaagaagttaaactgtctttctatacatggtatgttgtttaaatagaaaattctaagaaatctataactctacactacatttgtgtatttatttctccttgtacttggatcaatttttattttatatattttaaggcatattaccaaaggcatacaaatttagaattattacattttcttggtcaattaaaatgtcttcctttatttctagtaaatgttttctgcctcaatttttttttttaaattacctatgtttgccagacgtctctgttggtatgcacatagcacacattctccagtctttttttctcaatttgtttgtgtcctcaagttttgtttggattagttggactttttaaatcaaatgtgatgatctttgttcttttctttttcttttctttttgcttcttttctttttgtttttgttttaaagatcgagtctcactctgtcacccaggcaggagtgcagtggtgcagtcttgtctaacagcaacctccacctcctggcttcaaaggattcttctgcctcagcctctcaagtagctggaattacaggtgcttgccaccatgcacagctaatttttgtatttttagtagaaacaggtttcaccatgctggccaggctgttttcaaactcctgacctcaaatgatccacctgccttggcctcccaaagtgctgggattgcagccaggagccactgcacccagcctattttcatctttgacaaatacttcttaggcacctgcagtgtaccaggctctattgtggcattgagtctaaagcagtgaataaaagagataaaaatctctaacctaacaaaccttttctaatataatccaaaaacacaagtgaaatagatatcataatgttaatattttagtgtacattttccagtcatcagagtctttatcagaggtatagttagccaatttgaattcatataatataattttatatcttggtttttagtgagtagtatatagatacattttaatgtaattagatttttaaaaatagacattacttatgtaaagtaaaatttattttttttagtgtaaagggccctaggtttccacaaacacttacaatcatgaaaccaccatgaaaaccaatacataaaacatttctaccacacagttctatcatgtccattttcaatcaactcctctttcctgccccacttctacataaccactgatctatttactgccatataaatgtaatcatgtaactttttgaatttggcttctttcacttagtgttacacatttgagatccatccacattcacacatcgacattcttgtatgtatgagtagttcctttcattttcattgctcagtagtattccattatatgtagttccatgatatagattaaacagtttgtttatctagtcatctgttgaaggacatttatttgttcccagacggggatattttttggtgattatgaataaagccattataaatatttgaatacagaattttgcatgaacatacttttcttttctctaggagagagattgcttggtcatatgatatgtgtgtttatacaaaattacataagaaatagccaaatttttttccaaagtagttgcattaccaccagaaatatatgagagtttcaattccttagataatcatgtcatctgaaatagagatttctttattttctcaatctctatgtattttatttctttttcttgcattattgcattgtctaatgcatctaatataatattgcaccattaagtatgatgttagctgtaggttttacatagattatctctatcaggttgaggaagttccctttaattcctagtttgctcagaatttttgtcataaatagatgttgaattttgtccaagaatttttctttattgagatgatcatatggtttttcacttttaataagttgttatggtgaatgatattgattatttaaattttgagcaaacctggtgcttaaaaactattgtatttggtttgctattgtcttgggatattttgcaaatatgttcatgagtgatattgatttgtaattttcttctcctaactatttttatttggttttggtatcaaagtaatgctaactgtaaaataagtgagaagtaaattcttctctattttatgaaaaagtttttgtagaattgatatgtcttttttaaatgtttgtagaattcaccaataatgccatctaggccttctttgttagaaaaaaatttaactctaaattcaattatttaaatagatattagaagtccaattatgcattttttctgattcagtttttatcaattgtctttcaaggaatttttccattttattaagcagctgatgtctgtagattctatagtgatatcctgtcttggattcctggtattgttaatttaaagtttttcccttttgtcttatcttgtttgatttttaattaatctggtagaggtttatcattttttgtaatctcaaaaaagcagctttaaaaaaattttctctatttttttcccatttcaatttctatttcaattctcattatttccttccttatgctttgtacttaaatttttcttctgtttctagtttcttaagctgggtgctgttattattgattttagatatttttttcttgtctaatataggtattttgtgctgtaaattgacctttaagcatttctttaactgtgtcccacaagttttgatgtgttttcattttcattcaatttaaaatattttctaattttttgtgactttctcttctacacatgggttattcagaaatgtggtaattaatggggtaaatatttggggatttttcagatagctttctgttacttatttcaactttcattttgtttggtctgaggacatactttgtattattttcattattctcaatatattgagtatttttaaggcatagatatgcctatgtgcacttgaaaagaatatgtattctgctgttgttgggtagaatgctctgtaaatgtcagttaggtcaattagttgatagcacagcccaggacttcttttcctgtgcccttactctttcaattatagagagcagaactttgaaatgtctaggtatatttattatttctcttttcagttctatcagtttgagctttatgtattttaaagttctgtcattgggtgcatacacatttagattatatatcttctttgtatattgaaaacttcatctttttattcctaacaatattatttgttaagaattttttgtatggtaatatagccaaggaggttccatttaattaatgttgtatgggataactttttccatccttttactttgaaactatctacagctttgtatttaaagtgagtttcttgtagacagtatatagttgggtcttgctatttttatctaaagtaactatctgtattttaattagtgtattaaatccatttgcatttaatgtaattaatgaaacagttaaattaaaatctgtacttgctagttgtttttatttgttctgtatattctttgtctcctttttgctcatttccgacatttcttttttaaactgacatataagaattgtacatacttatggggtacatagtgatattttgataatgataatgtatagttatcggatcagggtaattagtgtatccatcatctaaaacatttgtcatttatttgtgttgggaacattcaatattcttcttctagatacctgaaactatgtataataacacataattattaactatagtaatcctacaatgttatagagcactagaacttattcctcctatgtagttgtaatgttgtatcttttaacaaatatccctttcagtatgctctttcccattcagtatgatgttggctgtggttttgtcatatatggcctttattgtattgtctttcccctacccttcccaacctctagtatcctctgttctactttttacatctatgagatcagttttttttttagcttccacatataagagaaaacatgcggtgtttagctttctctttctggcttatttcacttaacataatatcctccagttccatctatgtggccacaaatgacaagattttgttcttttttatggcttaatagtattccattgtgtacatacattattttctttaaaaagaaaaaatacattatttatttatccatgtggctactgtgaataatgctgcaataaacagaagggtgcggatgtctcttttatatacttattttctttcctttggataaatgccagtattggaattgctggatcatgtgataattgtgtttatagttttcaaaagaaccttcatatagttctacatagtgactatactagtttacattcccaccaacagtgttatgagttccttttttttccacatccttgccagcattgtttatttttatccgtttgatattgaacatttttaaatatactttttggccttttatgtgtgttcttttgcaaaatggctcttcagatcatttgtttatttttcaatcagattatttattttgttgttgttagttgtttgagttccttctaaattctggatattagtctcctgtcagatgcatagtttgaaaatatttttccccattctgcaggtcacgtgttgattgttttatttgctgtacagaagcttttcaattggatataaaccatttgtgtatttttgcttctgttccctgtgcatttgagatcctattcagaaaattttttccctgaccaatgtcctgaagcatttcccttatgttttcttccagtagttttatagttttaggtcttacaataaagtattctatattgggttgattttttataggacaaaaagtggggggttaattttattcttctgcatatggacaatcagtttttcctagcacaatttattgaaaagattgaaaagaaaccagttatttttcttggtacttttgtcaaaaattagttgactgtagatagatatattaatttccggttctctgttctgttccatttgcttatgtgcctgtttttatggcagtacaatgctgatttggttactacagctttgtaatatatttcgagatccgataatgcgatactcctagctttgtttttgttgttgttgttgtttgtttaagattgctttggctatttgaggtctttgtggttctacacaaattttaagatttttttttcaatttctgtgaggaatgtcattgtcattttgatagagattgcactgaatctgtagattgtttttggtagtaaggccgaagcctggagcatgggatttctttccatttgtttgtatcctcttccatttctttcaatagtgtttcatagtttttcttttacatctttggttaaatttattcctcagtatcttcttttgtagctattgtaaatggtattgactttttgcattcttttttggcctagtttgttgttctttaatagaaatgttactgattcttgcatgttgattttatattctgcagatttactaaagtcgattgtcagttctaagtgtattttggtaaagtctttaggattttctacatataagatcatgtcttctgcaaacagggacaatttaacttcctcttttccaatttaggtgtcctttatttctttctcttgcctaagtgctctggctcggatttccagtactatgttaaataagagtggtgagagtgggcatctttgtttcagttcttagagggagagctttctgctttttctcattcagtattatgttggctgtgggtttgtcatatatggcctttattgtgtttaattacttttattctatacctaatttatcgagaatttgtatcacaaagagaagttaaattttatccaatggtttttctgcatctattgagatgatcacatggtttctgttcataattttgctgatgtgatgtttctcatttattgatttccatatgttgaactatttctcggataattcatgcccacttgatcatgctgtattatctttttgatgtattgttgccatcagtttgctaatattttgtagaggacttctgcatctatgttcattggggatattggtctatgggtttttttgtgtgttgtgtccttgtctggttttgatatcagggttatgctggtctcataaaatgagttaggaagagttcccttcatttcagtctttaaaaaaatttttgagaagaattagtgttaattcttgtttaaagatttggtagaatgcaacattgaagccatctggtcctggacctttctttgttgaaagactttttattacaacttcaatctctttacttattattaggctattcaggtattctatttattcttggttcaaactcgagaggttgtatgtgtctagaaatttatccattttctctaagtttttacatttattggtttatagttgttcatagcagtatctaatgaccctttgtgtttctgtggtatctgttgtgatatctctatttttgtatctgattttatttatttggggcttcttttttctttttcttagtctagctattgtttgtttattttgtctttcttttaaaataaaaacctttaatcaactttttgtttcattaatcctttgtatatgttttcagtctcaatttcgtttatttctgctccgatcattattatctctttccttctactattttggggtttgggttgttcttgcttttctagctccttgaaatgtatcattaagatgtttatttgaaaattttctagatttttgaagtagacattggtttctataaacttccctcttactactgccttttctgtgtatcgtcagttttggtatgttctgtttctattttcatttatttcaagaaatttaaaacatttccttcttaatctcttaattgatttaatggtcattcaggagcatattgtttaatttccatgtatttgtacagtttccaaagtttccctgattattgacttctggttttattccatgtggtcttagaaggtatttaatataatttcaatttgtaaaattttttcgagacttgttatgttttctaacatatgattaatcttggaaaatgttccacgcactgattaaaagaatgtgccctctgcagctcttgggcaaaaagttctgtaaatgtctgttaggttcatttggtctatggtgcagcttaaatcctgtgttcttggatttttgatttttctgtttagataatctctccaacgctgacagtgaaatgttgaagtacccaaatattattttgttatttcactttagatctaatatttgctttatgtatctgggtgctccagtgttggttgcatatatatttaaaattgttatattttcttgctgaattgatccctttattattatataatgttattatttttctcctttttacagtttttgacttgaagtctgctttgtctgatataagcatagctactcttgcttgcttttggtttacctttgcatgaaatatctttttccatccttcacatcccatctatgtatgtctttacaggtgaagtgagtttcttatagggaacatatagttggctattatttctttttgtccatttaggctatctatatctcttaaatggggaacttaatgtatttaccttcaaggttattattgataggtgaggacttatccctgtctttttattgattgttttctggttattctgaatatcttttgtttcttttttccttcctagttgtttatctttgcagttgaatggctttctgtagtaatctgggcatgtaagaccccctggccttccaaccaccacagatgcctttctgcttccccctgaactccagcactctccctttaacatttcagttaaatcttgtttattcattacattgttcctttcttgtcctgactattcttttttattcagtatgttatatgattccattttatttccagtattgatatattactcatgtctcttttaaaaaatattttttacggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaaaaaaaaaaatatatattttttactctataacatatgattcacaatatacatccttaatttatcatagtctgccttcaaatgatattatgctgccttatgtatagtgtaaaacaaatacactatatttccaaatcctccctcccatttttaatgctatttttatcatattgtatcatgagtttatagtgtatgtatattttacatacatatttttaaatttttacatacactataaactcatactacaatgcgacaacatttgctgtagataatatatgttagagcaattaaaactagaaaggtatatttttgccttcattttagttatgctcagagctcatgattactttatgtaggtccaaattttagttctttgtggtaattcttctgcctgaaaaatttcctttggcatttcttttagtgtgcattagctagtatcaaactctcttggctttttcttctctgaaaaaaaaagtatttttttcaatgacatttcattaggtataaaattctatgtttacagtttgtgtggatttttttttgttttgttttgtttttgtctttcagtacttaaagatattacccctttgtcttctggcttgcatagtttttaaataagcagtatgctgtaactcttatctttgaccttctgcttgtagcatttccctttgttgtcatcgccttgaagatttcattttaatctttggttttccacagtttgaatgagatgtatatttattctgcttgaagttccctaaatttctggagtctatggtttgattatttaattacttttgaaaaattcttggtcattatatcttcaaatatttcttctgccacaatcacattctctttctctccccctctcaaccccttcttataacctcttcacttttttcaaggattccagtaacacatgtgctagtctctttcatattgccccacactcttggatgcttagttctgggttccctcccttcaattcttttatctctttgcactttaatttggctaatttctaccacccttttatcaagtttactgattctttcttttgctgtgtcaaatctactgacaaactcatcaaagatatttttcatctcttttatcatgctttttattttttacatttccatttgactctttataatattattgattgtatctagtaaagtcaaatttagtctactttcaaaatactaaggctttttactaaactgtttttaagattttctccattgtctttgggttttgtttttttagcaatttttctctgataatacctaggtgcaaaattatttttcaccgtagtttttattcataagatatcttgttgtttttcaccaggtctggaatattctcagtcattagtttttcaaatattgcttcttatttattctgtcctttgttctccttctggggctcaaaatatatggatcttttcccttcccacactatcacttatgtttccttccctctttctgtatatcctatccttttgtctcttcatgctttattgtcaatattttcttcttacctatattgcaattcattaaattgcttcagttttatcacatttgctatttaactaattcactaatttgtattctaatatttgtttctttttttcaaatctatttttaataacttccagttctttgctaaaattttcagacttgtctcttatctccctgtttatgcaaacagttggtttaaagtctgataattgtttgaagtctgatagcacaaacattggcagccaccatagctgtttctattttccataatttccactggtctcattcatgttgtgttatttccttgtgtgcctagttatttttactgtgggctaaatactgtacgtaaaattattataggagtagcctgatgcctggggtaattttgtatatttcaaacatatatatttatatttgaaaagcttccagcatccccactaatgatccaagattattttaatccaaactgggctgcagtttctgccagagctatcctacttccacttccctcttagtccccaaatcaaaggatagcatgtctaccttggttgatctgaattccaatgttttttcctcagctcagtaatgtgttgctctacctcctagtctctctactaactcttgctgaattaggaaatgtgtcaagaggactagtagccctagaatactgggcccacctcttggatttccacctcctcccagatcttagatcagtgattttttattttcttattagttctccagggcattttagcagttttaaaaaaaaatgtttggttttattttgtttagctttcctcattgtccttagggaaaagatgagtccacattatttaatccatcattattcttctgcaggaatttgtggggtttttttggtttgttttttgtttttgtttgtttgtttgtttgtttgttttagctctgggctctatagattctcatttcttttaagttttgtggtctcttgttttaaagtgctctgccaccaaagtgcctctatttctaacagtttattcactcaaacagctcttgctagttacacaattgaatttgcttaaattaagtgaacatataaatttccctgtatatgttatgatatctccattataagaactttttaatttttttctatgatcatcaagctgcacaatagatcttctgaacttaccccttctatctaactacaattttgtatctttggaacaacatcttcccaacttcctcctccatttaaaaactttcaaaattctttactgtatgcctgaaatagtcttctctctgccttgacaccttcaaatctcagctcagtatttattgtcaaagctttccaaacttccttgatttcagtgtagcaactgtgtatcttactgcaggaatttgagtgtgccaaataaatacttttacttcattttctttacatctaattaaatgtgattttgagatcatgtccctccatgttgctagaaaattcacctttcatttacttgttggatggggctcaggaaattttttccctgctgtctaaattggtataagaatcctaacacttccatctgggaaatggagatataatttacatatgcctttagttcatcgtagttacctcaataaccttattgttcaggctcacatgttcactagaagtcaaatatttccaagccctccatgccaggcttgcaaatggaaatcactgacaagactggattcctgatacttcatatgcagcttcctcaaggcaccccataggtccttctatctcccaaaatagctgctaaatatctagctatggtttcctgttacttgaggtatatactaacttctatcccctttctattctggaggaatctctttccttggtggcattcttctatattccttccctctacaaaaatttctcaatgaatttagacttttagaggaaaaaaaaaacaagaaagaaattagaaaaaggttgccttcaggggcattctggacttggccttgcacacaaacctcctcttaggcaagagatagcaagcatctggttaccttctggaagagaaggaagaaggcagcaaaaacaattcacaaaatatgtcaataaattatcaagccagaagtttaagtccctcagttgttcatttttaaagcacatatacctgttttttttttgtagcacctatcacactttctatttgaaatttatgcatcattattttattaatatcagcctccttaactccgtaatatgacctccctgatagcagtcatcttgactagttttgattgtttaaaagctaacatcacatctggcaatactatacattcaataagtctttgttgaattaatgaatcagtgaatgaataattaagtaaagtgtattctacaagttctctcagttaaaaaggacctaaaattaaatgttttgcttcctttcagctgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggtgaggacaatttatttgatgtgattaaagacaaaaatatgcactttggggttatctaatttgaaaactagctcttgaattaatttgtactaaatctctagattatttatataaacagaagataaagattgagtgaatagtgaaaatgggtaaatcagcctttatgtgtcattctgacatattctacttgtatatattaagatagaattataaataaataaattataattattgtattactctttataaaaatattcttatagaaggtttacagaaatacaacaaacatcaggtattcactatatagaattgatgaatgttaatacatatatatcatatacactttgcatatatatgtgtttatgtgtatagacgtagacatatatactttaaaacccttttttaagaagcaacaataatacatccaattaattactttgtaccacatccccgccccccaaaaaaattctattgccttttctctcttctactactcagatacagtcactttcattaagttggtatgtatctttccagttcatatttttgtgcttgtactaaatatgtatgtaccaatgaaaaatatgtgatattgttttgtatgtttttaaattttatataaatgatattcactagatttttattttgcatttttaactgtatttgtgtttttgaaagctgagattctgtattgtatttttaagttaatcataaggaaacattattttacattaaaaatatttttattatgaatttaaagggtacatgtgaaggtttgttacaaggatatattgcataatgataagctttgggcctctggtgtacgcatcacccaaatagtgaacattgtacccaacaggtaatttttcaaccctcatccccctcccatcctcgccatttttggagtccccactgtctattatttccttctttatgtccatacatacccattgttcagctcccacttataagcgagaacatgtggtatttgattttctatttctgggttatttcacttaggataatgacctccagctccaaccatgttgctccaaaagacatgatttcattctctttcatggttgaataatattctatggtacatatgtaccacattttctttatccaatcatccattgatggacatgaaagttgattccatgactttgctattgtaaatatgtattgtaaatatgtgctattgcacatcaaaatatgtgctgcagtaaacatatgtgtgcaggcatctttttcatataaagattattttcctctcggtagatacccagtagtgggactgttgagtggtagtcctatttttaattttttgagaaatcatctctattctcttaccatatacaaaaattaacttgagatagattaaagacttacatgtaagatctgaaactataaaaatcctagaggaaaatctaggaaaaactctcctggacattggcctagacaaataatttataactaaaacctcaaaagcaaatgcaataaaaacaaaaatagacaaataggactcaattaaactattttacttcctacaagtaaacatgactttagtcatgtttctaatcctaagagtttatgcttagtatttcattctggtagaattattcagactcctaatagattagtgagatcttagtccaagtgttaatatcacaagattagctattaagattaactttctatggcaatcattgtttgaacaaatacagtttcctgaaacaaaattctaaaacaattatgtagccaaagttcacagcctcgtttatcattcaaccatattttcatctcttacaatataaatttttaatattttatgaattttttacacttctcagcaaatggcttagaaactcaatcatgtggtgacaaaatatgtaagttagaatttaatttaaattttagaatgattgatttataaatgtatgctaactctgtctctcatcggtctaaagtctcaatctagtgctttgcgttccaaaaaaaactctcactctccaaaaatgtatactacttggtacttggaacgtctattttctacctatttctctctatgtagaatattctgctgatttctctgtgatttctttagttctagcttttaattttccaattattttattcaactttgtatagtcgatccatttgctgacctattgagattattttaaaagtatttttctaaaattttgatttggttctttttcaattttcttttgtctagttttttctgttgtctagtctactggattattttcctacctttatagctttcaacatgttaaatatatcttcacggaattctttcaaattgttccagtatatattgtttctgcagtgcaattctctgctaagtctaccaattcattctcatggcatattatgctttcttcagtacttagtgattttttattacaggcttagtttttggtgggaattatttcctgtggaaacccgtcttccctggataatgaacatattcttagggttagtttgtttcttaggaggtcctatcattttcatcagtcttgcactagatttttatgtaaagttcttggttcgggttccatatgttgtgtttcatagataatgaatatcaaggtcccttccccaatataaaattatctttgatcactaggcattgtttggttgacctttcaaacctgacccaggatggcccacagcttcttgctgagacattagacattttcttgttgaatttttccctcaaggtagatcttccaagcatccatgttgacatagaatgttctagtttccaatttacactagcttacacccatgatgagattgaaaaccgtaacacatcatctttctttttctataccatttacttagcttgaaatgcttccaactttctctccctcaactaaccgaacctccttctcccttattccttgtgtgcgtttctactcctagaccaatggctctcaaccaggttggtcattggattcatctggctcacttccttaaaggaaaaaaaaaaaaagaaacaaaacaaaacagatgtctatcctaagccaattaaacaaaagcagccatggtagatcctgcctgggcatgggttttttgttttttgaatttttaaaaaatctactggttattctaatctttagccagggttaaaaacctctattttgaacccagtccaattagcatatctttgatgaaaccttctccaatttctccaggaatcagttctctatctatgctgcctgagaactttccctctgtttttccagcactaatcacattgactctctgtatacaagacaaatagccctttctggtatgaaaatgtgccttgtaccttacaccacattctattcccagtacctagacagtatggcacaacgtggtgcaagaggataagaaggtgaaaaagcggatgggtggatggacccaaagtaaaatcctattgatgattaagatttgatacttatttgttttctctaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagtttggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtatgtatcatgttaactttattgttactattaataaacatttcacacatttataaataaattatgttactttctctcacttggcagaaattcacaagaatgcatttgattgctgggagataacagtaactaaattacctacatgaaaataatttcaaaagcaaaatttttaaaaataattttcaaaattgtttttaaatagcaaataaaaagattactggatgtgggatgtattttaatatgttaggtatgatatggagatcatactaataaatgtgccctggcccttaagagtcttgcatttgccctgggagctccagagaagttctgtcccctgcccttcaaaacactgtgtgaattagagaggagtaagatttgttaaatgtgtataaatactgaactctgttcttgaacaatccactattgagagagtttttgatggagagcatctggctcaaggctgttattagagtaacacctgagaattccttccacccttaggaattacaaatgtcaaacaataaaagagctgagccttgaccagaccccctagggctagcttaatgatttatcagagtcctttctagggtaatgaatagcaggaacagcccaggttcacacttgatggagagtcctccgacttcttgccaaaggtggtatatctgatgatagagcatctccagcagggagcactattgagacaccagaaactgctcaacagtaatcaacacagagcagaaagtctccaggcctaaactaaaggagaatctctagaaaccgggaaagatgaggacccactaggcctagcatgtgtcagcgtggactgttgtttggagagagcagatgtagcttagtttgcccaaatggagtgcattataggtgccccctactccacatgctctctgagggggtgcaccaccaattcaaggaaaaggacaggtgaaaacaacagccctgtgaagcccagtccagaaagttggatcgttatactaaatcactatcgaaagaagccagtatcaaaagaagttagagaagtgggatgggtatttatgttcactaggacctgatggataaaggaagctcagagttttgctacatttttacacttttccctttttatactcaaaattcaggtcacttatttattctagtgatcacagagtagacagtcaacatacacctgttgtctagtgttcgacgtgtgggtcagcattctcaccctggctttacacaattgtctcccctgcaagcccttttaattgtttaatgggacccaacaatagcatctcctaaattagtctcccaatatttacttatgaaaacagcccaa

SEQ ID NO: 16069 - DNA, 54816 bp, Human
aaggaggttttgaagacgtgccagtgcagaagcagacctgcaccggccagaacaccaggttcaaggcgtttgttgccatcagggacagtggccacactgatctgggtgttaagtgctccaaggaggtggccactgccatctgcggggccatcatcctggccaagctctccgttgtgcccatgcgcagaggctactgggggaacaagatcggcaagccccacaccatcccttgcaaggtgacaggctgccacggctctgtgctggcgcgggtcatccctgcgcccaggagcactggcatcgtctcggcccccatggccaagaagctgctgctgatggcagctatcaatgactgctacacctcagccaggggctgcactgccatcctgggcaacttcgtcatggtcattttttatgccatctctaaggtctacagcaggctgaaccctgacctctggaaggagactgtattcaccaagtctccctatcaggaattcactgaccacctcctcaagacccacaccagagtctccgtgcagaggacccaggctccagcggtggctacaacatcgggttgtacaagaaaaataaaatgaagtaagcctggaaacaaaaaaactacattaataagaaacatagaaaaaacactaaagaagaaatgttataaagtacccataattccagggtaactttttcaaaaaacatacctacatatttttaaattgttacagtcatacagtacatattaattactatgctataattgcattacacattttcgtacatttctacctaattcaaacattatcatgtaatggctaaataacactcaattatatagatgttctatcattcccattctgttatgcacatgccaaaaatcttgtagggataaaatcactcatggaaagccttttaccgacctaggaggcattctgtattatctctgaatgagtcccacattgcaaatttttcctctagatttggatcagattgctagtccttgagctgagaatcagatgaaacatttggcttccctaacttaagggccatgtttattagaattaattttctgagaatgtatagagtgtccatagctgattccagtaagttaaatgtgtataagactccactttaaaaatcttcaggcatttgggggtatgtgtgctaagtgagagatcttaattttaataacagtggaaactccagactgggcacacctgaagggcaaggactgtgagctccgtatttgtagggaagtaccgaggacagcctagaatccgtctgtggctgttaaatgcggcattttgtaaagacatgcaggaatacctgtgaataagtagttaatagtaccaaaaattattcagagcactttggattgttgaataagtgtaagattaccccagcccatagagtataagaattacattttctaagaaagctaacaaaattaaacccaaaattttattagctaagttgatcacagggaacctagtttagttatattattgggtggatccccccacccgctactcaggaatgcctcatgaaagtttaaagggcatagtataccggctaaacaacttaaatccctatttttggaaaaaagaactagaagcatgtttaaattttttagaatgcaggtaattggagaagatattgagcttattttgctgttgcagattgatgcaccattgattcttgataacacgtcgactcaagcaaagtaaaatctgtaagatttgtaaaagaatgacgcaagcagtcatatataggtatgaatatgcatgttgtatatgtttgggggcattatacacagatttttaagtgattcctggtatccagaaaggattaagattaggaaagtctctgagcttttgtagtgtcaataaacatttatctccactggtttgtttttctgtttccctaaccgttcggcttaaaactggccctccaaaaatgaatctgttagcaagtttatactgatccatcctcgttttcagatataccatcctcaggttctacagagccagaattgtctcaaagcgtacttgatgcttttgaccttgcgcttcccaagataaaaattctgacggagggatttgtggacttgattttcacaaggcctgcgaggtgtttacaagcctcgagggctttgagtagaaaaggtagggtcatgcgctagctagggagatatcggagagaggaagtgctgcacaggacccagatgatagcggtttcaaatactggcttagtctgcggcgggcgcaggtcccctcacccggcaccctgtggttcagcacaggagggttctttctctccgcgggcactgattccgggtcgcggcggacgtcgcttccggagcagcatggcggccactgaggatgagaggctagcagggagcggtgagggagagcggctggatttcttacgggatcggcacgtgcgatttttccagcgctgcctccaggttttgccggagcgctattcttcactcgagacaagcaggtaactcgtggcacagtcagccaggctggcacaaggcccgggctccagcggaaaggcgcggcggagtcggaccgcaaactgggcgccggaagggggctgcgcggccgcccagttggcactgactggtttcaagtgggcttgaggttacccccactctcccgccgtacggtgggaaggtctggaaggctgtaggtcgagggctgtggcatctccagtttccggctttttcacttcccttttcttctggcaactctgagctgcttttttacccgctcccatagcctgtcactttgcctcattacttccgagtgtaaaaggaaaaggacaaagtttgtcgtcgtatttttagatgaatacttctgtgcatccttgtcctctctaaagtcattaactcttaatagagtgtctgtatggtgttttatgtgtaggagcggcagagaacctctaaggtcttagaaactttgtgggaactataaatctaatggtaggcgaaagaggtgtggtgttgcgtgaagcagcctgttaaaagtatcgcaatagctgaagagtgtggtgcggcagagactaagcgacttcatttacagtaaaagctggggatgagaagaaagaaaggagaaggcaatctttgctccgcattgctgtgttttgaagtgaagctcaaaagctgcttgagactggatgggaggaaagagcggcttgtttttgctgtgttctttccccacgttttccaaattctgagttgctggtgtattttgaacactgcatgaccggatcagtttggggagctttgcagattacttctgcacacttggtcaagaaccacattatggtaggtgccagagtacagctgaacaagacaagcatttgtatagagttctgtgctatatgttagtgtagtgttcataggagtatatagacaggcatgtacataatccagatatctttagagaggccttccttaaacacccttcctaaagggaccacttccaatgaccacctcacattacgtatgtattggtttatttgtttaatgtctttctattacactggattataaacttcacaaaggtaacattttcgtctatcttgtttacctctatacttaggactgggctgccctgtccaatctggtagccactagccacatttggctattttgatttgaattaattaaatcaaattaaaaattaagtgattcttttggtagtagccaccacatttcaagtacccagttgccatattggccagtggcaattgtttctatttcaacatttgcaacagcttagtccttttggtcaacattgcactaggaccttaaatagtacctggtatctgagaagcactaagaaatatttgttgaataatgtgagctgagccctgaaggatgaacagattctcacaaaagaaagagtgaaacgtttatattccttcctcctctcataggtgttgatcgattagcagagcctataccttcactgaaagattcagatttccaaaccgaaaggttatgattgtagtgatatgagatgttttaaaatgttgataaattgtttatatcttaatagggattaattttatgtgaattcaaagcttttagataaaaagtcttccatcctgtttttgttattgatacataatgtgcatatttatcgtatacatacactgcttagatagatgcagtgtataagtcctgtgagctgattaaattgtgattgttaaacagttgaactttgcttgcagctatcactataagtctgtgatttaattttcaaaatgccaatgtgtttggcctgttttataaaattccagcttggacaaatccatatagaataatgcacattggcattaaactgtgtaattctgttcacagcataagtaaaacagcacaaattttctgacttatttaactttagtatgagcataggatcgacaccaggtgttatataacaccttggtgcattggttaagcaatattgtatccttttttgtctaatgtttgtcatatgaatagaatttttacatcattttggttttcttatagcctagttaaccgcatttaagataactgcatatgtcagtttctgtagtgattttaagtttttctctttcctaactcacagactttattttctttagcactaagttcttttgtggtgcatgtgattcataactgactttaaaatgcttgtgaagaaactccaaccttttcagcaaaggtgaccggtcacaaagtttctgctgatctttaagacaaaacagtacattgggcaagccacaactcttacctggtattgcagttaaattccacagtcattcatagagtgcctccccatgtgtctaggtacaggtatacagtgttaaactaatgattcaggtgttcctctgttcgtttctttttaccaataggtatgaaaaagctttgagaaggctaatattagactggatatttagacacttattttcagattcaccattttggcaaaattactcttattttcttgtttcttttagcctgaccaataggaataatttttacttttctagtgacaatgactttatgaaaataaagagtgtattgtctgcggtttcatcagagatttttcttttatattgacttcttaaaatgatagttactagtttataatccaagtgaatattaaatcttgggttgggagctttatcaattaccaggtttcttttataagtagtttagggagtttagtgtggttatgagttattcttgccatttgtatttgggtaataggaattagagtagtcctttttattaaggaacaaagtagtgacaattttctgttatttttacagtcacctcttctagaagaagggtttaggcagttagcttttatttcacaaagcatttacaatctagctagtctttgtattctcatgtccctctattttcccctgtgtatcctgtgttgtaacctctctcctgcctcccattctgcaactactttgttctttcgtttcctcccttatctttttttttttttttttttttttttgagacagtctcactctgtcaccaggctggagtgcggtggcaccatctctcctcactgcagcctccgcctcctgggttcaagcgattctcctgcctcagcctctcaagtagctgggactacaggtgtgtgccaccacgctcagctaattttttgtatttttagtagagatgcggtttcaccatgttggccaggatggtcttggtctcttggccttgtgatccgcccgcctcggcctcccaaagtgctgggattacaggcgtgagccaccgtgcccggcccccttatcttaaatatatcacagtctagcagtacatctttcaaagtgtagtggtgggagactctaagtaatggcttgtatgtgctttcaaaaatgcacatacctgggccccttcccagaccttcattggattctgtgtgggccttgggagtctgcattataacacgcatctcaggtggttctaaagcaggctaaagttagagactgtttgccttataggagaaacaaatatgcagttattacagcagtgattcccaactctaatgtgtatgtgaatcacttggggatcttgttaaaatgcagattctgattgcataagcctgggtcattgtatttttagatgaatactcctgtgcatcccagtcctctgtaaagttattaactcttaatagagtgtctgtatggtgttttacgtgtaggagcagcagagaacgtctaaggtcttagaaatttactttatgggaactgtaaatctaatggtaggcgaaagagctgcggtgttgcatgaagcagcctgttaaagtatattgcaatagctgaggagtgtgatgctgagtgtgagccggagatgctgcatttctgacaagtgcccagatgattttgttatggctaatcccctgactagacaaaatgattgtgatattctgagggcattctggaagtacctaagtagctcagcctgaagagagacagggactagagaaggcttcttggaagaagtaatcccaaagctaaatcttaaagaatgtgttccagtgttttgttgttgttgttgttgcaaatggacaataagaagaataaagctggagaagtgagtgttgagcagaaaacttcaattagttctctagtagtggttcaaaatgtaaagggatatggtaggaatgtaatctgaagaggtaggcatgcatcagatcatggaaagctttgtgtgcttgtctagaaacatgagttggatatcatgtaagtgacaggaatagtcatatatatagtcatatatcacatggtacaggaccagaaccagggagaccaatgaggacactcatgtggtagtccaggagagagatgctgaggcagtgaagtagggctagaaaagaggggatgaagaaaaagaaggagtcccaggattcttgaattggaactgctatctggtctggataataaaaggcaaaaggagccagttgagaaaggaagaagatgattcatgtaatagcacttaacatgtaacctccttaaggttaggaagctttattcatttttgtggtgacatctagtctgtagtaggtgttcagtagatgtttcttattgaaaaagtatgatagtagaaaaactattttacaagttaaataattccacagatatgtgactgtacttaaaagtatttaccagttgaatcagccattgaaaaataattataaatgaagaataatgcttaaaattccagaattcatgcagtctttcagtcatttgtttcgaagtattatggcagcatctatgtgctagtattttaacttcatgattaagtctaatgtatcatctaaggctctctcttcactgacatggttatcaattttatttgtgttcttatttcttaatgtagatgcttatttataattttagatgcaatatgatgtagtcataggcccatctggtatctaggcaggaatgtagtccattgtttaagacacttgtttaagacacttggtaaaggatggggttgcaccagaaagggtcaggacaagggatccaaagtttgggaatctagtcaactctcataaattagtgttttcagtatatttcttatatcagtatgactaagttcttttttccactgtccagactatagactgtttttcattctttttttttttttttttttttgagatggagttttgctattgttgcccaggctggagtgcaatggcacgatctcggctcactgcaacctcagctcactgtaacctccacctactgggttcaagtgagtctcctgcctcagcctccctagtagctgggattacaggtgcccaccaccacgcctagctgactttttgtatttttagtagagatggagtttcatcatgttggccaggctggtctcgagttcctgacctcagttgatccacccgctttgacctcccaaagtgctgggattgcaggagtgagccactgcgcccatccttcttgttgttcttatttaatctttggggtatgcgtgtcttaagcctggaatatttgacatcttttggagacacttaggttaaccctcttgtctgtgaattgattctttggtaaagcaacttgattgggggttgggggatgttactttttcatccttgtaagataaacttcttatacatattgttcagagtgagagaagaggggtgaacagaaagatattgtttgcttatttacacttctcaggctgcagattcagattgagttctagggaaaagaagaaacagaataaacagatattctctgaaagaagtaaaaaagtaaaaataacttcattggcttgattttaggtgcgtgtgttcgcacaattacccctctatacacctgtgctgagtcaggttgcccagcagtttattcccaagtagaagtcatctaggaaccataaaaccctacattatactatttctctgggaggcccacagcccaaaattcctttgtgttttttgtggcttgttttaattctctctctttcagttttaggactacttgagaattctgatgtgattggaagaggaatggtttcccagactattttaaaggaggccagatatttgccccaaagtgacttattggttctgtctgccaagcatttctgatgggacctctttttataaacataagccattcaccataactctgttactctcataaaccttatggtctcaccctaagtcttcacctatgagttgaaaatgctggactttcaggagcccttaataattaagtatgcaagattttaaaataccatcacatggctgatttcttgtatttggcacttacatgtagagtgcattcatatccaggagcaagtaacatgacaaacagatcattcagataacgtatacagataagagtatgaccttaaagcaggttttctcaacctcagcactattaacattttaggccagataattcttggttgtatggacctgtcctgtgcattgtagacatttagcagcagccgtggcttttacccacttgatgccagtaactccctcctccactgtgacaaccaagaatgtttgattatgatatattatgttagggtcagtgttcccagtagagaaccactgttctcaaacagtgcttctgaaacctgcctgcacattaaaattacctgggaagttaaatacaaaaacaaaccgaaagggcccagaccccaccttacacccatagatttgattgtgaagtaggaccttgatctctatgttatgttggtggtgttttggtcgtttgtttttaagcagattctaatgagcagtttttaagcagattctaatgagaagcacccctgtggagaataccactttgggacttagacttcttgagtagttttgattgtctagtgttgaaatttcaagtaaattacttgaattttttgggctttatattcttcagttagaaaatcaaagagatggactagatcatttctaaatttcttaattttgaaaaaaatgccaacttgtttttatagccttttgcataaattctcttactacatagcttttactgacaggaagatctttgttttatccattgtctgacctcaagtccttcatgttttcctccacttttgtctctgtcttctttttgcccttttccttaataacgctttaataaactgtattagtagatgcttaattgtacctgactataaatataatcatttactttatgtattatatcaaaaccaaaaaaccctgttagagctctccgggagggttagatgtagtattgcaggtcctttattagttcagtaaatatttgagtgcatacaaacaaagtggaccttctctcatgagacataattaccaccaagggcagtgattttcacactttgttgctattatgtagaggtttttcccatgtctaaaggtttattgtgtttggagaagcacattcctctggggaaaatggttacaaccaagagtctatagaaaaggcctgtagtgttatagactgtgattagatcctaaagtcgttgttactcttgtccctccaaatcatggcaaagaccaaggataatggcttccatttattgcgtgcttattgtgagtaggtaagcacaattactgtataaggtatagtaatgattaaaataattattggaagctgattagaaaagtttaggtatcctgcccagagtcatgtggtcagtctagtgaaattggccaacttgaaatttgactgcagagtctgagctttgaactactgtacaacactgcttcccacataaaggagttccactgcccttaatataatcctgatcttacctagataaattacctctctaattcaaatagatctcagtgtgttgttaggattaaattgagataatatatgagaaatgtcccagctcagtgtctaatacatggtaatagtctctcaataggatgtttcccaaatatttatttctgaagtgcacccaaatctctgtagttttagtttttgcccttaagctttggttggaattaaattactttctgatatctcctcctgttatctaatggatgctgctagtctttttccaccagggatcagagcgataatttgcccttaaaaaaaaaaaaaagagaagaaatcactattttctcatctctcctaaagttggtacagattgagcatccctaatccaaaaatctgagagactccaaaatcagaaacggtttgagcactgacatgaagccacaagtgaaaaattccacacataagtgcttaacactaactttgtttcatgcacaaaattgttaaactattatataaaataagcttcgtgtgtaagatgtatatgaaatttaaatgaatttcatatttagatttgggtcctgtcccagtggggtatcatctcatgtatatgcaaatattctaaaatcaaaaaaaaatctgaaatctgaaacagttctggtcccaagcatttcagataagggatactcaacctgtagtactattctagataatagtactctagatgcacaggagagaagtaaatttattacatacagtggatacctcaggacattaaggcttaactatttcttagaatcttcattgaaaagattacagaatacatcaggtagctctgctgtaaaattttagaccagataatttgaagtgttaatttattactattagtcatatgaattgttagattatggaaatgatgtaacagtactcaatcaagctatactagagactgcttctcaacatgaaaggaattatatataacaaattctttgtgttcaaagccatcggtaagatactgatttttatatgaaagcacaggtttagatttctgatttatagtgtacagtttcagagggggaaggttttgctctatagtttttcattctgccaaagaatgctcctctctgggaaaatagagtgtaagtacatttgtatttttttaaatgttttatatttctcaaagcttattataaatcttttcccaaggaatcatgttatttgtgaacacctttgaattaagacattattctcatattcctccagaattaaatacaagctataattgatcctgacaaattagtgaaaattgacattttcacatatttctaagtcctgtactatttgtactgattagttgtagagaatccttttttaaatctactttagccttcagtttggtgatattctggcttcagtgggtcttgtttgtgtcaatggggtaggattggtttcttaacccccaaatgtccccttttgaaaaattgaaacaaaaggcttgactgatagtattaagttacaagaatatgtatatatatattttttgcttttgcaaggtggaagtattgtttaaattattggaaaattagaatgattttattatttttctagaccaggaagacttcagacttaagtggtatgatagttaagatggaattttacatttttttcttttaggttgacaattgcattttttgcactctccgggctggatatgttggattccttagatgtggtgaacaaagatgatataatagagtggatttattccctgcaggtccttcccacagaagacagtgagtgagtttttagcattttatttttagtgtgactggttgtacctgacataacatgtgttggactagaaaatcttagtacttgtatactgttaacatattttatttatctgtgattttgttgtaatgcagcattgccattctgttgaaatacagtacttaacaaatctgatcataatctcaagaaaacaatttagagttatctggaatttaatagagattcacagttgtggcaccatactatgttgtatacttccactttgatgactacttgttgattatttatagtcagtatttatgtttgattagttctgtagcattaactctgtttttcattcccaacaattcttgtcttttcagtgaaaaactctttgccatcgaaaagttttctttcagtttcctgattattttccctccagtgtttcattagcatttttaatggtttcttaaagctcttatgtatgcttcagtcatttttacacttaacacttaaaaacttttgattaattaaatgaattctcagagttcataaattacgtaatcaactgcaaatatacaagtttttataaactctgttattcactctattaagtataaaatatctaagatagatataacttatacatgttataaattctaaccttaaaaacatcaaacaaacaaactcctagaaaatcatgcttgtttttttttgtggttcgttggttagagtaatcatatgtaaatctcatccagtgaactttggagaaataataagctaaaactttacttagaaagaaaggttttctctgtttggcagacgatcttgaacatagtttgtggctattttattcttgaagttcatagtgtttgtttttatataactttttaaatctatgcctatttacaaagtcttattaaaaaatgatttaagtattttgaactaggtctatcagaattaaatatataaatatctaatcacttttctgctagccccaatgaaagcatgtataagtttggtcaatagttacagatctaacatgttgatgagtaggatttattgaatttctgctaagagtactattcttctaaacctgtagagaagagctgtgataagttgcaagttatggtcctcattttccaggagcatgtggccgaggccacgtcttagtcctagtcacttgcaaaatacatgtcaattgttgttttccctttttgccggatgttttttaataatttaagtgaaagtctgggattttttaaacagttgattattagactgaggtatggtagaattattacagattgtgcttggtatttttttttaattataagtacatgcccggtttttaaagaaatgtatcttacatggtacagataggaaatcatatacacactgtggcacatacgaaagctattccctaagttcttgccgaaatatatttttatattattttttaattaaaaatttactgaaactcgtactcctgaaataaaatagctattgtctttatagaaaaggatggaccataacatttaatgagagaactcaagctgtaggttatagtttccagaccattggtcacttactcaccatgcttcctactttctgtcttttcttctatttccccccactattaaggattatttggtggctccgtaattgagcaattttttggtctgttctttaataagtgtttacttccccctaccattttattagtgaaatgagttttttataacgctattatatctatgttgttttaaaaagctacatacttcttctcattatttaatcttgtgagagatttgctattatctggagtttcatattatccataataattttgtttgttacataatcaacagaatggctaaaaattaaaaaggtggaaaataacaagggttcacaaaaatgtagcaaactggaactctcattcactgctaaaggagttttatagctgctttggaaaactatttggttatatttactaaagctgaacatatgtatgttctatgacccaacagttctagtgtatactcagcagaaattaaaacatgttccccaaaagatatgttctagcatgtttataacagtattttttataagagcctacaactagtaattatacagactacccatcttcagtataatggataaaggatatattagcatattcacaccatggaaaataatacagtaatgggaatgaacagtctacaactacattcagttatttgaatgagtgtcacaagcatgtttatgagagaaagaagtacattgtatatagttccatttttacaaaatacaaaaataggtcaaaccagtctgggcatttggggagtactagaaggaagtgggagaggcttctggagtgctagtcatgtactttttcttgagctgagtgctggttatacaggtgagtttattttgaaaaagttcatggagctttttaattattataggagtacttttctgatgtttattatacttcagggaaagtttaaacattttttggagttagaattgcagctcaccactccttttgagaaccatcagaattttctttcccattaaactgtcaactccatggacttcactggtttgaaacccactgccaatttttttcttcagtcattgctgcttaagttacttaaaatatttttgcctccacctgaattgcaaacctctggaagggagacaagtgaatgtgtcttctatttcttttccctctcagtgcttattgtgtatcagtagttgttagactattaaatcacctgccccttctccaacttttttctcttcctcttttatatattttcacatttagcctaggacctcatctggctcttcaaatattttctaattcataaagcatttgcaaactggtagaatatgctttctgcaactcataggtctgtatttgtcctactttgagataccacataaaatctagggaattataacatctagaaatgttaaacaaaacctggggattataaagcaaaaatttgatagatttgactaaataaatatttaaatactttatgtagtaaaagataaataagtgatgaatttgcagaaaattatggcttgtataatattaacatcgactataaagaattgttaaagattcagaagaaaaagatacattgtcctttagaaaatgacaaaatttattaagtagttaacaaaagaagtacagatacataaaaagatgattaaccttactagaaatcagggaaattcagtcaaaacaatgttacaaaataaatgttcatcaaaagtgaaagttacataaactatggcccagtaaagaatattatgcagtaaataaggtagagctctatatatatactgacatgaaactgtctgtcatatatattagatatgagttttaaatttcttttcaaagaatcaatatgtcagtatgttcaattttttgccttctacttttaaacttaacttcctcgtaaagcaacctttttcaatcgcctgccccaccctgactcattctgattacctgctccaccctgactcattccaattacctgctcctccctgactcattccgattacctgctccaccctgactcattctgatctaccctgactcccaccaaaccactcaccttgtctctctctttaaattagccagttggaattagtttagcctgtttggtctaaccctagccaataggggaacaacacagcagcaggggccacccgcgtcagggatgagaaccccttcccctcccttgtccaagtgtgtgctcaccattgctccatctgtaagggcacatccttctatagaagtaaattgccatgctgagaagaaaaaagaaaattttatatttgagtgctatttcttttgtggcaccgaaactttacttataatatatatgattaaatgataaatttaaaacatatacagaggtgctttaacaatctatataaatgtgcaggaaaaactcagaaaggatacatagaaaatctttgtggagggggaagtagatgggaacagaggtggggggatggcaagataagatactttactgtttttctatatatctgaattgtttgaatgtttaccataagtaaatatgtttctgtatttaaagttttaaactagaaaaatacttagcttaacctctcttcaaaacatacaaaaataaaaactaaaagttcatagctatacgtaaatactgatatttttgctaatggaagaaataatgcaatacattatttactattttataattttcaaagcactgccaaatacataatcagatagatttattcttcacctaattggcctgtcccaagaagaggaaactgagacgcaaagtgattcagagacctgtctgaaacctcacacaaatgataagagatagaatcggattgacatctggcacttctgactccaggtttcaatgttgttttactgtttaagtatatgagtggagacaatcacgtttggcatataaggacattgtgaatatttaattaaaattaaccctggcctccacttaactccaggattataaagaccctagtggtttcctagtaataagtgtatggtgagaccactggaggatcgggtccttctcattaacttcaggagggaagtattcgggaaacacaatgggtcaggttgggaattgtgtgtgcccttctttgagggcacaaccagagaattttagacttagaacagagtgaggactattacagtccatcattttacaaatgaggacattaaggttcaaagagattaataatttgtccacagtaatacagctagttaatgctagagacaagattagaatgcagttttctagtcctttggatattttacttatatgtgctgattcagtgcaataggtgctctgtttaccatgcatgtttttctgtgaggtacagatttttctcatgggaactcagagactgtcttatagctttacaggaaaatctagtatctgttccttaatagatcccataaattattaggattaagtgtttggaaacatagataagaagatttaatattaaagggtaaaatgtttaatgctttcatttttttagtggattcttcagatggctcactttttaaaaaataacatgggggaagtaagtatggtttcatgtggctaagtcaagcgtgttgcatattttaaaaattataagtcatctgttttggaaatattatagatcaagacattttgacaaaaatggttttacaatgttcatttatatatccagcattcccaggtcagatgtctggtagaccattccacagaccttttcacagttcagctgcaattctgaattctcaatttgctatcttgttgagggaaatattattaagtctctaatctctgtgaaagaatatctcctgtctgccttttctttaattggtgtaggtccaattctaaaacaaatgtgtgaaatgtggaaaataggtatatttaaaattttttttttagctattgaatgtttcatttaccttgtttcattactttcttgacatccttaaggagttgtgtaaggcatgtcttcttactaggaaattgtgtttcttgagatttatgtggaattatttctctatccataaaatataaatgttcattttaaaatcagaaagtagccacattcctcacttgaattctgtttgcttagggcaaaaacttttaaaatgaggattagaaagttaagaagttaagaacatgagcaaatcagttttgaaatatatttaagaagcataatcatcattaatagtatggtgatattttggcccaagagctgtcctttattatacctaaatataattttgaatgcaattttatatttcacaatacagtttattgctttttatgaaaagcaactcccctgattaaaataaacctctttaaactctcaaacttttatattccataagtttataaccgttttttaaagaatatctaaatgtactatctttcaatgcttgacatatagttggttttatgagcttaatagtaaaacactaagttttaaagtgacatatgactcagtcatcaggcaagagtcagcttaataaattttcatgtacaaacgtgcaaataaatgaattattcttccttatagttgataactatagatacattatattttctaataacacacttcctgcatacttacacataaacacacacacatattacatccatgtacatactcccatttttgctgcctttctcatctacccagttttcatttttcttcagtaacctcaatttttatgatatagtgctatctaaagtacttatgttaaacagcataaacaagtttgactctatagttctacaaaagtatatttaccaaatcagtagttcttgattctgactatgtgtcaaaccgggattgtttttctttttaaatacaattttccaggccctatcctcatgctttttaacaggcatgggaggggagatgcaagaggcatctctgttttttcaaaataggcaattgattctgatgggcagccagaccacacaaagaattttcagtttgttttgcaactgttaaataggaacactagatggtgctgtttgataacctggaaagaaatttatactgtacccagagtatgcattcagcgataaatttacaatgaattgtgtgtgtatactttcttaattatcatgaaaaggtatgcttactagaattccaaaggaaagcacacaagagcagacaaatattgacagaaaccgcaaaagagtacctaataaatatttttaagtggtgaattttttttttttttttgaaatggagtatcattctgtcacccaggatggagtgcagtggcgcaatcttggctcactgcaacctccacctcccgggttcaagcaattcttctgcctcagcctcccaagtagctgggactaaaggtgtgctccaccacacccggctaattttagtacttttagtagagatggggtagaattctccatgttggtcaggctggtctcgaactcctgacctcaggtgatccacccacctcggcctcccaaagtgctaggatgacaggcttgagccaccgcgcccggcctaagtggtgaaaaattaagtggtgaaaatgttacctcctaatgagcatcattttttaaaacattaggatttaagtgtgtgactgataactcaatttagtaaatgagtaattttcttgatttcttagttacttcatcatagcttttcataagaaacaggagaattctcttactgtagaataaagtataaactttagaataaacttctttatccagtttcatagtccacaggtgattaagaagaaggcaaaaaatactacattgtcttttccctatactgtgaccgtggtgcttaagatccaaacacttttttcatgacagtatacagtctttctggaaaaaaaaagaaaaacatttttactttaaaaaagctttccttgataaattgcaacaaaagctattcatttcttcctgtttcacttttgataaaatacaattaactgattttgaatggttactgtttattaagccttgtttcactttgctaagtacaatctaaacatgtcctttaacctttacaagaagcctgaagtatattacttgcaatatgttattgttactagttcaaaaatggaagaaactggctcagagaggttgttacttgcctatagaactcattgataggaagaataggatcctgagtttgattccaagtgtccatgccataatctcctaaccttatatggtacttttaagtattgatatttctgctgcttttcagaaaagttatttatttaatcaggctaaaaacagaagtgaacaaacagaaatgtcatttactgattcacctctaagaagatgaataaattcatttatttcactcagaagcagatattttattgagccactactatatgtctgcctctatgtaaaacacctgacagaattgtttaagttggtggggtactcaacaaaggtgtccagttgcaagtataaatgcagaactgacagatggtatcagagctgtcttccatcaaaagtagaaatgggatcacatttttatggaggactgttagcagattagtaacttgaaaggataccctttaaaaaagacaatcccaagaacaaaaagagaaaaaaaaagatttaaaaatgttttaatcatataggaaaatacgccttttgatactgcccctcatccaactagagaaggattaaaagaagtgatgataaaaggataggctgggtgcggtgggctcctgcctgtaatcccagtactttgggaggccaagacaggcagatcacttgaggtcaggaattcgagaccagcctggccaacacgatgaaaccccgtctctactaaaaatacaaaaattagctgggcgtggtagctcatgcctgtagtcctagctatttgggaggctgaggcaggagaattgcttgtgcctgcgaggcaaggttgcagtgagccgagatcatgcccctgcagtccagcctgggcaacagagcaagactctgtctcaaaaataaaaaggataaatgaattcataacttggtaagagaaagataactttttattttttttttaagtatagcattatgttcaatttggaatatggggggtgtgttaggtagaatcctttttttttttttttttttttttttgtgagacagagtctcgctctgttgcccaggctggagtgcagtggcccgatcttagctcactgcaagctccgcctcccgggttcatgccattttcctgcctcagcctcccgagtagctgggactacaggcgcccgccaccgcgcccagctaattttttgtatttttagtagagacggggtttcactgtgttagccaggatggtcttgatctcctgacctcgtgatccgcccgtctcggcctcccaaagtgctgggattacaggcatgagccaccgcgcccaacctgtgttaggtagaattctaaagatgttgccccaggatttctgttccctgttaattcagtcaaatactaatctgggtactgctgtgaagggactgtgtagatgggagttaaagttatactaatcaactgaccttaaaatgtggagcttatccataggtgacatgtgtacaggtgggctcagtataatcacatgaacagcagacgaacacagaaacgttcgtcatggaattgcagagaaagggagcagaagagagaagagaaggtagagagggtctaatggaaaagatttgagtgccgttgccactctgagatatggggcccatatatgagaaatggcaagagaggatctaggagcaaaaagggatacctaccagcaaagaaatggagaactcagtcacacaactgcaaggaagttgattctgccagcatcctgaatgagcttggaggcagattgttcccccaaagcctccaagtaaggaaggtagccctgcctacaccttaactttagcctgatgatgcctgtgttagacttctgaccttacaaacagtaaggcagtaggtgttttaagttgccaagtttgtggtaatatgttatggcaacagtgactaatacagagaacaaatttcagccttattcatatcatctcacaccattcatattattttgtttattcccttccagtctttgttgatatgtgccatttgcttaattataaacataaaaatgcacatttatttttggatcctacttttttgcttaacttgatcaaatacatttctctgtgttgctacatagttctactgattattatttttaataggaatatagcgtttctttcagtacatgaggcatgatatgcttaacctgctggacttttatggtgcttctagattttcactattattaaactgcagtgtgcatttcttctcatacttgaaattattggaattgattctcagatatatcatgactaggtcaaaaggttatgagtgtttttataacttctgttatatattggcaagttttaagtagcttaccaatttaaaagtccttaggataagagaaccataatttgactgggtcaaaaggatatgagtgtttttataacttctgttatatattggcaagttttaagtagcttaccaatttaaaagtccttaggataagagaaccataatcactgaaatcataatcaccattagtatcttttttttttttcaagacagtttgactctgtcgcccaggctggagtgcagtggcacgattttggctcattgcaacctccacctcccgggttcaagcaattctcttgcctcagcttccccagtagctgggattacaggcaggtgccactacacccatctaagttttgtattattagtatagatgtggttttaccatgttgaccaggctggtctggaactcctgacctcaggtgatccgccctcctctgcctcctccccaagtgctgggattataggcgtgagctaccacacctggctgctagtatctttttaaaatacatttttcgccagtagggagatgataattggtggagagtttaaatttagtggttcctaatttgttcaaagaattaatgtataagctactattttaagttttttggggggataagaagctgaaaaaatatagtacctaatgcagaagtaggagagtgaaaacagttaataatgaagttagtcatacactagtcataatctcttatgaaggtagttcttcatatcagagactatttttagaccaactcgatttttttttatcagcggtgcatttacagtctgctgatactgcattgttattttctgcatctatcatactgattttctaatagctattaaaaccataattgttgtatagttgattgttctttcaagttcccaacttatattccattgatatcttgagaaatgaaaatttttagatagaaaaaaagtatggataaacatattttgattgagtagagagagactaagtgctaacttacagtgttctacatacttcaaagccaagtggattactggactcagaacgaaggtctagctaatgtggaaatacaaagtacatattttctcttcagctttaaacctttagtttgctcccatgtaaagaagcaatgagttaaagtaaaaacacactaaatgagttaaagtaaaaagacagtagaccctattgtgttattaaccgttaccttgaacaatcacttaacctctgggcttctgttttctgttctgtagaaagggggattgaacatgttgatcacataaaaattgatctgacaggagaagtatgaaaggactgtataggcagtgaggtgggctattaaaaaaaggtacatgatagaaataattatgttttttgtgactcatatggaaattaaatgaggaaattcccataagcacctagaatggacctggcacatggtaagcattcagcattagccagtatgaaaatggagactaaaatagtctgtttctgaaagattgtgtaattaaactgctttagaatctgtgcaaaaataaagtgtactttaaataagcacatgcttttattttctaggatcaaatctaaatcgctgtggtttccgaggctcttcatacctgggtattccgttcaatccatcaaaggttggttctatttggttcagaaggaagtagaagggatgtagggatattttaataaaagagaaaactaagaagttacacagaaaaaaacaggcttccagatttcaatgtggctaaatgttgtctaataatatatatatattataaactgaaatcctttaaaggaaacctatacctactttacttcctcaaagaagtgcactttcttccgggaagaatacatgcagtacataaacacacacaaatttctattaattgttacaaaaaattgtctcagtatcatacatctgtgtgtaaaagttattggtgatttcctgagtaaaggaaaacagagcactgaagtgttttgatacctgctgtgtaagaagccagtaaactttgttgtgtttatagaaagactctacatttagctcacatttcttaggaataaaagaaaaagcccttctaaaggcagtgattgaagacctaggtagtgattattttaatgacttttattagaatatgcagaacttcttcatggttatatccaaaggccttgataccagcacatgccaatataaaaacagtgagtcctaacagagggaggagctttatttcttcttcaaaggagcagacccagaagaaactttgtaggtgttccatatgtacacaaaatacaagtatttttctacagtagaaagtggagaaaagcatcattttttctaaagcggcctcacaccatagaaactttttccctgatggggccagcctgcttatgtaatggttataagccagtatcttgttgggctgagtatccacttgcaaggtaagtggagagctaccagtttttccgtaatcagcttcaaatttttggaataaatagcagtaatgttgaagaagatgacatactttgatagaggtactacttcagctttcttcctctgccttaagctgtaaaccagcttgcctgtgtcaaggtcatatgaatttaccagcaggactccaattatgggtgcccactgcatttagcagggaatgagaaaacaaaggattcagaaaatttgtcccttttcatgcctatcatattttccaccttaagctaatccagaatacaggtaatgtcttcatttagtcataatgaacagaatatcgtgccactagttatgatgaccgttatatagtactatactatatatagatgtctacctatatttgttacagtgctttaataacattacttttaaaatatgatccttcccccaaccaacgcctgcaccaaaacattttcaaaataacaggagtaaaattgaagaaaaaaccattattgcccttggttcacagagtctcctgaaactcctttttggaccttcattcacctgcaccctgatatcttctgggcaagctaggtctcacttcatgctgtattaccttcatctgaattctgggtggtaaaaggaactagatattccaagtggtatcacatagaaccgtcactgagagtggtgactgagcgtctaggagacagattaggccaagagaatgtgaggaggcacattagattgtccagtacagtatatgaataaaatattgtcactgagttttcttctgaagccaccaaactacctatggaccattcactgacttacctgataaatgcttgggaccttcaatggctgtagagcactttttgagaaacactgatggatcctcccactattgtcacaatttcctttcacaaatcccatgctctctagcaaattttgtgttgtccttaatgtgcaccccagaattatccttctctaatttgcgtttactttttcttctacctgtaatacctcctcttcatctatacctgcccaggctcctcttctgcagaaaagaattcctatttaaacccatgttattattatccctcccttatgactactcattacattctattgtaattatttgagtagacttatcttctgctcttaaggttaaggaccacatttaatttatgtttggcttccatgcagttgttttaacatagcaggtatttactttaagtatcaaaaagttaaatatgcaataggaattctaagaagtcagttgtaaatgtggaataggatagccaggagaactagagcttgagttctaaggaggaacttagaatgaaagacataaagatggaaatttgcttggtacatttgtgagaccatataaagaactgcatatctggccaggcacagtggctcacacctgcaatcccagcactttgggaggatgaggaggatggatcacttgatctcaggagtttgagaccagcctgggcaacatgggaaaaacctgttctgtacataaaatacaaaaattagctggatgtggtggcaggtgcctgtagtctcggctacctgggaggctgaggcagggcaggaggattgcttgagccttggaggcggaggttgcagtgagcgagattgtgccactgcactccagcctgggtgacggagcaaagcctatctcaaaaaaaaaaatgtgtatctaaaggtgggtaggtggggtgggttcagattattataaaaagggtagtgaacaccattcaaattcattctgtgaggaaccatagaaggtaagtatgcaagaaaatcttacgattcatgggtggtttcaagacccttggatcttgactccaaagaactagtggtccgtctgatatttgccttgcacttagtcaccattaagataagtaacagctttttagacagtaacttacttaatcgtcacaataaccttgtgatgtactaatatcttcattttctaggattaggaacattaagcaagccagtgagaaatagaaccaggattttatgcatttcaatgattgtaaaagtttacatttattatagaaggcagaagagtttattttaattgtatcgttttttagtttcttatatggtgatcactactgtggtatttcatttagatttgtgctatataaaataagttttgttttagaaatctttttttctggaaggctatatgcttttctgactttataagacttaaattataagtgatagcgtgattaagtttgaggtttaaataatttagccaggcatggtggtttgtgcctgttgtagtcccagctactctggaggctgaggccggagaatcacttgagcccaggagttggagactgcagtgagctatgattgcaccactacagtccagcctgggtgacagataagaccctgttactaaaaaaaaaaaaaaaaaaaaaaaaaaaaaaatccaaaaaaataagtaatacataatttgctttacctgaatatcataactacttccataatgcctgaggtatcaaagaatttaaagattaagtagcctgtgcaatcatattcatattgagacatacataaaatggagatttgtttttctcaataagatgtctatacaaatcagtataagccatatttaattttactatttactaaaaccttatgtcagatttcttaatgaaataagttttcatttcacttcattaattagtactatattaattttgtatttaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggaggtatgagtgattctttgttactttttttgtaataaacaaaaatatattggaactaaaaaatggatacagtactatactagatctttagaggatcatactctattagaaccccacctaaagcttacgaggtacataattaagtgcatagtcaaaaaagtgacctcagatttcctctgtgagtgaaaataatagtaattacaatagccaaacacctttatcttccttcttaataacaatgggtacataaataaatggttgaataatttcaggattggaatctaatttacattctagatgaaaaattgatattttgaagtacgcatacatttagtctggacctcagttccttgctttatggtgattagggaagaaaggggtgaacactgaatattgtattccagagtaggtagtttccatgacatttttaaaggatagaaaaaggagttcgtatgttcattgatatttggtgattcacatagtgtgtctaaagatgaatcttcctggagctttaaggtagaaaaaaaattttaagtctgagaagcgataaagcagtagtgaaaagattaaggaaaagactgcaaacaaatcctgctgtgctgttaactctttgtgctccatctactaatagctctgttttcccgtcagtgttttcaaaacactgctcttgatgagggaaaaataaatgtagacaagtagaataaattgacattaattggaaaccctatgaaactaaatatttacttcatccagtacatatatgacttatgtctcaatatttcagtgtagtctttgattattgcttccttattcttgtttataaatacatacacaacatagattgctgcctctctacaactaatatgtaaaattaaaatacaatatgatcaatcgattaaatggttatctgtgtatacatttagaagaaatttcacatagaaaaacttgggcttggaaatttcgtatacccagtaggtctcaggttttaccttttactttttctgccattctcaagccagtatactgcagctgtccctggctaggatcaaataagcttatgctgagtaagcatccaggagggagtaacatggtagtgtgtaaaaataccaagaagtcaaaagtttgtagtagaatgatgatttagagaaagttttatattattcaagttagtagtcttattctttattgaataataaaagtagaatattgaataataaaagtagaataatcaacagatttttctgttagtaaagacaagcaggaggtgtttctaacccccatgcaaaaaaatcagagtccagtgttaatagaaaatcatattgttgttattattttcagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatggtgagttctgttgataaaattgactatttaggttgtttttgctggtacatgagggctgtattatagtgtatgtctcatctcttccgccaacaatttgtaaataagagcattaagattgctttttggtaaattgtgtatcagaacacaataaagaaataatcttaaagtgcagattgactccttggccattaaaatttaatatgattttatttaaagaagcagtatctttataagaaagggattggttgacttaaaagaaaaataagtaaaatctgaaagtcgaatattgacagcctattctagcaggagttagtagagagtcctgacacgcaaactggaagattatgttatctttggtgagactatttctctcatctttttattggcattagtaaggaaagcttagtcttagccagaactatcctttgctctactgtgtcatctctgtataaaaggagaaataaaacttctgcattccaggtttattatttcccaaatatgaagtttttcattttatagattattttgaggctgttagaatattttaggctgttaattcaacttttcataggcaatatttcaaaatgaaaatgcctgtgagttcctaagaagaatggagttgcatttaagtgagtgtgtaacagtggatcatatttttgtagattccacaacagcccaaattttaaaaagcctctggatacagaaagaagataccattaaaggagttttaagaggaaaagagatttatgtttgataggagggtgggtgataagaatttttggtatgaatagtacagaagtaatactgtcttctcagtgcactgtatttggaggtgcagcaagttgatttgccctgtgtctgctcacttggttaaggtggcatatgccagagttttctctgtaaagttagtgtttttccctttgtaattaccgaatatcttgtggtgagatacctggagactaaatattcagtgagtccctaatcaaatttttatccaatagtgttgttagtatgcattgatgattttccagctctagcatccttcctataaatatcagttaaaattctactgtttgaaaaaaactttctctctgcatttatttatttacttatacttacttatttatatctctatggacttcagtttcttattttattcagtgggttgtaatctgttactgtcattattttgatgctcagattgtcctagattaggcctgtggaaccccttttagtaggctctatgcccttttgacatgttaccctcattctttgaagacctccttgctttctggcacaagatattccaggtttatcttctacttttccatcctcagctctggaatcagtcatttctttgaggagccttggttattcttgttggaggatagggtttagaaactagaatctgggtactaagtatgctcattggtattgcgatgtcattacttctaggccttttctcgggcagagataggaaatgtatgtgtacataggcatccccttacagacacacagaatctatatttctgtatctatttatatgtctatatattaaaatcatgaatctatcgtgatgcctcaaatttcagtcttaacaccacagggctcattttaactttcgtcctttcatttatgactccatttctgatagtgacaagcagtcctggctcctattacccagaatacattggttctttttgttttgagtctgagggcatatagtcaaagtactatatttaagaagtactccagttacttattttatttcccccctttaatatggttatgttatctgtttgaagtaccattaggttatttgtttctctttgaattccattttaggcttttccttcacttagctctctcctgcccacaacttcgttgactttatttatttacttaatatgtgaaaaactaatttggttcttaaggtcagaactatacaaaaagatatatacagagaagtgtgactccttgcccctcaccctccctgtattcccccctcttcttaactcccatacttaacatcttgttccctgtcaccctgtaggtaactattctcgttagttttcagtttatctttcttacatttcttattgatgagaagatatggatatttttaatgcttttcctttcttcataaggtagcataccatattctttttttttttgctgtttgcttttttcacttaacaatatagcttgggagaaaaaaaaaaacaccaatacaatgtgaaaattactccttatcagttcagagagatttttctctttttcttatagtttcctattatattactccactgtgtggatgtgcagatgtaccatggtttttttcagctattctacatttagagcatatattttgcaattacaaataatgctgtaattaataacttcctgcatatatatttctatattgttatagatacatcttcagggtaaatttctggtagtggaattgcctgatcaaaaggtaaatgcatatgtaattttattagagattgcccattttctctccaaaaaggatagaccagtttgttttcctaccaatataagagagtgcctgttttcacatagcctcaccaataaaaagcgttatactttttttgtttttacctttttttctggtagtcgaaaagtgatatttcagtatatttttaattttgctgccctcctctcatgatttttcattttattatttcttttattatgagtgtaattgaccattttcttaactcgagggccatacaaatccagactgcaggccagagttagcctttgggccattgctgacccctagttctagtccattattttgcatttgctttttttttttttccttcttttttttctttttaggaattccattttagtgtctgttcttatttttttgcctgaccttcttttcagccactttctctttgacctttttgacttatctcatttttattctcttggatgttttctccttttttcagtgtcccttgtattttcatttgagattattcttccttagtcatcctgtaatttaaaatttatttcttattttgtctttttcttctatttcttttctaacactatttctctttttatttctattgtttgttcatctgtttttagcttttaatttcgttttttatttccaaatggttgtttgagggtatgtatttgagtgtggagtgctacattacagttttcttctgattcatgcctatttcttgggagtagaggcagattttcatatacttaggtgttagcgtttcatttgctgtattttcatctcagagttactttgtatgttagtgatttttattttttctgataagaattcctagtttaagattgttctcttcattgtaatgcagtatgctttctttactgggtggctttttttgtagctggggttgttctatgatttttctgataggaaaaaggttctcttttgtttctcaggtatctaaattttgcttttttgagctttcctttatcacctgattttcaaagggcttctccctccttttttaactttcttcaccaaaatttacactctttgagccctgccactttgacttgcacattcttttaagtgccttccatatagccagtgctgtgtttaccaggcctctttctgaacaggctatcctcattttgcatgacagtgccatactataatgataaccacacaagctgaaatgatacaaggtgattttaatcatcaatgggaaaaattatgattgttttatgacctttaaaatttttgccaaaactttgaaaactcttcctgtcagttataaatgtatgatgttttaaatagtaaaatcagtatatagtatactatgatgttttaaatagtaaaatcagtatatggtatactataatttaaaacattagaaatattgtgaatattgccttcttctcattatataaattataagatggagtattttttctgtgtcttggcaaatgaccacaatctaagtttctatcagcttccaacgttgtgtgttttgtgttttcagtgttgtgaagtcgctgagaattccttttatgtgaagtttttttgcccatagcagttccctagaacatcttcctctttttttatcacaagctcttcccttgcttatagatgtttcaccttcacttagttcttctggtggtatacctagagtctcaaacagcaatattatcaacattcccgtaatagctgtttcttctataactctaattttaagttcatacccagtgttaatgctttttatttctttactgcactttcatctttgttggccaagcccctctttctgttatgccttttaataaaacatcatgtgggtttatcactgagagacaaagaacacaaccacagtctgctatctgtgtgtgaactgaataacatgagcaatgaccaattcctaacagactttgaaaaaggtggtatgattgatcactgatcgcgatgcacatgtgttatttatgtagtgatttgcagagtgaagagccagcaacggagttttgtactttttgcaattatggttaatatgctgctgtggttactgaagtttgttgtgttatttagctaaaccatggcaactggaatgtgtgcataagagaactgtgcaaagtgagaactgcctgtatttctcatatttagggtggactttctcttaggcagtgattttagatcaatctcagaactactgttagctcccctcctctcatgatttttcataaatcacccttgctctctgcaaaggtgtgtagagttgcaatagacggcttgctgggatttgatgtttctttttctgtagacaggtaatctgaagcttgagtgtgtcttcttgctttgctaagatttgagatttcaaagttttattgttcttcttctgttttgattttggagtgtatgtggggagattcaaataatggtacccaataatggctaccattattctcagtgaccccagactgcctcagaatagacttgtttcatgtttataatgttctatcagtatgaaatccttacattttcctccagctcacgtatacttgcaatggtaaaggagtaaggtttggagcttttattgagtagggattgaatatgtagataactttgaataatctattctcagaatgtgcctagtgtatgcatttagtgatttggcttggtgaataagaagagaaaatcaggtatttgaaaatgcctaattctacttctccatggggaaaaacgcatattttggaagatgtaaaggagaaataaaatttaaagagacctaaaaaacttagttcattggcaacttatttattcatttattattattattatttccctattaaactgaacaatgtttttctttttcagtcctatgacaatggactggcacagggagctggacttgaatctcatggtaagacatcttaaataagtgaacatgtagtttcttttgttcccttagacaacatcttggtgtcttcagtatggagaacctcagaagtttttctcaacccttggtgcagcataattttcttctttgtcactttcctgattctcttttgacaccattttgtctatttgaagcctctttggtcagtaatcattcaggtgttattcaggctgggatgttcatatgatgttttctagtaatctattcaagtgttatctgcatgaaaatatcttgggattgtttcttacactatcattagaaaacaacaggttttctttggcataactctaaaaggctagaccaaatatagaatattaaatatgaatgcacaagttcatgaagaaatgaacatttttattttccttaacaaaattattattagtcatagttgtaaaacattttgctgcttagcttatattcagtgcaaacattaatacagtcttttctttcatgtttttttccactttggcagaactagaataatgatgtgatagtcactaagtgtcagcacatcaatagcctgaattctctcaagttgaaatttccatttggagataaataagcttccattcttcttttctaaaaagaaaaaggccaggtcatggagactctctgagtgaatttcactttcttcctcatcacagcagttttccatataattatttgttatctccatccctttgctagcataatgtagcagaaagaacagatcagtgttcttgtctcagccctgacaccaactgagtgaccttggctcctcatgtaatttctcggagggtttcctcatcaacagagtagaaagaattccatctttctttaggattgttgttagtattataagagatatgggggaaagtggtttgtaaatcataaacctgtataaaaagatatttctaacaaatattccttaatcccatagccttgtatacattctgggattttgtcctatcaagtatttcctcctcttctcacctcttcactccctccttcaatttaggtagttgtagagtatgtgtctctaaggggtatatagaacactgtcctggagtttcctctgaagccatactataattatgacaccatagtttttgtgtgtgcctgagtctctatgagatggagggtgggaggagctggcaataacaattatgttactagtcatcaccacatgatcaagagggatatagttatagttgtacaaagaggaaatctggcggctctaagaatttctaagaagacaggatctggtgtttactattgtaggtggtattagtgtacactctggctaaggagtcacctcacctgtgagacagctgatattatttccaagacattgggattatattctctggaatatgaaacagaggggctgcccaaacatgacactgtctaatgggtcctgtcaggaaaaaatcttcctgagttatacaagtcatgattttgaattggtatggcttgagtaggctgtacccattaggatcatcagtgatgggctatagttcatgcccaaagcgtatatcttccttctatctataaatttggcttggtaggtttgaggcctaaagccctagaggaaggccttttaatcatagtgtcacagtgtatttgtatatcttaaataggttattataccaaagtatagccccttcagcctttggaacaaccaagcaggacctgggtatctggagtccctggtaaggttgtctccggccaggagcatcttcctcagtattacagtatggcctacaaataccaaatattataattttctttgtgtgctatgaggttagataggctgggaagtactaccctaaaggattttggtttagttttctttccccttctcatcaccatctatactagcaagtgaaacctctttctaaaaagtagtcctgcagtttggcaacccatcaagtcattgtgttctctctttttcttttttattgttactgtctttggaaaagtgttccaaatgtactattcacctttcttcacaaatgacttgttctgtaattctctgtgtaagcctttagcaacttaggaagtttgtctttgaaagtcatgagtgatctgtatttcaaatccaatatctttttctcattcctcatcttatatttattgaagcatttgagctattaacctccccacttctttcttaaaacgtcacattccacttgtcctacttcctcatgaattagttctggttccttcaccatctttgtttcttcctgtcacttctttacctcagttcagctttcttttctctgaatagttcttcctaaatctcaaggcttttgtacatgctgttcattgtacatagaatcttcctccatcatcctccacccccagcatacacctggttttctttcacatccttcagatcttggttcaagctcgtgatttaaaattgcaaaccacccagatacacatgcagtatttataatagaattgcaaaccaactgcacatacacatcccattctctaaccccctttctagatttatctttctccacatcacttactattttataaacgacctatgttttatctatttgtttattgtctgcttcttctcacttaaacctcatgagaacagagttttttgcctatgttacaaactgatgtatcctctacacctgtaacatgcttggcacatagttgaacaaactaacagatggttctttattaattatctctgtgttgatggcacccaaaactgtgtttcccagtctgcactgttacttctgtgctgcatagccctctttccatttgcttgcgaggcatctttctcgatatgacttcagtatctcaaactgcatatttttaaaactgtcattctcctcttcagcctgttgatgctattcagaaataacgtagatttattgattttttaaaaaaatttttttggcctgggggaagccagcaatctggaattttgagtttaattttaatctccttttcagtttttgtttttaatttgccagttacaccagttgtcctccataaattagcaacttataatccctgatctacagactaagaggaaaataatgtatttattaaccagctgctgtttgcccactaccatctgatactttacatacagtctcattgaatccccatatcaactctctgagaatagacatttttgtcttagtcagaactcagagaggtaaaaccactatgagtattaaagaataaaggctgtaatagaaatatgattttatacacaagtgtggaagaagatggagaagaacctaaaaggggtagttggagggtcagggaaaatcactgacaagtctcctgaaacagtggcacaggtggacaagtcaggccatacagggaaatctagaaagccagacacagtcacctgccagattgtgactgtggtggataagtctgtgaagggctggtgctcctgcatctgtatgtgggcctgacgtaaccagggcaagagtaagaagaatttggatgacaagtatatgggagaatgagggcaagctggactctaccagcatcactgcctttgttgcttacctcctctaaccataaccagggtaatgagtgttacttgacttccaccatacaagtctcacacagattgctctaacttttgaccatacagggaagtggatcctggggaacagaattctagcttagccaagttgacacagtagaaaaccacaataattattgttatttcactcagagaagtcacttgcttagtaggcttacatatcaggttaagtgtcataacccactttaaaaccctgtgcttgctcagtaatctcatcctgcctacaattaagtcccttagtttattcctctgtaatctgattccagtctagctttgtagacccacatctgagtgaccccttccatgcactctaggttgtaagaaaacatactctccaaacatttgtatgtggcttttcacctctggacgttgctaatattccttttcctttgcttgaaatgcttcctttccacttgcttctgcttgtttctcttttcataaccgtcagagtttaatctatctttctatacctgtttccaggggttcaagtgtcaccttctctataaaacatttcttcatcttttgtcccccttagttctgagcaaaatttcccttttctgtattcccataatacttcattcatgccatttttatggtacttacctctgtttatctttgctggattgtaagctggtcatatgtcttattccatatgcccttgtacaatgtactatttgatgaattagttatcctgtattccactttgcatctcttgcttggaaagttgaatttggaatgtgtacttctgttagtttgttattaatttagtttcttcgtgtgcctttctcattccccaatttaaatattattttatatatatatattttaattcaactactcttctccaactgtagcttagcttggagcccatttttcatgaaaactaaacagacatattttatccttttaggctgtgatcatcaaatgtagtgattctctttatccccatgattcccttgagatagtgcatgttgagtgtcccttatccaaaatacttgggtccagaagtgttttgggttatggaatatttgcattatacttaccaattaagcttccctaatctagaaatcagaaatttgaaatgttccagtggacatttcctttgagtgtcatgcaggcgctcagaaagtttcggatttgggagcatttcagattttagaattttggattagagatactcatcttgtacagttttagggtaaaatgttccttttgttttggaagaattgaattttcctgctttgttagagataaaactattctcgctgcccccacccccacccccgccaactcaggattcataatgcagttcagataaattaatttggttccatgattcttttaaaatatctctacttcttaattataaagataaatattaaatctaaataatcaactcccttgaatttacttcacttggccgggcatggtggctctgcctataatcccagcactttgggaggccgatgtgggtggatcacttgaggtcaggagttcaggaccagcctggccaacatgatgaaaccccatctctgctaaaaatacaaaaaaaattagccaaatgtggtggcacacacctgtaatcctagctactcgggaggcagaggcacaagaattgtttgaacccaggaggcggaggttgcagtgagccgagatcacaccactgcactccagcctgggtgacagagcaagactgtctcaaaaaaaaaaaaaaaatttactttacctttttaatatggtgtttaattgtaaaatgatgtacttatttatgtacctatttatttagttttctactttagctatatgatttttgactaccttaaatttcagaagacatggattctttctgataacttagtatatacaagtactaagagaatctctaaaactgagctggaaaacctgtgggagcaaaataagttataactgttacactgttaaaatataagtagatcataacataacagagctgaagtcaggaacacctcctttaccctgcagttggaagaattggggtaggttaagagagagtctctatggtccctttcatctgtgatgttttatgactgaagtattctgcatatgctaattctccatataactgaagcacatcacgtaggtggcaaacttttaaccatttcagatgaaaatctttcttattcttttatttgtatttgccttaatattcttactattatccttaaacttttgttcatactatgtcttcaactaaggcataatgagcacagtttcaccttttcttgatgaattcaaatcattataataaagaacaattctagtattgtacttttaatataatgatatagtattcttgaaatattttgaagtgtgtacacatcattgatctaaccccattcagccccaaaaagatattccattttagttcttgtgcctgtttttaaatagaattttgtaatctacttatcaaaatgtcacttttcttttcttcctgtttttatgtctgcctttaacactcttctaacatactactacttttttttttttttttttgagacatagtctctctctgtcgcccaggctggggtgcagtcaagggatcgtcctacttccaccttctgagttgctaggaccacaggtgcacaccaccatgcctggccaattttaaaaatatttttttgtagagacagggtctccttatgttgcccaggctggtctcgaactcctgagctcaagcagttctctcactttggcctcccaaagtggtgggatttacaggcatgagccaccatgcccagcctaacatactagtttttatacagggttttataactagttttttagagatttgtgtaaaacaagagactttaggagcaacaggcttacctgttggtaaatgaatgttaaagcatagactttgtaaatgtttctggcaatccagagtccaaacttacttctggagttactatgttcaaaatccagtagtttggacaaagtaaagagtgtttttctttgagttgtgccagtttgcattaagtaatcctaataagtagtttgaggagtaatccttaattgcctctttttacttttcgggagtttgaaaggttacttactgtctattagagactttatatttaatgatgtaataaaacttgaagtcatggcttggttatcatgaaagaaaaattggaactagtgagtcatttgaaaaggaaataagattactagttgcttaatagaaattattttaaaaggttgtaataatttttttagcttttcttttgattcactcaagactaacatagatgtcccaactaattctgaagattaaatagttcttaactgacagtaacacttctaatatgataactaccttgagttttctagagggaatgctcacctttcctttgccagagaatacattcaagatttgtaacactgaaaggaaagttaaggcatgagatgtattaggaacaaggcatttaaattgctgaaattaataaaaatcactaggtgaagtcataataaattgcaagtataagtattttcaaattatttggagttgacaacaaatagtgccagtaaaaagtgttgtttgttttcttatatggaaaaatactgacttttcatttcctgaggaaagtacctttgtgagtgtattagttttctatcgctgccataacattttagcacaaatataggggtgtaaagcagcacaaatttatcctctccatttccggccagagctgtacatctgtaactaagtctgaactgagacttacagggctaaaatcaagatgtcagcagggccggctcctttcgccaacagtgtctccagaggagaatctgtcccttgactcttcccagcttctagtggctgctggcattccttaccattggctacaacactcaaatctctggcaccatagttgcattgccaccccctctctgttagtctaatctccttctctcctcttataatggcacttgtgagtacaattagggcccacccagataataccgaataatctccccatttcaagatcgtttaacttaatcacatttgcaaagcctctttctccgtataaagtaacattcacaggttccagggattaggacttaaatattggggaggcattattcagcctacgcagtgggtatggatacgttttgaagtaatgctgtgcatctgctttcatatttggtttccctctttcctaccgcccccatcccccaccattcttttcttccttaaaattcttttttttttttatactttaagttctagggtacatgtgcacaacgtgcaggtttgttacatatgtatacatgtgccatgttggtgtgctgcacccattaactcatcatttacattaggtatttctcctaatgctatccttccccactcctcccaccccacaacaggccccggtgtgtgatgttccccaccctgtgtccaggtgttctcattgttcagttcccacctatgagtgagaacatgcggtgtttggttttctgtccttgcgatagtttgctcagaatggtggtttccagcttcatccgtgtccctacaaaggacgtgaactcatccgtttttatggctacatagtattccatggtgtgtgcattttcttaatccagtctatcattgatggatgtttgggttgattccaagtctttgctattgtgaatagtgccacaataaacatatgtgtacatgtgtctttatagcagcatgatttataatcctttgggtatatacccagtaatgggatcgctgggtcaaatggtatttctagttctagatccttgaaaaatcaccacactgtcttccacaatggttgaactagtaaataggaacacctttacactgttggtgggactgtaaactacttccttaaaattcttaagctgactagttgtagtatctgtatatcagcttctaacttgtttatcttatttgtgaaaacttgtttgtagcttagggttgatggagcctcaattcataagcaatatactgtctttaagagagttaaaaatcagtctcaggtgattgggtcctgggcagggagttagcagtcccggactttagttccaaatctgctgttaaccatgtaattttaaacaagttccttaatcttgttccaagtcttactttttttcataagtaaaatgtttcttatagctttatattctctgttttaacaaatattgaagacttgtgtttagtggttattttaaaatctcatcttttaaatttaaattttatttcactattttctagaattatataaccactttttccccttgaacattttgtactattttcataagcatctaatttgaagtttaaaacgttgtgtggttttgattaacaggaggatcaactttttgtggcattgcctcactatgtctgatgggtaaactagaagaagttttttcagaaaaagaattgaacaggataaagaggtggtgtataatgaggcaacaaaatggttatcatggaagacctaataagcctgtagacacctgttattctttttgggtgggagcaactctgaaggtaagagaaataataaaaaatgagaaacctatattctgtgttcatatagattgtgctaaaaaggtttgatctttgtaatgtgtattaaatattgttaggtttaggctactggattttctcttttgctctgccaaagctagtctctgtatggtttttccatagaaatcagtgatctcttgtgctgcttgaaaattttcattcttggaaaactcaagtaacccagaacttgagttttatgcctacttaaaaccttacatagaacatattaaatacttactttcttgtgggtataaggtaataaaaaagttggaactgactagttcatataaatcagggatctgtctgaaaatgatagcagtaaaggttttatgggaaggtattaatcttaaaagacaaaccatgggtcatttcttcaaaaaccatgtaaggacttttttattatttatttgtttaaaccttctgaaactcatcaattgacatgccagcacattttttcccatctctactaccttttaatatacctaattccgtaaggttatttagtcactaaatacacacaagttttctctgtcttaaagttgccttttcatctttaagaattgttaccttgttctgatattctgccatgtaacaggagtctgttagaggagtccatgtttgtcttctccataatatcctaattttttctcttaaaatttatgtataaggttgaaaaaaatttggaaaagaatggtttaaaatgatgacagtagtctccctgtctctcctcacttgtagtaccatttctcaggtgcatttcaatttttttggactgtgggaaatttcaagcatattcaaaagcaaagagaaaggtataataacacccatgtgtccatcaaccagtctcaacaattatcaaccgaaagctaccctttcttcatccatactctaattcccttcaattcactgaattattttaaagcagatcccatatatcattttttatattctctggaaattttttaatataatctctaaatgaaaataactttttaaaaaaaacagaaccttagtgtcattatcacatctaaacaattagccataatttcttattatcattaaatatccagtgatttcctgttgtatcacgtatatttcctattgtatcacatcaagaggcatgtaatatccaattatctctccttttaatcaaagagctccacagttgaaaatatacatagcacattatactaacagtttaaacatttgtaagtatacagttcactagcattaattccatttacaatgttgtgtaatcgtcactaccatgcaaaactttttcattatacccaacataaatcctgtatacattaaacagtaattccctattcttctttcccctcagcctggtaacctctcctctgctctctgtcactatgaatttgtctattctaggtacctcatataggtgaaatcatacaatatttgtccttctgtttctggcttatttcacttagcataatggtttcagggtttatttatgacatggcatatatcaaaatttaattttttaatggctgaataataatattccattgtatatgaataccacgttttccttcttcatttatctgttgatagtcacttgcgttgttttcaccttttggctattgcaaataatactgctaaaaacatgggtgtataaatatatgttcaagtccgtgctttcatttttcaggggtactgtatgtatataggagtggaattgctgggtcatatggtagttcttcatttaactttttgaggaaatgccaaacttttccacagcagctacaacattttgtattccctctagcaatgtatgagagttccattttctctacatcctcaccaacatttgttttttctgtttgtttttatgtatatatattaatataatagccatcctaatggatctgaagtgtcatttcattgtggttttgatttgcttttttctaatgatattgagtgtctttctgtgtacttattggtcatttgtatatcttcttgggagatatatctattcaaaccctttgcctatttttaaatctggtttcttttgttataaagttgtgggagttcatatattctggatattaatcccttctcagatatatgatttgcaaatattttctcattccttgagttgcctttttactctgttgatggtgtcctttaacgcacaaaagttttttgatgcagtacaattttatcaaaatttttcttttattgattgtgttattggtgtcatgtccataaaattattgctgaatccacggtcgtaaagattttccccagtgttttcttctaataattttatggtttcaggccttaatgttgggcctttcatcaattttgagttaattattttatgtaatgtaaggtaagatccaacctcattctttgacatgtggatatctaattttcctagcaccatttgttgaaaagactgtccttttccatgaaatggttttggcacccttgtcaaaagtcagttgactatatatatgtgaggtttgtttctggacgtcttattttattctgttgttttatatggctgcccttgtgccagtactatactgttttaattactgtagctttgtagtaagtttcaaagtcaagaagtttgagacttccaacttttctttttcaagattgttttggctatttggagccccttgcaatttgatatgaatctggtaattgactttcccatttctgcaaaaaagtcttttgaaattttgatgggaattgcattgaatctgtagatccctttgggtagtagtgatatcttgacactgttgagtgttcctatccatgagcacaggatgcttttccatttatataggtggtcttcaatttctttcagcaatgttttgtagttttcaacatacaaatctttcacctttttgttaagattaaattctcagtatttaatcatttcagatgctcttgtaaatgaaattgctttcttaatttccttttggattgttcattgctagtctatagtaactaccaactttttatggaatagttttaacaggcattaaggatcattgcttaaatcaattatggcattaagaggttacaaaacagtggtattctttcattccttctcaatttattaactagcattgttttttaaagaagaattttaccttaccctgagatatactttgtacagagaaggacagataaatactgaattctttcccttaatagtgttcaacaaaatgagttggttccctaccatcccctcagcctttccaataaaatattagattttagagtttgggttttttttttttttttttgagaatcattgtgaacacatagattttaacattttttagtcatatattatatataatatatattagttatatatgacatatatatatatatatacacacacacatataatgcttaaattgtcctatctttagtctataagaaccctttcaagttgtcccaagtcttttttatttgacgtcagtagtctttgacagctttctgaaggcaaccacttttaaactttttaaaaatgttttaattcttgtggacattaccataactttaaatcacagactgacttcttatcacctttagacattattgatgattcccaactatgagaaattaagatttagcctctcacttttccaacaaattgttacccgttatagttagttctgaatattttcctcatcttctaccttccaatgctatataaggttacctttatttttataatgttaagttaggacacattcatatatttgttcaatattaataatcacatctttcagcctttgcctataggttgattctaaaatttaaaaaccagtaatcaacacttattatgggatagtgaaaatattgtttattgctaagccaagtgcagtgttactattataattttttcatttttatgtaatgaccagtgtgccactgatggaaaatattcctaacatcaagattcaaaaaagtctttttccttatattttattaattaaatcaatgtaaatgaataaatttgtttcctgtttgtaccataactttcttatgagtttagcttttctttttgagaaataatgcttcttcattagtcactaaaagctgtggctctctctggttcattaacatatattaaattgctttgtatcatcagaaatgtcttgaaccctcttacctactgtgcacctcatcttgaacttcacagtattatttatttatttgtattttacttttatggggtcttgagagaaaagccaagtacatgtcctaaatcattaaaaactatatagttttttatgttgcaatcatttttgtcttacctttttctttcctaattaaagagctatacttttttactattttcaaaactgtctgtagcatctggttagtaatttttgtttgctctttttttaaaaaatatttttaattccagttactactagtttataactaatagctcaagagcttatcataagagttaaaatatgggtagataaaattgtactttttaaaatgactgattatgttgagtggattcgagttgtcttttgaatttagcttaatgtgatttaaagggttcagttggcctggttcagaagaaggaaatagagagtcgagaaaaggagagtagatttgataagaaaattaaaaagttaatgtgatttactcatttcaaaagtgctcaaggccccagagacttggtctgagcaccttagctaaagaaaagcatatctaaatgacacgtatctgaaatttgagccaaaggttgatatgagttttatgtcagtaaatttttatttgtcatgtcatttcagcttctaaaaattttccaatacactaactttgagaaaaatagaaattacatcttatcaactcaagatcgccttgtagggggatttgccaagtggccagacagtcatccaggtaattattttctttgtgaatcagaacaacctttatttcctgaatagatcttcaagcatctttatcagaaaaggcatatgatagaaaatatatccagttgcaaagttacattaaataatattttttaaaaggtatattgtgtaagcttaggataaatttagggtattagagagtataaatgaaagagtttattatcaagatgcatgggaatagtgtgcattttttcccaaatattttacttagtaatgttttatttcatttgcagcaataatgtagatggtctgaatgggtcctttccaaagaagagaattatttaggccatccaaagccgttaggattattagtcatgacttgaactaagtataataaattactcccaatcctgaagggaatcagttcttactcttttcagaagtcattaaataggccgggcacagtggctcatgcctgtaaccccaacactttgggaggtcaaggcaggtggatcacttgaggtcaggagttcaagaccagcctggccaacgtgttgaaaccccgactctactaaaaatacaaaaatcagccaggtgtggtgatgcgtgcctgtagtcccagctatgcgggagtctgaggcaggagagtcacttaaacccaggaagcagaggttccagtgagccgagattgcaccactgccctccagcctgtgtgacagagcgagactctttgtctcaaaaaaaaaagtcattaaataaaatatttcaaatcctgaatatatgtgtttctcacttcccatactcttgttctccaaatttcaacagattcagacaatataaatggcatggcactcaaggcccttccaaaatttggctcctctcccacctctagcatcattctgcagcctacacctcacccgacatatgttttcacctccagcaaaatgagtctatatacagcttccctataaaaatccatttaagtgtgttttgaaataatttcaaacactgacacttttgataagcaagtagttaaagaattagttacaaatatgaaactagacacaaggaatgattgtttttgccagtattgcaatagagtcgtggtttttattatcagcctggaaagtgcctcatcaactcatcttccatcacagaactgctgtggttggaatgtgtgattgaatcagaatataaataaggagctcatgaaatcaatttttgtatttgaaatgagcaggaatatttccttacacccctacttgcctatattttcatataaaacatgcttcctaggccaggagttttggctcacgcctgtaatcccaacagtttgggaggctgaggtgggcggatcacttgaggcaaggagtttgagactagcctggccacatggtgaaacattgcctctactaaaaatacaataattagccaggcgtggtggtgggtgcctgtaatcccaactacttgggaggctggggcagaagaattgcctgaacctgggaggcagaggttgcagtgagccaaggtcacaccactgcactccagcctgggcaacagagcaagagtacatctcaaaaaataaaataaaataaatggccgggtgcagtggctcacgcctgtaatcccagctttgggaggctgatgctggtgaatcacttgaagtcaggagttgaagaccagcctggtcaatatggcgagaccccgtctctaccaaaaatacaaaaatagccaggcatggtggtgcacacctgtagtcccagctactcaggaggctgaggcaggagaattgcttgaacccaggaggtggaggttgcagtgagccaagatctcaccattgcactccagcctgggcgacagagcgagactctgtctcaatcaatcaatcagtagtaaaacatgtcttcttagagaaagtgtacattgctttcaaagtcgtaagccaaagtgtgtcttcagaagttaatttctcaagcaaaataatatcttgaaatttttgatatctctagtgcctcaaaactgagaattattttggtcttcattccattttttaaaccagtgcagggtactgttttaacaaataatgggagtagggaaatgacagtctcttaggaaacatttcttgtataaacatacttgaaatacattcagtgtttccaatagcttttttaaaagaaagttcttgaggctttttccggagagttcagttgctaactttaacatttgtgtaaatatttggatgtactacttactttttacagatacattacaatgttttcagagtatgcaatagaaagcatagaagggctttgctaaattgaatttatgtgtaaagatctggtcccagaatctttaatcattttaacaagattctttaaaattaagcttattcttcattctagtgaatttagtggcaaatttgatacaaagggattttatatacatttatgaaagaaacttcaaaagaataaccttttattgtggagtaaatatatatttcaacatctaaagtgctttattatggagtaaacatatagttccacatctaaagtgcttgtacgttgccacttacagataaggagtttttttaaaaacacaatttgaggcttcaaacaattgagttctgatctcattggctgttacaaaaatctttttgagaaacaaataagttttatttgttactttacccagagagattttagttttacacagttctattttatgttattatagatatatattttctgttgtactttttcctagaaaagtttcctagtttctagaaaacaaagcttaatgttgctttgtaccctttgtagttttagaataactatatggatgtaatatgacaggtgaaatcaagtttattttttatagtctgaaagtcaaaggaaagtgagccagaagaaacctaagtattttctgaaaaggcctaaaaggtgatcaacatgggcctccattagttaaataacattttcacaatggcattgagtaagcacagctatttgtcatttctgttttgaaaaataagtgatactgttgtaagtaaagctttttctttaactcttttgacaaagtttgatgtggtaagatgtgttgaactttttgttgttgttgttttgagacagggtttcattattttgcccaggctagagtgcagtgatataatcatgcctcactgcagcctcaacctccctaggctcaggtgagcctcccacctcagcctcccgagtagccggaactacaggcgcacgccaccatacctggtaatttttgtattttttgtagagatggagcttcaccgtattgcccaggctggtatcgaactcctgtggctcaaggaatatgcccttctcggcctcccaaagtgctgggattacaggtgtgagccaccacacccagcctgttttgaactttaatagctcttaaggccataaatgtcggccaattcaaaaatagaaaaaaattttgactggtacaaaactgtctttttaatgttcctataactgcaaagctctgagctcttcagaagtctacataagactcctaggcaggaatggccatgtgatttcattggccactttaatagaagaggatcgctgccccctgaaagatgggaaactagtgagccagtgcagaattgtcatggtatgagcactcatattatttcaaccaaatagaatgtgagtttgtttttattgtcagatcagatatttttacaatgactgacattaccctaaataggaggattaaatatggcacagcattccagaatggattatttttgcataagctccttttatttaacacaatgttaggatagtactgcatatggtttaggaactttcagaggtaaaacgtggagcgagggatattgcaacttagattcagagttttgttttcgttttaaagaaaaaaaaacttaatgatatagcattgaagctactcgttttcatgttctctagtaagcaagaggggaaactccccaaagtgagaagtcttacatatgactgctgctactcctgtcttttaatcacagaggttatggacagtatcagctcttcagctggaaactgttttcctttgttaatgatattttcatgaataaaatattttattttgatcatctgagttttttttttaattggtgtttgaggctttgagaaagcaaatatttttaaaactatattagcatttctctaaacttacttttaatggagtgatgggctggtaaatatgtggctaaaatattctgtagaatgtacaagtaagaatgcctattatgatgttttaaatgccttcttttcagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatgactgattttagattgggagggtggggggatttgtagcataactgtagctcaagtttaaaagccatgtataaccaagtgtgctctttttttaaaaggtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagttttgtgctatgtgggtcatttatctagacattgctgtggtgaataccagttatgtttgattttattctcaaatcattagttgccttttttttttttttttttttttgctttctaggaagaaaacaatcttttttatctagaaggaaagatactttgtgttttcatttttagccatttgaagtttttaatttattgcccccagtgtgttagctgctctaatttcaaactaatacttttctaatttttttcaaattaaataagtaaaaaatacaaaaacagaaccattcaaacagattcagtggtgtaactcaatacatggtcatttttattctcatattttcaggtaagtgaaagggaaatgcgaccatttagagggtaagaaatagggttttgtttttgttcattgttttgttttaagtctatgaactagctaattataaaggaggtagtataaaaactcttcattagtaattaatttatcaataactcatatccgttacttgctcagtgacattcagaactattgcgtctagtactgaaatggggaaagaaatctcttcactaaaggagttggctttaagttagtcttggtgataataaatgttgaaatacaagtatcagtataaaaactggattactggtatcactgtttaggcattgtaatactttaaatgttatctttttttctaaatcagagggaaaaaaatgttgtgaaataacagtccttcccaagggaaacactgtgtacttggagaaatgattgatttattattggcatgcttagttttaaacctgagtttgccaactgtatgttttttaattagaaataaaataaatcttctgatggtgggggaaaaagtaagcttaataacagatgttatccgtctatgggttattccagttgctactatttaaatcctggcagattaagacatccatatctcaaactaagtcatctcttagacattggaagttaaagtagcatatatataatggctttaggactatataaaaagcccaaattgttttttctgtatcaccaagaaaggttagaaggcaataaaggtagtaacagtgattttattcataaatgttagagaaaaattccaatctaaaagtatttcataaggctaaatattttctaactcctgataatttaataccataagattataaattttagtatgcttctaattgatacacttgtgggagactttcttgtgaaactttatggactagtaaatgttcacattccacagcaactgaattgaccagaaaatagcagcccagtgtgaattgtggag

SEQ ID NO: 16070 - DNA, 275110 bp, Human; identical to SEQ ID NO: 12706

SEQ ID NO: 16071 - DNA, 62463 bp, Human
atcgagaccatcctggccagcatggtgaaacctcgtctctactaaaaatacaaaaattagctgggcatggtggcacgcgcctgtagtcccagctactcgggaggctgaggcaggagaatcacttgaacccgggaggcagaggttgcagtgagccaagatcacgccagtgcactccagcctggcgacagagcgagactctgtctcaaaataataaataaataaataaataaataaataaataaatagttgttgaatgcatgtctgactgattaagccaaaggcaccatattcaaacaaaatcagacactggtgcaatgccaaacagcttctgcccgtgcaaggaatgatttagcatggagcacagtcacctgcagaggaacaacttggaggcagactctccttactcagctcacttggagcagagcttcctgagttgggggttcttgacagataagccctccagcttcagcagaagcaggcttggagctgccacttctctgaacccccttgcacttactgtcagtcactcacaccttgcacttattcacatcctatcctgcctcgttcttgaatggagtccatggtgagccttctctgtgccgctggatggtaagcttcctggggacagggaatgggtctgatagtttccttggagcccctggcgctcccggcactgggctgttgatacgtggggctccggaaacactgtgctgacctgtgaaagggactggcctaaggggctgtggattgtcctgtagggtgacttctgaactgttcttcagcctgggcagttcccaggtttatttggggggatgcctgggtccaaagaaccagggtcaggggcccaggggtttcttcctggagacaggatgcctggcgccttcaataacggaaaggaaactgagaaactttctgaggccaagataaagagtatgcaagtgaggggtgcagagagagcagtttaggggcagcaggccccaaccgaagcagaggaagggcccacgtctgggcccaggggactgactggctgccttgcgtgcatggggcacgggaagcataggctcccggaacaggaccctgccccagtttccccagtgagggaaggacaccgttccccgtgggatagagcactgcaccctttcttgattctcattgttcccgggagcgagcgccttggctgcgctgggcatacccaccctggcgccattcacaggcagtgcctgccctggccctgtgctcaccccatcaggcctcctcttccgcctctctggcacccacggcgcccctgcttgcctctgtccgggtctcggaggcgcgaacaccatcccaagcctgcgaccgcgcggcatcacccccgcccttccccctcctccaccccgccctttctacccctcccgggagctcctgggagtcgggccgccgtgtgcgcaagcgtgtccagccccttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcgggggcccgcggggcggggcggggcggggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgctcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggagttgtcagtgggaggccggctgtgcccagggtcctagggccacgttatgggggtcgtcaggcctaggccactgtgcctcagggctgcatgggtggtgagcagtgggagggatgcgatggggggagtgggctcagctgtctgctgtgggtgtttcctcggggacctggctggcagggacctcccggccagcccagaactgccaacatgtctgccagcactgcccctccattcccagtcctggggggaggctctgtctgggcagcttgaggcctgacctactgtggctgcttcctctgctccccagcctgggtcctgagggcctggcttaagggaactgctgccagaaggctgggagtgtaggcagtgttcgggtgcccagctgtgccctgtctgacctcatggccacccacaagctggcaccccccacaggcctcttggggaagcctgtactttccaccgcaggaggcgggtaccgcgtggaagccaggctcaggcggactcattctttttgaactttgggaacaggcctggtacaggctgagttctcacaagagacacacacccgtgtcactgtctcctgagctgtgccggacccgtcctacagactccacctcctctaggtcctggccctggcatctgccagggggattttaaatgagttgatatatgctaagtgctttgaaaggcgcctgcacggagggagagctgtataaatattcactattggtaatatttctcccatgctgttactctccaaagctgcccgataattctagagtgggttccggggacgtgcccgctgtttggggcctagaaatgaactcgggaggttgttttgcttgctgagagctggtctgggaatgccccttgaccgttccctgccctgctcctggcccactcccagactgctcctgtgcctggccccattgcgctgggtgggtgatcctaagctgccccatgggccctgggctctgtcaagacatggggagcttgccaggagttggggccagatcccccagactccaagatggtaaccgaggttgtgagggtgcacatggaaggaagagttagaagagtgaattggaaattgccagcttggactttgggcagagtgggtgtctttagcttggggatgggttgttgttcagagacaacagggccgccttctctgtgagctggcggcccaggctgaggtgcctctgggctgccttccctacgggaagcagtgactggccctctgcttctcaggaagagagtgccgtgcccccgccagcctcccaacctcgttagactcctagaatccggttttctggatagaactaagaatctgctcctttctggacttttaatcctggaaagggctcccttccccagcaggagcagagagaccaaaccccctttctgtgctccatcttgagctgtcattctgtcctaactccccactggccaccatctgcccttgctttgggggctaccccaggtctgacttgggcacgttctctgggtctctcctcagagaggctgctcctggggttgtcccaatggaattgggaattcttctcagaatggctcaaaggtttgcaccatctgttggagggaagggatccctctatcttggactaatacaaatgtttccgtgcctgccaagttccagaccctgggccgatagggaaaggagctggctggggggcctgcaggggatggagagggagcttgggccccaagtggggtctgaagtccaagcctacagattgccatcaaggcagccgctagagcctagcccagctcctggcccctcggagatggaccttagatgctggagagcggggcagtccagcagtgcagggtgggacaccccgagcaaacagcccctgcttcctgccccctcagttcagtcgcactgggccggctggacgtttccctgcaacaggcccctgctggtggtttagctcccgctccgtgtttccctcacgctgggatcctccttcctactcaagacccacgaccttgacctgaagcttttggttgccgggaggaaatggtgagtgtaggcagatttgggtgactcttgttattaaccccctcttctttgttgcccccttcccagaggcttctgtatgagtgtcctgagtggccctggatggactactggctgtccctggcctcagaatcaccccaacccctgccacatttcggggagggaggtgtgtgaatgatgtcctttattctacagactgaggaagtggtcagtgtagcttcacgtgagagcagcagcgtgcgatgcccaggccctagccaagtgctggtcagctttctgactggagcccctgagccctgcaggggctgaattcccccaaaggttgcttgggttgttgcatttcggggttagagggtgtgggtgtccagagctgtgggtttttagtgttggctgagccctttacctgggacctacagcctggccacaaccccatctctgttcccctgtaccccacactgccctgtgataggatgtgataagatggtaggattgcctatactgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaaaaaaaagatgtgctagacactttacgtcccttcatgtgagcttcacacaaccctgtaattaagcccatttataaatgaagaaatggaggattgaaggattaagttacttggccaaggtcatacagctcgtaagcagctgagctaggactcaaatccaggcttgcttccaaaaccttcacttttcagcccagttctcaactgccccctggagtttgctcattttgccccatgaagaaacagatcccagctcaaaggcgtgaaggggtttgctcaaggccacagtgtattagtgtcaaaggtggaacacaaaccctgacctctgagtgctctcccgaaccccacatcccggccgggccgtaccctgagcacacgcttgtccgctttctcagctgggcggggcggggcaggacaaggttcttctccctccctccttccctccttccctccttccctccttccccgtgggccctcccagcctccccagcccccacctctgctgctttcccttggcaattgcttccatctggcctgcctgcagctcctattcctttggaaatgtggctgccgcccacatggctgcaaggcaaccacggccacacgtggggaaggggaggggccctatggggtctaagcacagggaacccagccaaagtggctgctcctggcgtctggcatcctgattcctgccaggcagaagcaccttggctgcctggccctccttgatgcccgtcctgggctggctcaaggccagagaggctcccaaagacccaattctccttccaacatggtgagctgttttgcccacagacaagctccgcaccggcagccctccctgtctcttagaggttgctcaggttgggaggagggattcctggcaggagagaattaggggccagccggggtataccctgggttcccactgggttctgatcatttggagggaagtcatgcaagggactgacgagggcagaggctgagggatccgcggagttctgggcaggcgaggaggcagctgacttgctcatgactgtgggtatgcgccaccacactaggctaatttttctattttttgtagatacagggttttgccatgttgcccaggctggtttttgtttgtttgttttgttttgtttttgagacagagttttgctcttgtttcctaggctggagtgcagtggcgcgatctcggctaactgcaacctccatcttctggtttcaagttattctcctgcctcagcctcctgagtagctgagattacaggcacccgccaccacgcctggctaatttttgtacttttagtagagacagggtttcatcatgttggccaggctggtctcgaactcctgaccttgtgatccgcccacctcagcctcccaaagtgctgggattacaggcgtgagccaccgtgcccagccgagcgtgtctgtcttgttcactggtgtattttcttaatgcctggaatgatgtctagcaaacaataagcactcaatagattcttgtgtgatgagtgatggaaatgcagctcaggtatgctgatttgtctttgctgcatctttactttgcttcctcctcccagggcaaagggaaaaagtttcccttttgccagttgagctgtttgccagagaaaggtctggccccatctgtgtgctgccaccttgggggtctctgttcagacctcagagaggcaggcaggaacccaggtgaggatgggcaggagcttgtcccctgaggagtgcatgccccattccacccaccacagggtcggctggccacatttctctacccatcacccctccctagtaaccttcaggtccctgcagacaggtcctgacctcagctccaatccctatgtcagtcctctccttatttgaggcccaagaaaggtacccctacggtggaaccctcacttgggtcctgagagggagtgacagctttggaagagcgaggggttcacccacatttgcctcctcctgaacagctccacttttattccttgtacatattgcgtttccacttcaatttttttttgaaactgtgacagagggtttcttggctttaattttttttttttttgaaaacccccattgagttccagttgtgacccccctgtggttctcattttctggtagcatgccgtgtggggtctcacctcctcgcctttgcttctgctgccccctcacatggcttgggcattgttggtaatgaccttgctagactgcaaatgtccttcagtatcaactgaagccccagtcctgggaagcctccgtggccacccagcaccggcacttcctcccccttcctccccctgcgttctccactccctgcaggtcctatgcctgtgacagggagggaaccctgtgctggggtgaccccagcatggacctcagtggggctcaggctgaaccaaaggtaggtggttctgggggtagtgcctgaggtggttgtatggagctgtgagatttgtattcctagaagcaggttggaggctctcagcccttccctccatgcatggccttggatacagcttgcagcctgccactgtagcctccatttccttctccgagaaattaacacttctttttttttttttttgagatggagtctggctctattgcccaggctggagtgcagtggtgcgatctcggctcactgccatctctgcctcctgggttcaagtgattctcctgcctcagcctcccaagtagctgggatcacaggtgtgtgccactactcctggctaatttttgtacttttagtagaaatggggtttcaccgtgttggccaggctggtctcaaactcctgacctcaggtaatctgcccacctgagcctcccagagtgccaggattacaggagtgagccaccgtgtctggccaacatttcttccttttttttttttttttttttttaagacggagtctcactctgttgcccaggctggagtgcagtggcacaatctcagctcactgcaacctctgcctcccgggttcaagcgagattctcctacctcagcctcccgagtagctgggattataggtgcccaccatcacacccggctaatttttgtatttttagtagagatgggggtctcaccatgttggccaagctggtctcgaactcctgacctcaaatgatccacctgcctcggcctcccaaagtgttgggattataggtgtgaactaccgtgctccgcctggccaacacttcttaatgggataatgtttcagataacatccagtgcccggactccagcactctataaatgctggctggtgtgcttttctgggattccagggtggggtccagagactgaagagggtctgctttctggcccaggggaagaggggcaggtggctcactaggagctgtcctggcatcctttgtccccgtccacttaccagttatgtgacctcgggcaggtcttgcactctggcactcaattagcatctgtgttaattggggtaagagtatctgccacgtctcacagcctggtgatggacaaacaaaacaaacattttttaggctgggagaggcctcagaggttggctgtcatattgcaaacgagggagcagagactcagaaaagtaacttagttgtttaaggtcacagagcacctctctccccacaggcagggagccggtaattgggctgagcctcaggagtaacccttctctctctgcctctccagcccctaccttatgcctggcccattcagctggtctgttctccaggcccctaggactgggtgggctaagatgagtggtctagaaatccctccccagctgggctggactgaatgaggggctggccgaggagcgggtgttgatggagtatgggagattgtcctcacaggcagtgtgggccgtttctctagacctcctgcccccatctccttcctgtccctgtttgagccgtgctcttcttcttcaatccctttctgtctgccttctctttccacccctagatttctcaccatcttcagtgatccctcctccttcctttctgcctcctctgcattctctccttgcccttgcttctctgatctgccttttttctccagcctcagcattcaggttgtcctcatagtggaactgggactctgggggtggctgggttgggttgcctggaggccgggaatgttcaggagagccttcattgggagcccatgggagcaggagtcagctcctcctgttggcagctccagcattttcgaacaaaaatggctcttccaggagttgagtttggcgaagagacagtgcctgcccaaagtatgcaatgcttttatctttagctcagctcctgagccctcatgcaactctttggacatcttcctgcaaaggacggtgggatcttgtctttctggggcctcagggtctccaaagatgggctgactaagcttccctagcctgggacctgaaccctccaccctcctctctcttgagctctttctcccaggggaagctgctcgaatgaggggagttggccaacacagttttctactctcagaccccattgaggtgagcacacaacagtgttctgtgtgagggtctggatacactccccaccctcccaggcccggcaccgtgtcgccctgccccagcccagagcttgcctctgttggctttgtgaccctcgctttgtactgtggctttgttctgccttagggaccagctggtcccctgctgtggttccacacagtggagactgatccctgaccactcattcagctgcctggcggccctggggcaagtgtttgtcccccatctcccaaaatggcggggtgcaggggctccctgcccggagtcccaaccctgccaaggcagagggaatggggaacagctgcgctggcccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtgttgggctggatgtgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggtagtgaccaggccctgacaggcgggaatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacgggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagctgagcccggcccacggccagccctgaggaatggaggaagagagtgccctggctgggggagcccctcaagccctggaagctgtatgtgggcatggggtggtgggggcgtgcagagaggaggaggactgagagctgggtgtgtgtgtgcgcatgcctgtgtctgtgtgatctggttcccgggtgtctgagtagggaccaatgtgtttgtgctggagaagcctgtgtaggttactgacatggggaggggtggggcttgctttcctcaccccgcttcccacgtcttcattgagtcctcatctgggggccctgttccactctccttcccgtgtgcagggccctcccctctggcgagtctgcctctcactcgctcagcccctttaaccctgctggctcctaatgagacttcaggtgtggaccctcgaaccctcagctgcacaggtctggaaacatccttgttcatcaagcaccaggctgaccatggtgtccgtctcagtgcccagcagatgttctggtgaggggaggcgggagtgcaaggtctgccgagtgagggttccttccgggaggaggcagggtgagcgcagaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgcactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattccttttttttttttttttttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtatgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaacgccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggcccgttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagcgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggcagtcaccaggccttgacaggcgggaatctgtccctcccatcacccccccagttatgggtgcagatgaccctgaaattgctaaagcctcagggcttgagcccagaaagtgtgagcaggctggcggggcagctggaggaaggccttgcaggttcctggatttgggtgccgggtgggctgagaggacagtccctgtcactgggactgggcacaggtgcagagaggctgagacaggcccagaggacagtgagtgtgtgttgtgtgggtgccaggccagggagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggatttcaggtgtggacccttggaccctccgctgcacagttccagaaacttgttcatcaagtgccaggctgaccatggtgtccgtctcagtgcccagcagttgttctggtgatgggaggtgggagtacaaggtctgccgagtgaggcagaggaaaggggtttctgagcccagatctccggtgctccaagacactcaaaaccagagctgagagcctgaattcagaggctgtactgtggggcagggctggaatttgtggcacctgtgtagggactccagggctgaacgttgcctttgctgtccctgcttggggattttggggtactgggtttggatagagtgtgtcatctgcagaggcagcactgttctggaagtggactctgctcaggtgtggcgggcctgcctgtggggtcaccatggacaggaggctggtgtctggtcaggctgagggatccgtgtgccagcccttctgggaaggctgaatggggcggaactggtcagggcctggcaccaactccaggatgtgctacacccagacagacagatggagagccacctccctaggggcctcctccccctccccttctgcatgccaccacaccccagcagcatctcctgaggctgggccatgggtgaatctgagtcgagggcaggacagagtgggagtggcagtgcctctgcctgtctccctggccgtggcaggtcctttgtcacatatgggccaggagaggtgagtgtgattgtggtagtggtgggggcagtggctgaggacccctctctttgctgggctgggacagagcttgaatggagaggggccgccttgtgcctgggaagggaggaccaggtgtcgctggcaccttccacgtcctgagtgcttgttctgtgcccagcccctgctgaggctgcggacattaaataccaggatatgttttgagactcaggacacctctgaggacttgctgctgttatccacatttaaaagacgaggactctgaggctctgagaggttaagtacctggtccaggtcacctggtcagtttctttcttttttttttttgagatggagtcttgctctgttgcccaggctggagtgcagtggcgatctcggctcactgcgagctctgcctcccgggttcacaccattctcctgcctcagcctcccgagtaggggactacaggcgcccaccaccacacccggctaattttttttatttttagtagagacagggtttcactgtgttagccaggatggtctcgatctcctgacctcatgatcctcccacctcggcctcctaaagtgctgggatgacaggcatgagccaccgcgcctgacccacctggtgagtttctgagctccagacaactcatcccaaatttcatgggtgcatagagtatagagattaaaagtagttctggctgaattttaaatcctggttccactattttcgacctgtctgattttggaacatttaatgtattccttctgtgcctcagttttcttctgtgtaaatgagaatgaaagagtactcccccatcaatttgttgaaaacttcagtaagattatgccaggagctgcagcacagccccagggatgatttaaaagtgaattcaggacagggcgtggtggctcacgcctgtaatttcagcactttgggaggctgaggtgggaggatcccttgagcccaggagtttgaggccaccctggacaacatagtaagaccttgtctcaaaaaaaaaaagcgaatccagtggtgtcactctttgttatcaatgccctccagtgacattcatgacacccaaacttagaatctgagcttttagggtggcctgtgacatctataccacgtgtccccgtggcctccctggcaccccctttccttcctggctgtctgccaccatatggaactttctgtgccttgcacccagccagctcagagtcttgggcacttctctcagtctggaaccttctcttgcctaccccatcttcccatggctgcccttcatgtaggcctccggtttatagccggctcctcagagacatggttctatccccccagtggccaagggctggtggccctcactctctgcccctgtgccctgtgttagtggtcctgtggttgtcattgccccgtcatctccaccatttcctgtttgccgtgtgtctgtgccccccaaggatgaatgccatgagtccagcatgtcaccctgtttctgtcctgccacagtgctcgagtcagtgccctccctgcttgcattcggcccacaggccttgtggctcctgtttctgctgacctgtccagcctcacagtctggggaggccttggggtccccagcctgtgctgggacaggggtattattccagtagcccttctgtggaacaagtagggaaggagtgatgtgacctctgtggctctcctgggacacaggttagtcctgtgggtgacctcactttagagagggctggccagctgtgccggaattaggaagtgggtacagctggacaaaaggtggctggagccagctctgcagaagccacacctgctcatgagaagggtatccttgtgagtacaggggaaatggcatggagaaagacaaacaccggtgggtggctctgccagcttcccctggggtgcttctggcaacgcccaggtctgtgcacatccagatctttgcactgcgctgttttgacttggagaggagaggaggaagttagctgctctgaatggtgttgctgctaatctctacagcactttcctgtaaattaggaacggtaacacacacacccctcccccaccccgctggagaagccctgcaccagagcatacagtttggcaagtaggaggagggctggagcccagcctcacttgctgccctggccaggccgtgattgcccagggtgcatactgtggctggtgctctgccactgctgtttctgtcctcagggtaggacacaaggagggcaagtagggccagtcagcgagaggcgcaggtgacgcgtgttctagggtctgagatcagctgcttccatttcagtaattgtctttggagctacattgtctgctcatacaacctcccttccagatagtgccattttaaaaatcccatttacccaaaagaaaacctgacacctggaaaggtcgtttgcactcacacaagtgatggttggtccagaattcacatccaagtgtgagatttcaatattttttttcttcctcctttttttaaatcaaattttatttgaaagggtatcacagtcaccagtttgaaaaaggtaagcaggccaggtgtggtggctcacacctttaatctttgcattttgggaggcagaggcaggcgtgtcagttgagcccaggagtttgagaccagcctgttcaacgtggtgagaccccatctctccaacatttacaaaactagctggtcatggtggtatgtgcgtgtggtcgcagccactggggaggctgaggtgggagggttgcttcagcctggtgggtggctgcagtgagctgagattgggcctttggtcttcagtctgggctacagagcaagactctgtctcaaaaaaaaaaaaaaaattataaaggtaagcagtacaaatgggaatatgagcataagtcactctcattccagacctctgacccccaggacttttctcttgagaggccatagcctttgttttgcatccttctgagtaaacctattcgtgtacagacatatctgggtatgcatgtaactgttttgtgaaagtgcatttggagatatggatatcgttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctatgagagctcaggtccctcgtgttttgctgttatgatgaatgaaatatgctgtctccatcacgctggaatttgtagatgtagatgaccatagtttcttatttgccattcatttctttacattaaggtaaatattcatgtcctttggctatttttattttatttcttttttcttttcttttttaagacagagtctcgctctctctcccaggctggagtgaagtggcttaatcctggctcactgcaacctccacctcctgggttcaagcgattcttctgcctcagcctcctaagtagctgggattacaggcacctgccaccatgcctggctaatttttatatttttagtagaggtgggggttttaccatgttggccaggctggtctcgaactcatgacctcaaatgatccatccaccttggccttccagaatgctgggataataggtgtgagccactgcgcccggccctttgcctatttttaaattaggtttcttgtttttttttttttttttttctgatttacgtgagcacatcataggctcagtgaatttactgatatgttaggtataggttgcaaatgtactttagtttttcagttgtctttttttttttttttttttttttgagacggatttttgcttcttgttgcccaggctggagtgcagtgcaatgacacgatcttggctcactgcagcctccacctccttgggttcaggcaattctccagcctcagcctcttgagcagctgggatcacaggcgcctgccaccatgcctggctaatttttgtatttttagtagagacggggtttcaccatgttggccaggttggtctcgaactcgtgacctcaggtgatccacccgcctcagtctcccacagtgctgggattacaggcgtgagccaccgctccccggctcagttgtcttttaagtgtttcatttgtcttctctctactcctccctctctctcttgcacttgctgtctgtctcacttaaattttatgtaggtgaatatattcatctttccttgtttagcttctcaatttatatttcttcactatctctattaatatgaaaatatctcatctatataaatattaatgtaacagagttgcatgtgataatctgccaggttgaacaaatgggaatattatctctcatatgacgttagatttttttcctttaagaaataaaatattgcaagtagagaaccaaagacatgcccctgtgacctcttttattcttccccatctccccagaatataattatcacttaaagttgggtgtcaacctgtatttcattctttcatcatacacacaagcacacactgtttatacacataaataatgttgtttttggacgcatactttgtttttgcaacacctttaaacataagtttttacttttattattttatttaagataggatcttgctctgtcacccaggctggagtatagtggcgcgatcatagctcgctgcaacctctcatctcctgggctcaagtgatcctcccaccttagttagcctcctgaggaactgggataatcacagtcataagccaccaagcccagctaagttgtttattttatttttttattttttaaataaagatgaaatcttgctatgttatccaggctggtctcaaactcttgggctcaagcaatcctcctgccttggcctcccaaagtgctgggattacaggcatgactttaaaaagttaacattatgggccaggcgcggtggctcacgcctgtaatcccagcacactgggaggccgaggcgggtgaatcacgaggtcaggagatcgagaccattctggctaacgcagtgaaaccccgtctctgctaaaaaaatacaaaaaaaaaaaaaaaattagctgggcgcggtggggggcgcctgtagtcccagctacttgggaggctgaggcaggagaatagcgtgaacccgggaggcagagcttgcagtgagctgagatcacgccactgcactccagcctgggtgacagagcaagactctgtctccaaaaaaaaaaaagttaacattatgtcttcaagtttatcccaattgacccatatggattgatttcttcagtttacatggctatatagtattcaggtagcacagtgtatatagccatggctgtactgatgatagtgtttccagtttgtttttttttttttgctattgcagcactgcctaataaatatcctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgcttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcctacccactagtcaagaactcctcatttccgcctccccccagccccttggcagccaccattctgctttctgtgtctgtgagcttgactactttaagtatctattctaaatggaatgatacaggacttgtctttttgggactggcttatttcacttcgcgtagtaccttcaaggttgatccatactggtagcagaatttcctttctttttcaggctgaataatattccattgtatgcgtagaccacattttgtggatccgttcatccactgatggacgcttgggggttgcttccacattagctattgcaaagtcaataatgctgctgtgaacacgggtgtacagatatctctttgacatcctggtctcaaatattttggggatatacccagaagtgcagttgcttgatcctatcctgtcccttgcttttccctttgcttccttgttttttttttttctttttgttttatgggagtgctgatatattcaagtatttgttgattgcatgcattatgcctgacttgctcaaagcatgatgtcttgagcacttagcaaccttgtgcctgctgagtggtggaacagttctgaaaaggtctgttctggagtgggggtgctgtttcggagagcgatgaatcaggggcttgggtgctgactttaggaggtgcggctcttggaaagacagagtgtgacttccccagtgtggtctccttccttttcctcaccacttctcctacctaaccccaagaatgagtccttgagtctgtctcagtaggtggatctgcattcagtgcagggcagagcctgggtggcagtgcctctccttgcctccctggctgctacaaggtcctgtgtagcatctggtgtggacccagcagccaggaggagagctgagtgtgattggggtcgtggtggggccagtggcagtggatctctctctttgttgggctgggccagcgcttgaattgagaggggctgccatgtgtctggggagggcagaacccagcgtcactgacaccctccagatacagagttcttgctctgtgtttggcccatacctaatgttgtgaagtggaaatactggggtgtgttttgaggctcagaacacctgtgataacttggtcatgtgtgtgtgtgtgtgtgtgtgtgtgtgtgtgtgtatgtgtgtgtatgtgtatatataaaattattttccttaacaccactgacctgaaggcagttacacgtaatttacaaatgaggaatctgaggctttgagattgtcaaggtcacctgaccagtgactgcagaggctggattggcctgtgggcctgagtccgtaccccttttcactggctcctcctggaggccacatgtaccttgcgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtaagtggttaagatcagtcggacatgacaacctccagttctgcagaagccacttcatttgcctggggataaagcaggtccttgtgagctcatcgacatgcatttggcagaaagtgcgctggctctgccagctcccagtgtgagcttctagcaagccccttgtgccttagatgcccaggtcttttcagaataagcctggcttgttttaacttgatgcaacttgctgctcacagtcatcttattgtttgctgatgaattcagacctccattcatttaaatatttgtcagttatctaccatgtgtcaggcattaaatttagtgctggagatactatgggacataagaagtccctgcttgctgggagtgtgtggtctaattggtacttggggcagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttctttttttttttttttttttgagacaggctagagtgcagggggacgatcatagcttactgcggcctcgatctcctggactcagggggtcctcctgtctcagcctcccaagtatctaggactacaggtgtgtgccaccacacccggctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtagctgggtggcccgccccttgcaggcactggggcaggatatcagggggtccagaagaggttgggtttaggcagagtagaggtgattgtgtgggccgggggagcaatgtcaccttgaatgtgtttccatacccagggcccagatggctcaggaggagggggatggggacggggagagtgaggtctttttgactttgatgtgctttgactgcacatcagagtcaaacgagtcagaataagcgggacccctccacaggcatctcagccctcctaatttagcctttctgaagtggagccttgggagccgatgaagcttaataaactctcctggtgcttccagtaggcacttgagggtggacaccaccgtcttcaggtcataggaagtgtgagctagcaggaatcctggagattttctagcccaacagtgtccggtcaaaatagaatgggagccagaaatacaagccacatgtaattttaaattacttttaaaacatttaaatttagccacggttttaaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggctgtgctggaagcaggggattggctgtgctggtgggaagccagattccagccccagacactggtacctttggctttagatccttggggtggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgattttcttttttcttttctttttgtttgagacaggatctgacttggtctggagtgtagtagcctgatctcagctcactgcagcctccacctcccgggctcaagtgatcctcccacctcagcctctgaagtaattgggattacaagcacatgccaccatgcccggctaatttttgtattttttatagagatggggtttcaccatgatgcccaggctgttcttgaactcctgagctcaagcaatctgccctcctcggcctctcaaagtgctgggattactggcatgaggcacggggccctgccctgggtatgattttcaagtggttggtgtcttgtgactggcagctgataaacgggtgatacaatgtttctgtacaggagtctgcagtgccaggctgcaggggcggatggtggggggtgggtgggtagcctgtggagcccgagggtgggaacagagagtcttcttttgctgtaggtggaagcctgtctggctcctttccctctaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctacagcgtccagccaggggctgtgccacaggggccagaagatatctgacctactgtcactgcctcttccactctgttccacctgcactggggcaatgccatctgatgaacagatccatttattaattcaacacgtttgtattgagagcctgctgggtgccgggcactattgtcaacatgggtgatacagcagcaagcaaaacaagagaaacatctttgcaagcaggggagggggcctgcagtgttgggtgtgtggagttgttgctgggaagtagagaagctgagtaaagagctggacggagagagatagccaggcccatgtctacagaaaagcattctagactgagtgagcataaatcgcaaaggcccagaggagggagcatgcctagctagccccctagacctggtgaggctggtgtgggttgggcagtgatacggtttggctgtgtccccacccaaatctcatattgaattgtagctcccataattcccatgtgtcatgggagagacctggtgggagataattgaatcatggtggtgttctcccccaagttgttctcctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcatcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaggttcggcagggaagccagaggagtccgcagcccgggagacctggcctacagcggagagagtcagtccatgccagtggtgggatgtggctgcaaaaaatggtcggattcatggaagtctggtgtccagctggcaggcattagtggtcccatgaatacagctgtgtgccttgaacacgtactgcagagcttccagagagcaccagggctgtgggggctagagactgtgtctcgtgcggaagcgtggctgagaaggggctcgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtggaggttctggctgaaggagccagaattccagtgccagctccactcctcacgagctgtacaacctgggccggttactgacccctttcccaccttagttccctggctctacaatggaggtaattatcgtgttgaactcacagggtcgagatcatatttaacactttcacagcccttagaagtgtctagcacagtggtcctcagcatttggaaatgtctggaaacactttgtcacacctgagaagagggatttcctactggtgtctagtaggtagaggccagagatggctgctaaacaccccataatacacaagacagaccccgcaacagtgaactctctggcccctccaagtcagtggtgcagagattgagagatcctggtttcgcgttttgagcgtgcagtacatttcagttgttagtggaacatgcaatacatctttattcacatgttattacttatttgtcagatgtttgtaaaacatctgctacattcttggcagtttaatagaatctggagatacaaagaagttcctgaccacagaggtcatttaggcaagctaggaaagcacagaatgatataacacaaagttacattgtaccataaagcatattctatagtacacttaactctggtgggctcttggtataaaaatgtctccaatctcagaggtcatgggatagtgggcaagacatgaaaaccttgtataatataaaattttgttacctctaagtgctgaaattaaggtataaacaacgtctcatgggaaccaaaacatcagtcatttggaagtataagtcaagccttcgtaggagaggaaccatttcagcccgatattaccagagtgggatggtcccagcgagcgggatgtggagggttaggatgttatcttagtctgttttgtgctgccattaccaccaagtaggtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtccttttataaggaacccactcctgtaataatggcattaaacccattcatgagaacagagcccttgacccattcatgagaacagagccctcatggcctactcttatgagaccccacctcacaacattgttaacatttaggatcaagtttctagcacatgaactttgagggacacattcaaaccatagcattctgccccagtccccaaaatggatgtccttgtcacatgtagaatacatttgcttcttacctataatcccaaattcttatttgtttcagcaccacattaaaagtccaaagtccacagtctcatctaagtcagctgtgggtaaaactcaaggtatggttcatcctgaatcaaattcccctccagtcatgggctgtgaaatcaagcaagttgtctgcttccaaagtacagtgatgggacaggcataggacagatattccattccaaaagggagagataggcaagaagaaaggggcaactggtccagacaactccagaacccagcagggggaacaataccaaatcccaacttgacaataatcttctttgactccatgtcctgccttccagacacactcgggtagggacttgggcccccaaggcctccggcagccctgcttccctggccttgctgggctcattccatgcagcagctctcaccggttggagtctcatgcttgcagctcccccaggttgctgttgcacactggtagctctgcagttctggggtgtcaggatggccttactcccacagctccactaggcttcctggggactctcagcagctcagactccacagttctgctgggcattgccctacaggggctccctggtggtggctctgaccctgcaaccagtctctgcctgggtcccgagtctgtccgcaatatcctttgaaatctagttggagggagccaggcccatagcccctgcattctgtactctggtggcattaggaccatgtgggatgccaccaagactcaccacttgcaccttctagaatggtaggtcaagctgcacctgggcccatttaagccatggctggggaggcagaggagcactgtgcccaaatgtgggagcagagacttgaggtggccctggacagtgagccacaggtcctgagggctcccaagacctggcttttgacatagttccttccctcagattttggcactgccggagctgtgatcacaggtcatctctgcagtacctttgggatcattcttattttcttgatgaatagcctctggcttcattcttattgtactaatctccttatcaaactgtggctctggccaatactaatctccttatcaagtggtccatactaatattcttattaaactatcaaacggtaacatgcctgcacccttgctttcctctcctgaaagttctttcattctctactacagggccggtctcagaatccttccagtctctaagttctgtttcgcttttcattataaatttctttctttctttccttctttttttttttttttttttttttgagatggagtctcactctgttgcccaggctggagttcagtggcacgatctcagtttactgcaacttctgtctcctgggttcaaaccattctcctgccttagcctccctaatagctgggatttcaggtgtgtgccaccacacccagctaatttttttgtatttttagtagagatggggtttcatcatgtcagccaggctggtctcgaactcctgacctcaaatgatccgcccgcctcagcctcccaaagtgctaggattacagacgtgagctactgcgcccaaccctgcttttatttataagtttcatctttaaattatttatttcttctcaagttttacagtatacagttaaaataagtcatacagcaaccaaaatgctttgctgcttaggtatttcttccaccaaatagcctagtttatcactcttaagttctgcctgctatacagtttgaggacctggacacaatgtagccacattctttgctgctttgtaacaaggatgactgttatgccagtttccagtaccttaatcttcagatatatctgagacctcatcagaatggccttcacgatcgatatttctaccaccattctgatcacaaccacttagtctaagaagtttcagactttccctacagatcttctaatcccgctttattgcctgcctgcctccctccctcccttccttctttcctctctgctctctctctcttttcttcctttccctcccctcccctgctttcctctcccctctccacttcttggcaccaattttctgtcttagtccattttgtgctgctgtaacagaataccacagattgagtatattataatgaatagaattttatttggctcatggttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttctcatggccgcagactgaaggggcctggttacctaagggaccttggcttcatgtaaggagtgcggagtgagtgaagcaagagggtgatttgatccatatcatttcttagaaggataccatgttggcagtttcgaagaaggggcatgagtgaggaaacagttgtggtgaagagaccagttaggaagcctgtaacttggggtgggatctggaaccaggctgtggctccggaagaggagctggagggctgcactgtgaagtatttctcagagtctagacaatgtgaccttcacactggggctgagttttgtaaaatccgacatccccagtttcacctatgatgccaggcctgtggtaaggagctttgcaagcatttgctagaatatgagcaaatggaggtagaactgataatatttagtaaccatggggggatgaaagagggaggtgttgggagactgggttgataatatgggggttgggagtgaggagagagtccagctttgaacatcttcttccatttgaggaatttaagatcatccagctagaaaattagaaatactaggatggagtgtggaagagaaattagtgctgaaaataaagagctcgaatcatcagtgtatgaatagtagttaaacctctgaaaatgagtgaacttgtcccctgaaaatgtgtggcaggggagaagcgaggttcaaggacagtgcccccgagaatgccagcatttaaagggtggaccctcggtggctcacgcctgtaatcccagcactttgggaggctgaggtgggcggatcgcttgaggtcaggagtttgaaaccagcttggccaacatggtgaaaccccgtctctactaaacatacaaaaattagccaggcatggtggtgggtgcctgtatcccagctactagggaggcacaagaatcacttgaacctacaaggcagaggttccagtgggttcgtgccacttcactccagcctgggtgacagagggagactccctctcagaaaaaaaaaaagaagaagaagaaaaaaaaaaaggtgggccccggcagcagagcctactgtcccggaggcaggaggaaaacctgaagggaatcttgaccttgacctagaagccaaggaggaggcatggccaacaacatcaaaggcctctgagcagcgcagtgaagactgacaatagacctttcttaagtttggcaattagaaggtcattggcctcagcaagagcaatttcagaataaaaacaagagtggagggagtggcataggggtcgggggacagagtaggaagtgagggtgtagtagaggggaagaagtttgatcactgagggaaggagggagatgcaggggtagcttgaggaggagatagagcagagagaggtttgctgtttattttaggaagaggagacttgagcatgtttataagtcagagaatagagaaggagaggtgggagacacagggaaaagaggagtcattgattgggaactattctgggaaggtgaggtggatctggtgtctaggtggaaggatttgggggaaagaggggaggtaggagagtctagacgtagacagcaggcagacaggggctccaggttttccctacagaactgaggacagtgatggccgagcgtggtggctcatgcctgcaatcccagcactttgggatgccaaggtaggtggatcacttgaggccaggagttggacaccagcatgggcaacatggagaaaccccatctctactaaaaatacaaaaattagccgggcatggtgacacatgcctgtagtcccagctactcaggaggctgaggcacgagaatcatttgaacctgggaggtggaggttgccgtaagctgatggcaccactgcactttagcctgggcgatagagcaagactgtctgaaaaaaaaaaaaaaaaaagaagaagaagaagaactgaggacagtaagagtaagtggtcgcttgtgatcacagaaccagcaagtaaaccgcgagcttctgcccctctggtcttcccagaccccttccccggaacattaagccatatcgcttttatgggtccaggggctctgaggggctgggcatcatactgtgcccctgggggcatatctagttctgccccacttggttgggcgggtacctgctgagtactcactgtgtgttaggctgtgaatgctggggcagcaggaggcatggtttctgcctccactgggccttatttcttcaccttgtcccccagttctgcccttgggtaagttctgtggcagaactgaccagctcccttcggccagggacatcttggttcctggcagagcaccaagaagagcagattgtcttcctacccgggggcacctttgcccagcaggtcgggtgagctggcctcttggtgagaggctggtccccttggacatgagtggattcgatgcctgctttcccacccaggtactctactgtggctttgctcctgccctttatgctcagagctagaccagcaatgtgggggagctgctggggaaaggcgccatgttgtcttgaggtagcagccagccccggaagccctggaatgcctggggccactgagcaatcctcaccctcagccccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggacactcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagccgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcaccagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcatcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcacacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagcagttgtgatgtcctgtgtcctttcaggtgggggaaggcatgggacagggtgtggcagtgggcaggcttgttagaccagagcagggcatggtcactcaggaaataatgacttattgagtccagtgttgggtgcccggtcatgcattatcaccctggcatagcaggagagtgagtggtgctcacagcacccgtctgcaggcacccagcctggcacccggcaccctgggttactgcccagaggagggaggggctggaggatgccagacgagagtgccagagtcctctcccaccttccttcctctcttccccaccattcttcagttacccaaatctcatgcttgggaggtatgtgttttaaggacaggggtggggtcagacaaagaaagccaagtttcccttctcagattaagtgggaaccagaaaatggagtttatggaaggtcttgccagcggcccaggctgccaggatgggatgggcaggcctggagggcagtgtggaagggatttggcaaggcctaacagccagttgctgggccaggggatgaaacggcttctttcctaggtctttagcatcctaacaatcctgccgtttgcctgtctctcccgccttcgttctccatcttcccagatcctgcttagctgccaactgggcttcctgccaccccacagctgttcctttacatctggagccaggagggagagttggaactccccacttggggaatggaactggcagctgtattcctggctttctcggaaagagttgcggccttgaggttttgagacaagccaggctgggacaggacagataaagaggggcagcagtttgggaggaacagaggaagatgacatggttctccacagagcgttggaatggccttgtggacacccacttcatcccccagaatggccccaaggaccctcccagggaacagaagggctgctctctcagcagcctggctgctttgccaggggagaggggggttctgagagcgagtagagccccagcatctgcagccccaagcccactcccctccacacgggcaaactttgtcttgaaggctgtgtcctggggagcgagcttgcagacagcaggggttgtgagcgtgtggggatctcaactctgctcaccccgatgcgtccccagctgccgctcatgtggagatgcaagggagtgtccgttttcccatccggggccattgagaatggctgtctgcatacatgatccagctggcctggactgaggccactgcctgttactgaacgtgcctaaactcaagctagaatccggcacacaggggtgggtcagacccgtctaaactccacacacgcacacatgtagatatgggagcattttacattcttggtgggttgtttgtgattctgtgtgcggacagtccttcctgctcacatactgagaagactgtgaatgcggggtgtgtgtatacccaaatagaccattgtttgcttgggggggtggggatagctttctccagggtgcccaacatcctacgcagattgaggcaatactggccaagggtcggagctgagaatggggctttgatgtggggctgttggatggggttctttggttttctgggaaagggactttcagtcttcaattagcccaaccaacgggaatgaactgcctgccagcctgcctgggactgattaaaccataccctggaaatgaggaggggaaagagcacagtagggcacgtgcttgagggcaagtcaggagatctgggttctccaccagcctctgtcgcctttttctgtaagaacgtgggccagtcatttctctgcaacaaaagggtgggtccagctaaggagaaccgcttgtctcagaattacctagggagacttgggaatagagattcctgggtctcacccaggctgctggggacagcaggatcatcgcacgggcctcttgactctacggcctgcgtgtaaagcctgcgctaagccccagtgtccttcagcggcgtcaattaggcgcac

SEQ ID NO: 16072 - DNA, 25166 bp, Human
  misc_feature (1)...(25166): n = A,T,C or G
aacccagggccagctcctgacagcactggtggggcaggcagggccccgcaaggcagtggcctggggctgcccgcaggggtggggcacaggaaacacagtctttagggtcacaaggcctggggttaattctgcattactgctctggggccttgtcagtggagctgacagtttcctcatccataatgtgggatgatgcttccaccctgaggacaatcatgaaggttcaacaatgtggtcctgctgacatacctgtgggcccagtccaggatcgggagatacatgcaggtcagcttggggacagagatcctgctgtagcaaatgaaggaaacacatccctgcccttgggagctcacagctgagaggtgagacagatgtttgggcagccagggtcccaagagctctgccatgggctgagtgggggcgtgccagcgtgggaatgggggtcccttgtgcctagcattgtgatagactttgtgggcacacagggaacaaacccagaatgctgtctgggcttcaggaatggctcagccttgtggttgacatgggataggacatgcatacaaccagcagggtgtaggggaccctgctccaatggtaaatggcacagcaggactccaggtcttttcaacatttgtttatgtatccattcaagaagcgtttgagtttctaccgtgttaggtgctgcggatatagtggcaaatgagagacactgctccagctttctctcccttttttttttttttttgatggtgctgccagtctactggggccaaaagacaaaacccagataagtgctggaaagaagcgcaaagcatggttgaggggagggagagtgtcagagctggaggtggcttcagaaaggggtccaggaaggcctgcttgaggaggtgacatttgagcagagacccgagtgagctcaaggggttagaatgtaaggatctgagaaagagcatcaaagcagagggaagaagaagtgcaaaggccctggggcaggagtgtgttttgattttggaatgcccagagccatgccaaggtggccagtggccagcgtggctggtggggagggagtggtgggagaggaaggtgggaaagcagtcaggggctcaccttgtagggccttgaggccttggaggaatccttcactgaagtgtgatgggaagccccggagagtgtggagaggggattgggtttggtagaagagagactaccagggggcgagagtggaagcagaaggccagtgaggaggcaggtgcaagttgtcccaatgagaagggaaggaagatgagcacgatatgtgttggtataaccagggaaggcttcctggaggatgtggacaggcacaagctaagcctcaagggaactgaagttttggtggcagatgcaaaacaaaggcttctcctagaggagctcaggatgtgggcaaatgcttggtgtgggagccagcatgaggacacttggggtgtggggaggagaccccagcatcagctgcagggggagaagtcacagcggacttggcctgttggttccctggatgaggctttccaggcctccttctttccccatggacccagcgttccatcccctctcgttcctcacccatctccacgtggattggagtacttttcttcccgtttgctcacttagtcctcacagctaccctgggatggaatcagggtaggagctctgccccaccattttaccgagaatcgttcttgctttaatatgtggctgtggtggaaagagaagctttgttgtcgcatagacctaggcctgattcttagctttgccactttctggctgggccaccttgggcaacttgcctcgcctctcagagccccggttgccttgtctttgaatgggggtagtgagggggtggttatcagtgtgtgccacggcctggctcagagccggtgtagagaagcccttggtctttgtggtggacgtggctggctcctgcatgcagtgggcctgggacatctggggtggcttactgtgtccttttccctgcccaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatggtatgtgccaaccctctcctcctactccgtgtacccgtgtacatgtccttcctggcctcagagacctcaagttcaaatgccagccttgctgctcctggctgtgtgatcttggacctggcactgaccctttctgggtctgtttcctgatctataaaatggggatgcaatagtgaatccttgagagcattgtcaggagtactaactgaagatgtgaatgaaaagttctttggccggtaaatgccccataagtcgcatttgctgtggtatcagtggcttgcctgggatggcctaaagcaggtggctgttcccatgccaccactcaccagccccaggttcagccacttcaaggggcaggagcctcgaggtgatgcttttaggaagctgctggtggtgaaaatcagcctagtgtgtgtgttatgtgcgcgtgtgcatatgggtgctttgagcttgagcctgtgcacctgtgatatgtggcactcattaacaccttgggccatggtcctgttgacctgcccttgaccctggaactgcccaaccctcctggagtacttgggaactcaccccgctcccctgcctatgctgcctctgcaatggctgggaggagtgagacatcccaagcccctggtccacaaaggtgctcagcagtgagtgaaacaggcagcgctccgccttcccagagcttggagggcctctggcctagacagacactgagcaaataccacgcagattatttatttaaaattgccaggccggaaaagcggagactgctgcgaggcctcctggtccttgccactcactgggaaagcacctgcccccacccattcctgccttctcaggcccaggttctaggagatggcccaggccccagccttgggcctggggatctggggccgtggtcctgtgtgtggggccaaacctgccagcctgagcgtttttgggacgatgccccgcctgcctgccaaccctgcccgttgcagtcaggacgtgacaacaagacaaataatttcttggaccttttatcttggacaccatttattttccctcagccccggggcaggactgacctcatggtagggcccaagcgtggcagctgcaccgtcactgggggctgggccaggccaggccaggctgggcagggctgagccatgctgggcttgtgcacctccgggccagctgcctcccttctcccaggcatcactctttaccgcctccgttcccctcccactctctttccccttcttcctttcgcagcttttccccgttccccgttttgtttttgtccacctctctgtccccctccccaccagctctgtctccctccttcggaccacagcttccctcctccccacctctcccaggccctctgctggctgcctctatggggcctcccatccctcgtggccccctccacagacgcctggctgtgctaggctgacccaggtggtggttttccctcggatctgctgtccagtggctgccagaaggggcagctggctggccgtggcaggaggaggtgcccttctggggagtcccagagctctcattggcccctccaggctgggagagtacaggggggtcagactctggtctgaaccatctgtccacgccctgagacaggaggcgggagctcgagagggaggggagcctggaaatggccggcccctcaccccagaagtcacttgccctctcattccctctgcctgaactgggaactcagggaatctttcctgctgtgtgacctcagacaagcactttgccttctctgggccttggtttctcctctgcacaatggttgggctaacgcagtgcttcttctttttcttttctttttttttttttttttgagacagtgtcttgctctgttgcccaggctggagtggtgcagtggcatgatctcggctcactgcaacctctgcctcctgggttcaagcgattctcctgcctcagcctcccgagaagctgggattacaggcgcccaccaccacgcctggctaatttttgtatttttaatagagacggggtttcgccatgttggccagggtggtcttgaactcttgacctcaggtgatccacccgccttggcctcccaaagtgctgggattacaggtgtgagcatggccgcgcccggccatgcttcttaagtgtaacatgggtgtgaccacggagggatcctgtccaaatgcccatgttggttcagtgggtctcgggggcgaggcctgagctgctgcatctgacaagtgcctgggcggggccagtgggcagcacttccagtacctggggactaggccttcttggcttctctgccagcaccacgctttctaagattttatgatcctctctcaaggaatatgtttctgtactcctccgaccccccgacacccagggcagtgcagggccttgctggctgctgctgctccatttaaatgccacattagaaacacagatgaggccaagggaccccatctgtgagcccggggagaggaagtgagacaatggagccaattgaggcttccaatctagataatcaatacaaatattattgggagggtgatttatgtggccaagccagggcaggaggatgggcctgctctgctgatctgcattaggggcctgccttgtctcagggggaggggctgccagagcacccaggacagttcaggaacctgctcccactgagaatgatgcaatctgagatgtaccacacactttgtcagaatcgtaagattttataacatgcagtctcagagtctcagcaaacaccatggatacatccccgtaaacacctggaatctggaatccccacggacactcagaacctcagatttgcctctgtaaaggccagaatcctgaggtgctggctctgtgggtgggcacgaggggctgggtgccctgcccagggctcttggcctgctgcgcagtagtgggtggtcccttagtgaaatctgcttggatgtcagtggggcttctgcaccttggtattctgcaagagggtctcccggtggccctctaaagctctcccagtactgaaaagctttaggggttctgagagtgggccgctccaggaataagggactttcttagccttgccttgggttctggagggagagcacagctggccagagggctggaggcttaggtagttgaatacctggcaggtgggaggttgtgggggaggggcaccctgcccacctgggataatatcagcctcccctcttcttgccgttggtgctggacactctgtcctgcaggcagttgccatgtcatagaacagcactggaacaggaagcaggacactgagttccagctgcagctctgccagggagcatcttgcagggctggggaagagcctccatgtctgggcttagcttctttatctgccaagtggggaggagaaggcctcctccacctgcccttgaggtggatgtccctaagcctgggatgtgacgagatggggaaggcaccaactcctcagaaggagagggggccagctgagcccacacgcagggagactctagcatcggggggtttccggggcaactctgcttttaaagtttaggaaaccttatgattggatattcctgcctgattttatttgaaaaaaagatttctctgtttgagaaaaaaaaatgattaaaaaaccccattttgcggtaggccagcctccagactgacagtgcccagaataaccctgggcaggccagctagagtggccctgctagccagggagatggtatttggaggattgagcttgtcagctcaggaatctaatgggatttgaatctcggctccaccactttcgagtgggagaccgtggatctgagttagcctttctgatcctgtttcctcttctacaaacagggaaattgaaatgagagaatcttatgcccaaagattatatgatcattaaaccagtactaataatcaccacctgacctccttactatgggtgtgtgggggggggtggtgccatcgcgggctcaggtgaggaactgccatcaggtactggctccagaggcttccagaaaggacctgagggaagaagcggtactcctgtctgctgtcagtgggacctggcaggttagatgcaggtagaagagtcgtcctcccgtgattcccagcagcaaggtctctgccccagtgagggaggagggcctttggctcccctgattgcgtgtgtctcccctcagtcccttattcattcaacgtaaattaccaagcccaagcaccaggggagggggctactgtggtgagtgacatgcctcgtcccagccatcaaagagccttcagtctagggcccccattccttactagaggctgactttgagtaggaagaacctaggctgtgaacttcccacgtgactgtgagcccacccattctctccctgagcctcggtttccccacctgtaatgtgggtggggtaaagggtgtgcagctggtactttgcagcttcctccagctcaggcatggggttagtctgtgattccagctttacagggagtcagcacgccccagtgcagatgcttctctgagcccccaggctgggtacagagccccagagcccctgtgcttgcccttgtcccaacaagggtcctgctgcggtggaaccatctgttgacgtggctggtgcccctgcgagagtgtgagctccttggagggagtgactttgtcttgctctttgccatgtctccatgtccagcacaaggcctggcagagagcagggcccctttaaatgtggctagaaggatgcataaaatatgtacagggcaactcaaagtgtaaccgggggctgccgtcagtggctcacacagggaggaaggtcggggcttcagggctattgctgagttggtggtggagctgggagggagtcctctcgtccccatttccctccttctggtagttgccagaggtcctttgggctggttgagtggctgacgtagcagggacccctagtctcagagttgagcccccacggtccattttccacacgcatcccaaaatgtgagcatgttcctgcacagctcagaggtgctcatctcacttagagtaaaactcatgtccttgaatcggcctgcaggcctggcgtgcctggctcctgatcctgctgcagcctcaggctctgcctctgctccttgcttacatggccacagccacagcagccttccgggcatcccgtgaacacccaagcactgtccgtctgcgggcctttgcatttgctgtcctgagaatgctcttctcccagatatccccatggcccgctccctcacccacccaggcttctgtacgattgtctccttatcagagagtccccagctctgtccacccttcctagcacttgtcgctatccgacctgctgttatatatttagttacccactatctgtctcccgtgttagagtgtaaacttctggagggtggaggttttgtctgttttgctcactgttgcatccccagtacacagggccaaccacgaagacgctctcagtatatgcttgagcaagtgaatgtatgggtgatgccctgtgtgtgtcagggtatgtggcaggtgtccttccccctggcgcattgaggcaaagaggcttccttctgtttggcacagatctcagtgcacagtaggtacttggcaaatcagtgttccctccctcctttcccaccacccttcctttctatccggccaggcttgcactgtgcagtggggatagggtgatcatcagacccagcttcccccagcaggtctcccagctgggaatggaacttcctatctccacctaaacccctgcccctctgagctcatgtcccacaacttctgtccccagggaggagtgaccacccacacctcaccaaccccttgactgacacggctatgctagagctacagctagggttaaacagagctcccgatgaaccctattggtttttccccccaactttctggtgtgtccatatggagaaaggtctttgagaaaagaccatatacagcagagtgtgtgtgtgtgcctgggtgtgtgtgttacagtgacagggaagcgtctccagaaaggataccttctcctccattgccacctctctctccccctctcaagatctggtctgccttcagtggggaaggagggagggctgactcggtgtgacctctcagtgctgtctgtagtgaggatggttcttcactgggggaagacgcctggagagcagccagcagctctgtcagcactgggatctttgcggctggccagctaccgtccagccctcgcagggccccagatcggaggcccagcccctccctggctcccagctcccctgctgctcttgcgggtcttggggactttaccccaggcttggggaaaacaaacccaccctccagctttgttctcttgggttctgcctctttgggtcttgtcccctgcatctgtgggattcaactctgtctctgtgctgtgtctctctccaggcctctggctgcctctctgagtctttccctgctgtttcccacccttcaaacccaaagtcttcacagcgaggccccggatcaccctctgggaaacccggctggggaagcacactgggattagtcaaccaatcaatcagtcagtcaatgccacttcccttttctgtcatcaccagcctgcgtaaggtctgtcctctgtctgcctgcgtaccttggtctgaatctccatctgtctcaaactggctctggccttgctctgcctgtgttcaaatcctggtcctactgtgagactctggtcaagcaatttaactgctctattaacttacactgattcagtttcttcatctgtaaaatggcataatagttcctacctcatagggctgttgtgatggtcaaatgagatattccacattcacacactttttttttttttagatggagtctcgccctatagcccaggctggagtgcagtggtgcaatctcggctcattgcaacctctgcctccaaggttcaagtgattctcctgcctcagcctcccaagtagctgggattacaggcatgtgccaccacacccagctaattttttttatttttattagagacagggtttcaccacgtcggtcaggctgctctcgaactcctgacctcaggtgatgtgcccaccttggcctcccaaagtgctggggttacgggcatgagtgcccggccccacgttcacactcttaacatcttaacattgcttgacacatggtatatgctcagataagtattcactgttatcatcaatttttttttttttttttttttttttttttttttttagcagagacagggtttcaccgtgttagccaggatggtctcgattcctgatcttgtgatccacccaccttggcctcccaaagtgctgggattacaggcgtgagccaccgcgcctggcctgttatcatcattctttagtcatttttgctgcaggcattaaagtggggagagacaacatgagttttttgtagaaagagttttgtctccagctcccttcctgcactctttccccctttgctgctctcctttctggatgccggagaagggagcagatcctttgagccatttttctttctgccactctccttggccccagccctgggtggcctctgggctcctgctctgtgcggagccctggggagacaggctctgtgggccttccttccggggcagctgtggcctggagcttcccattttgtattcctcctcttgtttcatgcagccttttctcctcttcatcagatctgaaaccttctttgcctctctctggctgtggtcgcagcccagccctgggtggtcctgagggtttcccatctcccggtatcaaaggtatctttctcagggtgaccctggggactccctccttcctcaaagtcatttggaagtggagctgagggaaggtggacatccccatccactaacttctgcccaaagaaagtggggtcaaagagaagacctcccctgcctccttcgctgttcactcactcgctccccaggaaagggactggggcctctgagaagtgaggggtggggtagacaggcaaagcccaagacttctgggtcagactgcctgggcttggatctcagctccatcactgtgtgactgtgggactcggttttctcacctgtaaattggggataataacaatagttctaacctcctgggatggtggtaagaattaaatgagataatgcatgtaaggtagttaggacaatgcccagcacatcataagctctaaagaaatgtcagttactgatactttccataggggcagaactgaaagaggcctcagaggttacctagatctggcccagaagggaaaaggtctttcgctgtgtcactgaggctggggatgggtgggtgggagcccatggttcttgcaagtggcaccgagagtcgcaccaggaaggcgcacagtggtgaagggcactgaccatggaatcagacgctggactcagaccttaccctgctcttcccagccatgtgactcaggcaagccacttcacctccctgaatttcattttcattagccagtgaatggtgttagtcatctccacaccacaaggctgttgatgagcttattaaaactggcttactggtcgctcactctgagccgggcgtgggataggcgctggaagtcagagtggtgataagacagataggttcttgtcctcgtggagcttactttctgctgggtggagaccgacaataaaaataagagtttcggagaagagctctcaggaaaatggagcaggggaatggggtagggctggactggggagggtgctgccagcattagacatcatggtctgggaaggcctctctgaggggcaatatttgcaccacaacctaggagatgaggagccactctggaagctctgggcaaagcagcctccaggcagaggaacgacatgtgcaaaagccctgtggtgggagcgtgcttggtgtgctagaggggagaggcaaggaagggaggcagggctggtccacagggtccaggctgtgtgccctttgcgggtcccattgaagagtttacatgttcttctatgtgggttggggatccctaggaggtctttagcagagaagggacacaactaaatttatatattttttgttgtatgttttgagatggagtctcactctttcgcccaggctggagtgcagtggcatgatctcggctcactgcaaactctgcctcctgggttcaagtgattctcctgcctcagccttctgagtagctgggactacaggtgtgcgccacaatgcccggctaatttttgtggtttttttttttagtagagatggggtttcatcatgttggccaggctggtgtcgaactcctgacctcaggtgatccacccgccttggcctcccaaagtgctaggattacaggcatgagccacagcgcctggcaaatttatatttttaaaggatttctctggctgtggtgtagaggagagatggatgggggtgagagtggcaaggggaaggggctgttgagttgtgcaggctggaggggacggtggcccggccagggcagtgaggaagtctgatgagcagggtgagataatgtcatcaactcctccgcctggcctggtgcaggccccacaaatggagctgtgcctgagcccggatgaggtttccagctcttgagagcagcatcctgggggcttgggtcatgggagtggatgcgtgatgctgaggacctggcctgggtggtgtctctctcttctccttctcctgtctctctctctctgtctcattttctctctccctctctctctttctctgagaactgctgctgctattactccccaaagactttacataattctggcccggctccctcctcatgatgtcatgtgctgagtggagtctaggtcactccatcgcatgctgcggtcggggagagaacagacttctggctcccctggcgtgacggccaggcgcagaccctccccatgctggggtgggggtggctaggcttgtggtgggtggaggtgcaacctctgccccaggccctttggacagctcaggcaaaggccagggcttcctgcggtggccctggctggtgaggggtgggggttgtgctgggaggcctgtccctccagacctgggggcctctcccctggagcccaggccccagtagaaagaggcaggcagtcctgaggtcagtccctgttactgggtgctgctctgaacctaagtttcctacactgtaaaatggggacaaagacacccaatctcaggatggatggcttcagtgcactgtaaggggagcatagcaggaactgttctgaggacagaggtccaggcgtgtgctgggaagggccaagagggagtctctcccttgggcctacttggggttgtctgggccccagctcagtggctttacctacttcctgcatctcccatccctgcccctctgctagaccccacttcctaatcccaaggagaaggagagtagggtcgagcccctcccccttgcacaggtagggaaactgaggctcagagtggggtatggcttactcaaggtcacatagcctaggacggcaatgccagaatgaaactagacccggtgagccccagccccaggcattttctggtccattttgcagtgtgggatgtctgcagccctcaaggatgctgggaagttcaggtcatagtgcaagacctggggagggaagctttgctgctcctccacccttgcagacacatccgatatccttccactatattttcgtttttcttttcttttgggaaaacagtttggtttttgcagtttgtaggaaacttaaacaacatttactgagttttccctcccctgagaacagagtgctaagctcttcacagcatcattttgtannnnnnnnnnnnnnnnnnnntaatcctcccaataactattgaagattatacccccattttacaggagtaagaaactgagggccacagtcatacagttggggccagggtattcatatccagatttgtgcaccccaaagctctcaccttttcccctcatcagaagcacctgaaattgtcctgattcccccataactcctcaccccctgtggggcctgatctttacgaagagatggagaaagcaagtttcagagctgctgtgatgtttggccctggggagggagctcacagaggaaatgacggagtttgacttaaggggaacaaggaggatcaagggcttgtgcccaccgccatctcagcgttggttaatatccctgagtcagtgttgactagggctggggggaggtggagagaagaatgtgcctccccctgtttctagagttactaaattcttgttagatctttaaattttatgtaaattcttctttttttccctcttggaaaggtgggtatcgtattttaattagtagtggtgtcaaaggagggctagattaattattggaaatctcaagttccagatggttttaattttcacagcagggcaccagggtctatatttgtaaatttttttattaaaatcatacctagtgtattttaggggcactgaggtatactctttgtggctccaaggatactgtactcaggaatttggggctatgatttttgttatggagaagcaagtcccttgtcactgaaattaaacttttgtgggtgagggaggggcaggggctaggaagcaaggggtcagggaaaagagtgcacgaattgggagtggggcggtcacaggcaaataaagcagctggtactggggagtcaggcacagcggtttaagaccagagaggagagagagctaagagagggcgcgtggcctacccaaagtcacgcagcagcgtactggggagaaaaatgtgggctggtggagtgagaggaaaagatttggacacagcatacctaatcaagggacagtcactctttgcctgcttgatgtccttgttcaggcagggctttgggggatcagctctggacccctcatcctgagggaggctctgtggagcatggatggtgtagcatggggtctcccaccctggggggaatcccagtggggatccggtcctgattgggatttctgggctcctgggagttagttacccttcagctttggtggcctccatggacggcagtggaatatcctgcataccctttcctagggagctcgcacctcactccctgtgcccttcctgctatgaataggcaggttaaaggtgccgggggcactagcaggggctccagatgtttgccctgcaggaaggggccacagacctaacttttggaggaaatagcttgacgtcctgaaaggcaggggaggtgtgcgtgcacatgcctgcatctgtatctatctgtccccttggtccccttagctacttctctgtggttatttgtatggcatctgtcctgatttggggaatggggttatttttgtgattgtctgtcttgctttgggtttgggggatggggttatttgcatggccgcctgtcctgcttgggagaatggcctttttgtatggccgtctgtcctgctttgggaaatgggttttttgcacggttctttgtcctgtttggtggaatagagttgaggggctagggaaggtgggtgacgatgggtagaagggcacactggtgttcagccacagggggcagaactcccttctggctggagccatctggatcccaagtggagccaagagaggctggaggaaagggaacaggtgataggcagcttccatctccctgcctgaggggcaggggacagctacttctctgacttctctgtggttatttaggcatctgtcctgtgggacttgttaggcctccccatgcctgattttgggggagtgagggaccaaagataggaccagggaccatgtcactgagcctttagaccaagccattgcccctggtaataaaatgtgtcttgttctccttctgcctttcgaagcccagctcctagtggagacagacaccttcggtagtcaagtccggatcaagggcaaggagacggaattctacctgtgcatgaaccgcaaaggcaagctcgtggggaaggtgagtgatggtttgggattcccgggaacttcgggttcccctctggcagctctgggagctggaacaatgtgtccagggcactgtcagtcccaaatggaaaacaggccgtgtgtgtgtgtgtgtgtgtgtgtgtgtgtgtgtgtgtgtgtgtgtgtgtgtgtgtgagagagagagagagagagagacaggagagagagagagagactgtaatctcttcctttcaccccatcccatcccccacttctcttccccgggcacttgaactcaccaggctgaggtatccatggctgtgtctctcctgttgggtgtggagctctggcttgcttggtagtgggagaatccttgaggggctctggggcaccccggctacatgtccctgacgtctgggagcaaggaaccggcaggccaagggctgtggctgcatcgatcgttttaacaattgccaggggcttaccgtcctgcagcagtgacctctggaacctggccgcctcgtcagcgctgggcctcttggttctagcatttcagaaagattttattactttgaaactggcaagagagctgcatttaacaaattagggtgggggcaggagtgggggtgcaggttggggggaccctcgggttggggagacccacgtgtgtggggatctgagtctccaatgatgctgcttctcagcacccctgttcgtttcctgggtgcgcttgtttgcaaaagtcatgaactggcttcctctgggtgttccaatggaaggtgttatccacaggagctctatggtagggtcaggttctctgtccccttctctctgcagggactgactcccatatgcagtttgtacaaccagggttgagggggttttgcctggacaggtggagtggggtggagggtaggcctggattctaagggggatgggcttgtgcttgggggcaatgccctggctgattatttgcggttcattacatcttgttgggggtgggggagatgacttcagtcttgctgaagccatgtttttgattttttgaatcccccaagtcttatccctctccctttcccccataccaagaggctggggaggatgtaacaggccagagatcccagccagggcattgtcgcattattttgttaataattactgtcataatagcttccgctaattgagcactgactttctgcccggcactgaactgaaacgctcccaatgaatcccaggaggctgccaccgctaccatccccattccacagatgaggaagccgaggcttggccacgcccgggcacttgtcccaggtcccacactacagctcggcgggattcaaagcccggtttggaaggaaaagattccagccgcactgcccacaccaactgaggcttctcaaagagcaaaataatagtaatccgcagagcgcggctccgggatgccgaggagtggttttaattagtgattcactttccgccgttgcgaggctggccggccggcgaggggggtcggggccggggccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccacccccacccagctccaaacccatccatgggtcctcccaccttgctatgggacaccgaaggccctggggagcctccccgggcacatggattccttatgctccagatgcgtggcactgagcaccgctgttccatggacggggccttcgggcactgtccatgctgtgccctctgccgggactgcccttccctctgtccacttgccctgagtcctggctggtcattccctgacccctctgtcagcccacccaccccggagccccacagtccctcgcacagccctctgttgcctgtctgctaacctgggttgtcactgtttgtctttgtgcctgcatcctctgtcacactgggaactccctgagggcggattctgcatccattcatctgagttctgtgtacctggccaaagggctccgggggcaccaaagaaatagaaacatggttcctgctgtctgtggattgactcttaagctacagcctgaattattcacatcaacccaagggagtctaagcgccctggccttgctgagcctcagcgtcgtcatctgtaaaatgggaatgataatctgggcacttagtaagcaggtaggcacttgctaagtgttagtccctttcccctttggagccaggtcacgaggtcacttcttcacctgtgggaacgcctggtctcagctccagtgccaactcctttggagtggctcaatggggcagcttccttgggccatctgtgtgccaaccctgcacatctctggccacagcaagggtacctgcattgagcccttgacagagctttccagaggttgcaggcccttgctggagttactctttctgctgcattgtaccaatcagatgccaaagctgtgtccccagcccctgcatgttcaggcggccccccttctccttgctaccctctggaacccatgtcacctggcccaggaggtggcgcttcctttcattttgtaaacagttgttgagtgtctagcatgatgtgctaggcatttttttccccatctctggagacgcaacccagattgtatttttctcatctgccaccacctattgcgatcactgatgagtcctttttggggcaacatagagccacagaccttttcagggcaggggagtgctctgcccaccagcacatctttgttaagatggctttggttgcaaatggctgaaacttaacctaaaatgccttaagcaaaaagggaatacggggcttatatagcaaacaacaacaacaaaaaccaacagtccagggggtagttctagtttcaggtaagactggatctaggggccagatgaggtcatcaggattccgtcttcagatcaaatggaaggactagggctccagtttgggaagcaagaggttggaggtggtagtaggaaagagatcaaattctgctacatcatcagggttctgggatggaatattcacttactctctacatactgatgcttctgccttgcctgaaccaattaagtcagagtttccgggggtcgggcccaagcacaggtgtttttgtttttggagtctctgctgtggtgagcagggtcatagaggtagccaggagcagaggcaagcgtcaagcccggatgtagcctgctgttagcttcttatccatttttgcctgaggtcacgcaggggaacttgtgatcatcatagccccagggctggttcccaagattcgtgaatttcagcccaaagcctagctcttcagcccttttaagtaaacccagacatgcattgagcccgcgtgactggcactgggtagctccttgtacatccaaaacctcgctttgtgccaatggtggctatgtgggcctgggggaggcgagatgttttgatgggcagcacctgctcctcacctttcccccttgtggacctctttggaactgggcagaggagaagtgagctgcagtggctagggcaggttcaaatcccagctctgccacttagaatctccatgaccctgggcaaggccgatttgcttctgagctctgctttcttctaccaagcagagctgaagaagaggatgaaatgcagtaatggaagtagcaatgtttggcctgtagttggcaatcaataaatggttaatgactgagtagggagaccaagtgtgcgagacaatttctagggctcagcttgctttgtctccctaatcagtgtgtctcaggagggacctctcatagcttctgcttgtctctgggacatttataacagatccaggagggagagtctgttttcttcaggaggaaacccctttcatgtgtcatcccaccgtttccatcctaatgaaaatgcgttcaaccccaaatgctcggggcacccctgtcttgagctaagacctgtgctcagcaacaagagaactgagaagcagccctgacctcagcaggcacttgggctaatgcggaggcaggcagatatggaatttctctgttggggcatggggaggagaaatggggttcagaagatggagtatgtgagcccattaaggcttgacgcttgaatggagtcttgaatgaggaagaagaattgtccagggagataaagggaagtcctggaaggcttcccagaggaggcagtttttgagctgagcctggagggatgaaagccattttccaggcagtggcaggtattctaggatgggggagcatcatggtgtagcctttgttctgtttgctccaactatttggttgagaccaggcaaagaacctggattcaggttgcacacacagcttccagaattttccatggggtacccagagcccagggaccactcctctccacctgccttgcacacttaccctggctttcctcacagtagaccttcgctgctcacgccacccatactgtcctctgggtcccacgtgtgtgtcccaggtctgcccatgcctgttctgcagcctcctcgaaagatctcatcttccagagagtgttttcttaccctgcctgtccctttctgcaaagttcagcactttgtctggagggcccaagcttgccctctgctcaaaggtgaacgttcctggaagctccagcctgttttccacttcaaacaaaaggctggaactcgcacctcagtctccacacacagccagaccgctgggcttccagcttggctgggcatccgtccgtaacgaggagtgggcccggcctaaatttggagatgttagttggaaactcaagtgctgctaattcaggccttccaactttgtgtttcccactcttccccatcgagcaattcggctgtctcagagaggagactaacaccctgcctcctcaccaccccctgtccagatcagatccaaggaaggcacgccagccctgtcgggaacagctgccgttcaggaataatctagcaagctcctactgtgtgtcagattcatttataagcatcactcctacagtgtctctatgatgcaggagtcattgttcccattaggtaggtgaggaatttgaggtttacagagtgggactgactggcctgaggttacacaagggaagtgttagaggtcgtttgttttctgactccaaatctagtgctccttgtccagcagacccaggctcccaagggagttcacacatcggcccaggagcctgagatcccacaaccgacggcacagtttggagtttggccatgcgaaatctcttatttttggaggccccacctttcttcataccaagtattaaaatgcaccacatcccacatgacatgtaatttgtatttaactagatcacagtggagttgagttacagctgagtagctgatttaatgtcaggttttatgcaaatctatcaggactcatttctgttgtaagcgatagaacacagtatcacctgttttaaaggaaacgaaccatcattggcccacataaccgtgaggtaatgtgagcttcagacgtggctggatctagagcccaaatgatgtgaccaggacgtagtttctgtccttctctcctccttggctttgcttcatctgtgctggcttcactgtcagacaggatctcccctcatggtgataaagtggctgcctctgcttcagccttacaaactcctctggtttaaatccacctatgtttggggttgcctagaaaaggtctcaaggaacactgattggatggcttgggtcacttgctcacctgtgagccaatcactgaagccacagggaaaatagtgtctggatgtcttgctctggtagggatgaagtggagccattgggctatctgggtggagagtggggaaggaatagatttctgaatgacaatgggagtctgttacctaattggagggtgggggaaagatgcaggggccagtaacaaaagtttactccacagatccaggaagtgaaggctctctgtcctatgctgccccagccacagcctcctgcccatgccccttgtacctgctgtctcctctctctcctcctaacaaagagtcttcactcggccaaactagagtcaggctcctgaaccttctcttatgcccatctgtgcacttctttgtaaaatccagttttagcaagagccctgctaagtcagtttagcaaggatcccccactcttgatatatgatcagggtcctcatcctcctccatccctcaggtgatgtctggtcaccctggcctgtcctcagcaaagtctctgttaggtggctttagccagaatcccctacaccctcgatgtttcctcttagtcattttccactctgctccttggctataaacccccacctgcctgtgccatattcagagttaagctcaatctctctcccccactgcaaaacttcattacagttgtccctacaacaatcgcaatggtcctgaataaaaccttcctcgctgtgctttggcaagcataactgagtcatttttttcttgaacactccccctctctcccctgcagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaacaaaaaaaaagaaaaacaaagagaaagtagtactccgcccaccaacaaactccccctaactttcccaatcctctgttcctgccccaaactccaacaaaaatcgctctctggtttgcagtcatttatttattgtccgctgcaagctgccccgagacaccgcgcagggaaggcgtgcccctgggaattctccgcgcctcgacctcccgacgacagacgcctcgtccaatcatggtgaccctgccttgctcgcagttctggaggatgctgctatcgaccttccgtgactcacgtgacctagtacaccaatgataagggaatattttaaaaccagctatattatatatattatatatatataagctatttatttcacctctctgtatattgcagtttcatgaaccaagtattactgcctcaacaattaaaaacaacagacaaattatttaaaaaaccatgaggcgagtggtggctggtggctggtggcagggcgggggcagggtggcctctgtgtctcatgctttctggttggtctgtggtctttgcactgagagctagggccttgcacattcattcattcattcattcattcattcattcattctttgaattcaacattactatgcaccaggcgctgagaaggcagccttagaacagatggaaatccttgctttccgggagattccattctaatgggtcattgattcagtggcctcttcagtcatttgttcatatgcatttactcgtacctctcatgtgccaaggctcgattctcgaccctggggatttatccaagaacatggaagaaaatcccagccctcagggaacttcacttctagtaattcattgattcattgcttcatttgctcatttcttgatggatttatccattcaatatatatttcttaggcacttactaagcgccaggcactcttctaggtactggaaattcatcaaagaataaaacagacaagaaatcatgcctgtcagagcttgcagtctagggattaattgagtcacttgtgtcttccacatcagtgttttgccaggcacaggttgaaccagggaatatggtgggaggatctagatcagtttgggacctggcgtgtctgtcctcaaactcccatgggctggagcttgaggaatctggtgatgttaccttccaagtacccatccttcaacgtcttatttcccagggcctgtcccaggatgtcagggagaggccaggttaatctcgggattgaggcagattgaagattattgagtcctctgccctgagatttgggctgtgtgagcagtcaggcttcaagtgggggactgtttctgtttcttcccctccccatggcctccaacctaagtgtctttgtggggcaaaccatgtattcctggtggggcaggaggtagcctgaggcagaaggcacctctgctgctggggtcctgtggctgtcacctgcctcccttgaaaactaccccccagggctggtcaggagaggtccccatgagaccctaaggagaggtgggggcagaggcagtggggaggggtaggagtgccttctctgcaggttcctggctggagttggcattccacttcttccgagcgcagctcttggtcttgccctcgctctctgcgtcatgaaacctcatcacttcacccctgggccctgtcccgcatgtctgtggcttgccctcctgtccatcacagcacatttctgtagagttttgtgaagctctttagctgcgcatctcatggtgttctcaggatgcctttattatccccattttatagatgaggagactgagtctcaataacagtaagccacttctccaagatcacagaataagaaagtggttgaacctgtgtccaaatcttagcttctccaggatggcgacggctgccacttggagagtgcctaccattgtcggaacccctgctggaggcttcagtaggggcgctgcctgggtatccatcagacaactctgtgtgggaggtgggtatccctgcgtgggaggtgggcaccc

SEQ ID NO: 16073 - DNA, 385136 bp, Human
  misc_feature (1)...(385136): n = A,T,C or G
gcttttttttttttttttgagatcaagtcttgctctgttgcccaggctggagtgcagtggtgcaatcttggctcactgcaacctctacctcccgggttcgagtgattcttctgcctcagcctcttgagtagctgggattacaggcttgcacccaccacctctgctaatttttgtatttttagtggagatggggtttcaccatgttgggcaggctggtctccaactcctgacctcaaatgatccacctgcctcggcctcccaaagtgctgggattacaggcatgagccaccatgctcagcccttagatctcatttgtggtggagatgggtagtttttaaaaatggatgtttccatggctgacttctgtgtttctcttatttttttcttttaggcaaatatgactagagattatctatcttattatgcttctgtcttttaccattgtattacatttctttgcttgctcttaaactactgaagtgattaattcagtatgtccaccttatgaactagaagacataatataaatctgaatgttaatattggagcaagtggccttaaattatgaaattatgttttcttgccctcttgtggacaagtaagagtttgtagattttaaaattttttctgcattaactttagagcttcattgccaatattcatttcagagaattgcaaagctgctattgagtaatttgggtgcttacataaaatattttgttttactttttattttgattttggtttaaaatatctgtaaaatacagatttttaaaggttaaatgatttaaggaggtttacctaattctcttggttattaataaattttggggggtgacatatatcttcagtaagaatgttctacaaaaagcaattgtttttgcatattctcagaagtgttttatgggttatgcatttattttatcttttcaatgttagtatagttgtgaaattttctgttttgctgataaagaggattttaccaatatactttaaaatgtttagttgtttaactcactatcatcaaccaataggtggaagataatatgccgattcctgataatttctcttaaatgattttccaacatccttacgttaatgtttcatggctgtaaaagttggtatgaatattagattgttttagaatcacaaacatgttttaaagatgtatgattacaaaatttttttggttatttttctttaataggtactattttctatatatttcatggagctcctatgaatgaaattgcttagagactttcagttttacaaagatactttttgaattctgtttcatcccagctacagtgcatactaaaactgttttcaaggagcttacagacaactgggcagaccttttttgttacttccttttaatctatactcctccaaaatttacctgggtgaattttgtttttgctcaactttagttatttgctcaactttattccttacattgcagtaatttgtttgaatgactgtctagagacatggagagacacggagttgcttgagggtacagtgcctgtagatactcaataaatatttgtttaattaagaaaatttctgttatttgtgtgctcatacataccatttcagtctggtgagtattgttctttcctagagtttacttttaatcttaagtattttccaggtcctttgttgacttctgtttaaaccacagtacacacacacacacacacacacacacacacacacaacttttgtgtactataatagcttccccaaaattataatttagtcattgtgatgcagatcttcttccaaggcctctactttggattccttgttattaatcattgatgacaaaactagacctagcaagaatccctctatttttttacattgttaactacccaattgacacagagtattttaagtactcatgaaaattgggagacttaagatgctttggggttttactgattttattgtccataggttggcttgtttttaagcctttctttttgtctcataatttagggtttgtctgatccaggtaattatcatgaattttgtcgatttttggctcgtttaaagacaaattatcagctgggagaattagttatggtgaaggaatatcctgaagttattagattgattgctaattttaccattactagcctacaggtaggtaaaaatatgtaattatgttaaactgtagccagttttaaaacagcttcttggtaagggttggtgggggtatttgaaaaatatctattaatttgattactttgctggaaatgttcattgcagggttttaggttaaaaaattcattgaaatgtatataataaaaattgagaagctatttaaatatctaataattgaataatggcttgagaaactataataaaatctatgtgaagaaataaaatttttacagattatattatagaaaagtttttaaaataattttaagggagagattataaaaccatgtttttcacaggatgtcaactctgaaaaatattcatggaatgattagagggaagtagagtaatattttaatgttactctgggtggtaaaataatagagatgttggtttctttatacttttttgcatttataaatttgctatattatgtgttcattagttttatagtaagaataaaagttaatttaaaaatgtatgtttagtaattttattctgtaattcttattgtaggaagatgtaatattttaaataacttctgctttatttctttgtagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgaggtattcaaaaactaaatgtttttgttgtatttccttttgacacttggaattttttaagataaagttataaatttaaaattcaccccttttagcgtacagttgtatgatttctgacaagtgcacacaattgtataactaccatcacaattgagatatagattagttccatcaatccagatagttcttttggctcctttttcagtcagcccctctcctcaccctcatctctggcagttactgatctgttttgtgtacctgtaattttttttttgtcttttccagaatgttgtataaatgaaattatacagtatgcagctttttagtctgatttttttccacttagcataatgcatttgagagattcctctgtgttgtgttagtactttactttcattgctgagtagtataccattttgtggatatatcagtttgtttaccaattcacctgttgctggacttttgagttgtttatgtttttggccattgtaaataaaactgatgcaaatactcctgcacagattttgtacaaacataagtttttgtttctcctgggtaaatagctaggtgtgggattcctgggatgcatgttaaatatagtatatattttacttcgtaaaagctgccgaactattttccaaagtggctgtaccattttgcattcccgctcacaatgtatgaaagactcaattgctctgtgttctcactagcacttgatattgttagtttgaaaaaattttactcattctaataactatgtagtggtacctcattgtggttttcccttaatgactaataatgttgagcatattttcatgcacttatttaccatctgtatgtattcattgctagtgtgctagtcaaatccatttcccattttttaattgggttgtatattttctttttttttttttatattgagatttgagcagtctgtgtattttcttcacaagtctttctgttatgtatttgcaaatattttctgtgttgtttgccttttcattttctttctttttattatactttaagttctagggtacatgtgcacaatgtcttgccacgttgtcttctacaatggttgaactaatttacattcccaccaacagtgtaaaagcattcctgtttctccacatcctctccagcatctgttgtttcctgactttttaatgatcaccattctaactggcatgagatggtatctcattgtggtcttaatttgcatttctctgaccagtgatgatgagcattttttcatatgtctgttggctgcataaatgtcttcttttgagaagtatctgttcatatcctttgcccactttttgatggggttgtttttttcttgtaaatttgtttaagttctttgtagattctgggtattagccttttgtcagatggatagattgcaaagattttctcccattctgtaggttgcctgttcactctgatgatggtttcttttgctgtgcagaagctctttagtttaattagatcccatttgtcaattttggctttggttggccttgcttttggtgttttagtcatgaagtccttgcccatgcctatgtcctgaatggtattgactaggttttctgctagggtttttatggtgttaggtcttacatttaagtctttaatgtatcttgagttaatttttgtgtaaggtgtaaggaaggaatccagtttcagctttctacatatggctagtcagttttcccagcactgtttattaaataggaaataatttccccattgcttgtttttgtcaggtttgacaaagatcagatggttgtagatgtgtgttatttctgaggcctctgttctgttccattggtctatatatctgttttggtaccagtaccatgctgttttggttactgtagccttgtagtatagtttgaagtcaggtagcgtgatgcctccagctttgttctttttgcttaggattgtcttggctatacgggctcttttttggttccatatgaactttaaagtagctttttccaattctgcgaagaaagtcagtggtagcttgatggggatagcattgaatctataaattaccttgggcagtatggccattttcatgatattgattcttcctatccatgagcatggaatgttttatcaaggttcatagcttcctttcattgggttagaatatgctcctttagctcggagaagtttgttattaccaaccttctgaagcctacttctgtcaactcatcaaactcagtctccgtccagttttgttcccttgctggtgaggggctgcagtcctttggaggagaagaaagaggtgctctggtttttggaattttcagcttttctgctctggtttctccccatctttatggttttatctacctttggtctttgatgttggtgacctacagatggggtttctgtgtagatgtcctttttgttgatgtcgatgctattcctttctgtttgttagttttccttctaacagacccctcagctgcaggtctgttggagtttgccggaggtccactccagaccctgtttgtcttggtatcaacagcagaggctgcataacagcaaatattgctgcctgatccttcctctggaagcttcatcccagagggtcacctgcctgtttgaggtgtctgtcagcccctactgggaggtgtttcccagtcaggctacacaggggtcagggacccgcttgaggaggtggtctgttcgttctcggagtttgaacgctgtgctgagagaaccactgctttcttcagagctgtcagacagggacgtttaagtctgcagaagctgtctgctgccttttgttctgctatgccctgccccaagaggtggaatctacagaggctgagctgcggtgggctctgcccagtctgtgctttgtttacactgtgagctattcaagcctcagcaatggcggaccccccttcccccgtcaagctgcagcatcgcagtttgatctcagactgctgcactagcagtgagttacggctccgtgggcgtgggacccactgagccaggcacgggagggtatctcctggtctgcaggttgctaagactgtgggaaaagcacagcatttggtcagaagtgtactgtttctgcagatacagtctgtcacggcttcccttggctaggaaagggaaatcccctgaccccttgcacttcctgggtgaggcgacgccctgccctgcttcagcttgccctccgtgggctgcacccactgtcgaaccagtcccaatgagatgaaccatgtacctcagttagaaatgcagaaatcacccatcttctgcattgatctcactgggggctgcagaccagagctgttcctatttggccatcttggaagccctccgccttttcattttcttagcagagtccttagaagagcagaagttttaaattttgacttaagtccaatgctttattttttcttttatgtattatgtttttgttgttatacctatggaaactaatccagggtcacagagatttttcttttattttcccttctaggagttttattgtcttagaatttacattttagtctgtgatctctttcaggctaatttttgtatattacctggcataaggctagagttcttctttttggcatatagatgaccagttatttcaacatcatttgtgtaacagactatcctttctccattgaattgtttttacacttttgtcaaaaattaatttactgcatacatgtagttctatttctggactctgtcttcattaatctatgtgtctgttctttcaccagtaccctgtcttgattaggtttataataagctttgaaatcagatagtatgagttctttaagtggcttttctctttcaaaattgttttggcaattctactttctttgcttttccatgtatatttttgaatcagtttcttagtttctacaaagaagttctgctgggattttgactgggattgcattgaaactatagattaacttggggaaagaattgacatctcaacaatattgagtctcttagtctctgagcatgtctatcttttagtttatttagctcttctctgatttttctttaatcaaacattttatggtatttagccttcagatcttgcatacatttaggtagatttaattgatattttatgtttcctactgcctttgtatgatactgttttttaaatttgaatttctagttgttcactgccaatatctactaatacaggtcattttgtatattgacctcgtatgctatgatcttagttaaacttacctattagtttgagtagcatttttgtgtttctaaaaatattttctgtttacataatcatgccatcttcagatatagacagttttattttttaccttctaatacatttctattttattttttatttcttttcttttttctttttttttttagagacagagtctcgccctgtcaccccagctggagtgcagtggcgcaatcttagctcactgcaacctccgcctcccaagttcaagcaattctcatgcctcagcctcttgcgtaactgggattacaggtgtgtgccaccatgcccagctaacttttgtatttttagagtcaggatttcgctatgttggcctgactggtctcaaactcctggccccaagtgaacctcctgcctctgtcttttattcctttattatagaatttttatttaacatgaagtttatttgtggtgaataaaagtgcttcacattctaatgttgtctgcaaacttattctgtgtttgcagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggtcagtaaactttatatgactactgagtattatgttgaatattaagtaacatcattaatcactttaatagttttactgcaagttatttttatgtattttccccaattcctggtcccctaataaaccattaattttattaacctcctgggtatattggtaatttgttggttgatttttttttttttcagttttcctctataagattgataggatatacttctctctggaatcaatatgaagaaaaattgataatggcccttgagcagatagtttatgaacataactatcttaactggttgtgttttcttctttgctatacttgattgcaaactcagaacccaatttcagccaataaaaagtatataatatatcattgtgattttgcttttaggtattagccttcgttatggctttactattatttttattcctcaatttctttattttgtttttaaccctttattgacggaggaggtatttatttctgtatatccttttaggtcctttcaggaacatagggagtaaaaataaatgtatttttccaattttcttgttaagatgcactacaggaatggaaatttctagtagaaagcactttatagttctgaagttgttttgcatatttgtttatcttgtattggaaagtgagtttagtaagagatcataatcaaatttacttccagtgatttcccattttaacttaaaaaaatttttagaagattatcgtttacatttgaataatgttttttaaaaatgcgttttattatctgtccatcttgcgttaagtcacacagtactgatgaggggctagtgtgagataatcttctctacttcagtgttttttttcttttatgggatcttatttgtaaattaaatggggacaactaacacttttgcagcatttagtctcttcattattgatttattcttctagaagagttttgaaagttattaaatatcaaattcatataaaaggatatttatatatattgagacatacagaatagcagtaaccacaaacactattaccttgcttaaagaataggtcatttgccaatacctttgcagcatctttgttcctctttccaaatctgtcctctttcctatcaacagaaaatacttaacaatcttgaattttgtgtttatcaattcatgccttttcttcagtattaccacatgtgtatgcattccgaaaataatacatgatattgcatatttctcaacgttatacaaatggaatcaactgcatttattctttgacaactttattatcatttctcagtattttatttatgacagctcatactgatgcatatagctatagttccttcattttcagtaccatgcactgttacgttgtttgaatgtacctcagtttatttgtgcattctcttgttaataggtatttgttttctgttttttgctaataaaatcagtgctccttaacaattgttgtgatatccattatatattcagctttagtaggtactgttaaactattttacaaagtgtttgtactatttgacatcctaccaatagtgttcaggtgttcccatcaatctctatcaggaagtggcaaactttttcttaaagtgccaaatagtaaatgtttcaggtctccatcgcaactactcaagtctgcctttgtagccaggaagcagccgtagaccatactcgtgtctgtgtttcagtaaagttttatttacaaaaacaggaggctgtcttataggctgtagtttgctgacctggacctagattcttgccagcagctcgtattattatacctgcatttttgatgatctagttgagaataatatacctcctaggtattttacttttcactctgctgattaataagtttagtattatttcatgtttattgattgttgtatcatcatcagtgaaatgtatgtgcatctcttttgttcatttccacctcaccactggattgctttctttcactgatttgtaggagtcttttatgtattttgacattaatcatttaggtttttgaattgtaaatatcactccaagtttgcgacctgtctgctgcatatcattttagtgtgttattcttattttcatatcaaacttggttttgattaattcacaaaaatttttttgaagaggtaatgtatttcattgtgcaaaaattaaaaaaaattaaaatgtgttctgttccagtgctatactctgtcctccctttcttcactctagcaagtagttattcttagttttgcatgtctttccaaagtttctatatgcatatacaaagagttatgaatatataaattcttacctcccttatttgcatagaatacagcataccatactcactgctctacttcttgcttgttttcatttagtgttttatagctattttcataatatagagagaactcttattttttgtagatacatacgtaatattttactttttgaatatatcataatttaaccattccatccactgttgacaatgatttgagtgatttagtcttttcctgttaaaagtattcctgtacagataaaccttgtatgtgtcattttatgtatatatgaatttataaatttctcctagtgaaattgccgttgagtggaaggttaatgtatttgtaattctgcaaatgttgcccagttgttttctgtaaggactataccatttacttgtccactagaaatgtatgagattgtttccatgtatccttcataggacaatatatatatatttttattatactttaaattctgggatacatgtgcagaacgtgcaggtttgttacataggtatacacatgccatggtggtttgctgcacccatcagcctgtcatctacattaggtatttcttggaattcttggcaatcctgtgtgtgaaaaatggtttctcagtataatttaactttgcatttttcttatcagtgaggttgtgcattgtttaaatttacataagagccatttggcctttttttttgtaaatgaacaattcatttcctttgccatttttctattgggttgttggtcctttttttctccttgatttttaagagctttttacagttaggaaagtgagctccttgggtgtgatcagagttgcaaatatctttttcctttttttctttgcatatgttttagagattcaaatatggtgagcatattttgtttctttttgttgttgcatagtattccatagtattgccttaccatagtttatccattcaccagctgatggacattgaattacacttagagtttttggctattgcaaataatgatgttattaacatttttagacaagtctttgtatgtagaagaaattttcatttcttttggataggtacctaagatgagtgctgggtcatatggtaaatgtatgtttaatgttgtaagatactactaaacagttttatgaagtggatgtatcatttttcattcccattaacattgtataagagtttcacttactctgcatccctgccatcatttgccatctgtttaggcactctactgggtgtctagtgttatctcactgtggttataatttgcattccctaatgattaatgatgttaagcatcttttctattcttttttgccacttgtatttcttattttgtgaaaagtctgttgcccatttttaaattggattgttggctcttttgtatgtgttagggaattgcaagagtgctttatatgctctgtattctgtatacaatctctttttcacatatatgttttacaaatatttcctcccagtctgtggtttgtcttaactatttttcaaaggtgaaaagtttttaattttgatggtctactttttcacttttttctttatggcttgaggtttttgtatttatgaaatcttttctaacctaatgctatgaagagttctatgatttctgtaagtttaatagtttcagctattatattgaggcctgtgatccatttggtgttcatttttgtgaatgttgtgagttaagggtcaaggcttacagttatccagttgttctaacaccatttgtagaaaagaatatctttctcccccattgaatcactatgacaccttggtcaaaaatcagttgaccataaaatgctagagtctattagtggactttttgttctgtaccactgatctatatatgtttatccttatgctaatactatattgtcttgattactgtagcattaataattcttgaaatcaggtaatacaaattatttaaccttttttttttttcaaaaccgtttggctattctaggtcttttggctttactaattaattttagcatcagcatctcagtttcttcaaagtaggtgctagcattttgatagggtttgcctcaatctatacatcagtttgggccaggttaacaacattgaggcctgcagttcatgaacatttagttttctttgcaatattttattgttttcagtgtacagttagtgaaattgttcactgagtttattcctatgtatttttgatgctattgtaaatttcctgattattctctgctactctattaaaccagaattgaattttgtctttgtgtcttataactttgcttaatttattagttctaataactatttcatagattcttaggattgtctatgtgatcatgttgtctgcaaataaagatagttttatgtcatctttccagtctccatgccttttgtttatttttcttgccttattctactgagggcttccagtacagtgttgaataaaatgttaagaaggggacattcttgccttgtttctgtttgtaaatagaaagcattgagcattttactgttgagtatgatgttatctgtacgctgtttgaagacgttcatgagtttgaggaagttctcttcaattcttcagggtgtttataatgaataacgtattattttggggttttaaaatagaccttttatgcatctattcaaatgacttttttcctttattttacgaatgtagtgaattatattaattgatttttcgatgttaaaccagctttgcattctcaggataaatcctacttggtcataatataatgtttctttagaaattgttaaattcaatttgcaacacttttgttattttatatcagtgtttatgaaggatattggtttgtagttttcttgtggtgactttgcctggtttgggtaacatggtaatactggcttcataaaatgagtccggtagtgtttcctcttcctcctctatcttgtgaaagaatttgtgtagtattgctattatttcttctttaagagggatagaattcgtctgtgaagccagcgggccaagagggtttataattgtgaattcattttctttaatcagcatagaactattcaaattttctgtttcccttggggtcaaatttagtcatttgtgtctttcaaggaatttactcaatgtttcaatgtattggaataaaactattcttaatattccattgttattaatatctccagaagctgaagttgagattgataattttgtcatttttttcttttgttctgagtgacccaactagattttcatcacttttgttgatctttttagagaactatttttagtttcattgatctttattctttcttcattttctatttcactgattttttttcgcctttattattttctgccttatacttactttggatgttatttgatattccttttctaattctgggtgcagactgcagatctttgagttttagatttttggacttttctaataaaaacatttaaagctatcaatttttctttaaacattactttagttgtttaaacattactttagttgcatcccacgagttttgtagttttattattacttttttctaatctttttattattttttattttatttatttatttatttattttactttaagttctagggtacatgtgcacaatgttcagttttgttacatatgtatacatgtgccatgttggtgtgctgcacctgttaactcgtcatttacattaggtatatctcctaatgctatccctccccgctccccccactccccggcaggccctgatgtgtgatgttccccgccctgtgtccatgtgttcttattgttcagttcccacctatgagtgagaacatgccgtgtttggttttctgtccttgggatagtttgctcagaatgatggtttccagcttcatccatgtccctataaaggacatgaacttgtccttttttatggctgcatagtattccatggtgtatgtgtgtcacattttcttaatccagtctaccatcattggacatgtgggttggttccaagtctttgctattgtgaatagtgccacaataaacatacatgtgcatgtgtccttatagcggtgtgatttataatcatttgggtatatgcccagtaatgggatgactgggtcaaatgttatttctagttctagatccttgaggaattgccacactgtcttccacaatggttgaactagtttacagtcccaccaacagtgtcaaaagtgttcctatttctccacatcctctccagcacctgttgtttcctgacttcttaatgattgccattctaactggtgtgatatggtatctcattgtggttttgatttgcatttctctgatggccagtgatgatgagcatgtttttcatgtgtctgttggctgcataaatgtcttcttttgagaagtgtctgttcatatccttcacccactttttgatggggttatttgatttttctttgtagattctggatattagccctttgtcagatgggtagattgtaaaacttttctcccattctgtaggttgcctgttcactctgatggtagtttcttttgctgtgcagaagctctttagtttaatcagatcccatttgtcaattttggctttnnnnnnnnnnnnnnnnnnnncattttcttaatccagtctaccatcattggacatgtgggttggttccaagtctttgctattgtgaatagtgccacaataaacatacatgtgcatgtgtccttatagcggtgtgatttataatcatttgggtatatgcccagtaatgggatgactgggtcaaatgttatttctagttctagatccttgaggaattgccacactgtcttccacaatggttgaactagtttacagtcccaccaacagtgtaaaagcgttcctatttctccacatcctctccagcacctgttgtttcctgacttcttaatgattgccattctaactggtgtgatatggtatctcattgtggttttgatttgcatttctctgatggccagtgatgatgagcattttttcatatgtctgttggctgcataaatgtcttcttttgagaagtatctgttcatatcctttgcccactttttgatggggttgtttgattttttcttgtaaatttgtttaagttctttgtagattctggatattagccttttgtcagatgggtagattgtaaaaatttttctcccattctgtaggttgcctgttcactctgatggtagtttcttttgctgtgcagaagctctttaattagatccaatttgtcaattttgtcttttgttgccattgcttttggtgttttagaaatgaagtccttgcccatgcctatgtcctgaatggtattgcttaggttttcttctagggtttttatggttttaggtctaacatgtaagtctttaatccatcttgaattgatttttgtataaggtgtaaggaagggatccagtttcagctttctatatatggctagccagttttcccagcaccgtttattaagtagggaatctttccccatttcttgtttttgtcaggttattcaaagatcagatggttgtagatgtgtggtgttatttctgagggctctattctgttccattggtctatatctctgttttggtaccagtaccatgctgttttggttactgtagccttgtagtatagtttgaagtcaggtagcatgatgcctccagctttgttctttttgcttaggattgtcttggcaatgcgggctcttttttggttccatatgaactttaaagtagttttttcctattctgtgaagaaagtcagtggtagcttgatggggatagcattgaatctataaattaccttgggcagtatggccattttcatgatattgattcttcctatccatgagcatggaatgttcttccatttgtttgtatcctcttttatttcactgagcagtggtttgtagttctccttgaagaggtccttcacttcccttgtaagttggattcctaggtattttattctctttgaagcaattgtgaatgagaattcactcatgatttggctatctgtttgtctgttattggtgtataggaatgcttgtgatttttgcacactgattttgtatcctgagactttgctgaagttgcttatcagcttaaggagattttgggctgagacagtggggttttctaaatatacaatcatgtcatctgcaaacagggacaatttgacttcctcttttcctaattgaataccctttatttctttctgctgcctgattgccctggtcagaacatccaacactatgttgaataggagtggtgagagagggcatccctgtcttgtgccagttttcaaagggaatgctaccagtttttgtccattcagtatgatactggctgtgggtttgtcataaatagctcttattttttttgagatatgtcccatcaatacctagtttattgagagtttttagcatgaagggctgttgaattttgtcaaaggccttttctgcatctattgagataatcatgtggtttttgtctttggctctgtttatatgctggattacatttattgatttgcatatgttgaaccagccttgcatcccagggatgaagccaacttgatcgtggtggataagctttttgatgtgctgctggatttggtttgccagtattttattgaggatttttgcatcgatattcatcagggatgttggtctaaaattctctttttttttgttgtgtctctaccaggctttggtatcaggatgatgttggcctcataaaataaattagggaggattccctctttttctgttgattggaatagtttgagaaggaatggaaccagctcctctttgtacctctggtagaattcggctgtgaatccatctggtcctggactttttttggttggtaggctattaattattgcctcaatttcagaacctgttattggtctattcagggattcagcttcttcctggtttagtcttgggagggtgtatgtgtccaggaatttatccatttcttctagattttctaatttatttgtgtagaggtgtttatagtattctctgatggtagtctgcatttctgtgggatcagttgtgatatcccctttatcattttttattgtgtctatttgattcctctctcttttcttctttattagtcttactagcggtctatcaattttgttgatcttttcaaaaaaaccagctcctggattcattgatttttttgaagggttttttgtgtctctatttccttcagttctgctctgatcttagttatttctagccttctgctagcctttgaatgtgtttgctcttccttctctagttcttttaattgtgatgttagggtgtcaattttagatctttctagctttctcctgtgggcagttagtgctataaatttccctctacacaatgctttaaatgtgtcccagagattctgatatgttgtgtctttgttctcattggtttcaaagaacatctttatttctgccttgatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataagtgcgatgtggtgctgagaagaatgtatattctgttgatttggggtggagcgttctgtagatgtctattaggtctgcttggtgcagagctgagttcaattcctggatatccttgttaactttctgtctcgttgatctgtgtaatgttgacagtggggttttaaaatctcccattattattgtacgggagtctaagtctctttttaggtctctcaggacgtgctttatgaatctgggtgctcctgtattgggtgcatatatatttaggatagttagctcttcttgctgaattgatccctttaccattacgtaatgcccttctttgtctcttttgatctttgttggtttaaagtctgttttatcagagactaggattgcaacccctgctttttttgttttccatttgcttggtagatcttcctccatccctttattttgagcctatgtgtgtctctgcacatgagatgggtctcctgaatacagcacactgatgggtcttgaatttgatcctgtttttatgatgttagctggttattttgctcattcgttgttgcagtttcttcctagtattggtcttatttggcatgtttttgcagtggctggtaccagttgttcctttccacgtttagtgtaaggcaggcctggtggtgacaaaatctctcagcttttgtttgtctgtaaaggattttatttctccatcacttatgaagcctagtttggctggatatgaaattctgggttgaaaattcttttcttgaagaatgttgaatattggcccccactctcttctggcttgtagagtttctgccgagagatctgctgttagtctcatgggcttccctttgtgggtaacccgacctttctctctagctgcccttaacattttttccttcatttcaactttggtgaatctgacaattatgtgtcttggagttgctcttctcaaggagtatctttgtggcattctctgtatttcctgaatctgaatgttggcctgccttgctaggttggggaagttctcctggatgatatcctgaagagtggtttccaacttggttccattctccctgtcactttcaggtatatcagtcagacgtagatttggtcttttcacgtagtcccatatttcttgtagacttttgttcgtttctttttactcttttttctctaaacttctcttctaacttcatttcattcatttgatattcaatcactgatatcctttcttccatttgatcaaatctactgaagcttgtgcatgcatcacgtagttctcatgccatggttttcagctccatcaggtcatttaaggacttctctacactgtttattctagttagccattcgtctactctttttgcaagggtttagcttctttgcaatgggttcgaacatcctcctttagcttggtgaagttcgttattactgatcgtctgaagccttcttctctcgaatcgtcaaagtcattctctgtccagctttgttccgttgctggcgaggagctgcgttcctttggaggagaagagaccctctgatttttagaattctcagcttttctgctctggtttctccccatctttgtggttttatctacctttggtctttgatgatggtgacgtatggatggggttttggtgtggatgtcctttctgtttgttagttttccttctaacagtcaggaccctcagctgcaggtctgttggagtttgctggaggtccactccagaccctgtttgcctgggtatcaccagctgaggctgcagaacagcagatgttgctgcctaatccttcctctggaagcttagtctcagaggggcaccgggccttatgaggtgtcaatcgcccccctactgggaggtgcctcccagttaggctactcgggactcagggacccacttgaggaggcagtcggtccgttctcagatctcacactccatgctgggagaactactgctctcttcaaagctgtcagacagggacgtttaagtctgcagaagtttctgctgccttttgttcagctatgccctgcccctagaggtggagtctacagaggcaggcaggcctccttgagctgccgtgggctccacccagttcgagctttctggctgctttgcttacctactcaagccgcagcaatggctcaagccccttccccagcctcgctgccgccttgcagttccatctcaggctcttgtgctagcagtgagcgaggctccgtgggcatgggaccctccgagctaggtgcaggtcataatctcctggtgtgccgtctgctaaggccattggaaaagcgcagtattagggtgagagtgtcccgattttccaggtgccgtctgtcacagcttccctttgctaggaaagggaattcctggacctcttgcgcttccagggtgaggcaatgccccgccgtgctaggtgggctgcaccgacttgtttggcaagccctagtgagatgaatccggtacctcagttggaaatgcagaaatcacctgtcttctgcgtcagtctctctgggagctgcagactggagctgttcctattcggccatcttggcgccaccaagccgctgttttatttttattttcatttaaagataatttctaatttaattattatttctttgttctttgtgatttatggattatttagaagtgtgcttttaagttacaaatatttagagttttcctagttattgttactgatttttaaattttacctaccttggtcaagtatcattttgtgtgatttcagtctttctaaatttattaagacttgtcatatgacccagaatattgtctgtcctggcaaacgtagcatatacacttgaaaagaatatgtattttgctatttttgggtgtaatataaatataaattaagataatgttcatatattctttgtctttattgatttcttttgtctgtgtaattatattgtttgcagagagaggggtgttaaatctccagttatgattgtggaattgtttataatctaattccttaaatttttgtatcatgtaaacatttgtgattgttatgtcttccttattgacctttactcttgaaatctatcttatctgatattactgtaaccactccactgtcttcttatgcttactatttatgtagtatatctttctccatccatttacttcctgcctgcctgtgtctttatatttaaagtgtgtcttttgtaggtggtaaatagttgttcccttttaaaaaatccattctgaccatctctttttactggaatgtttagttcatttgctaggtggaggacaccaacttaattccatttaaattatttccttagaatgggagtttcatatctcattttcatatcacactggtagtctgtatgtagtccacaaaccatgtgaggtctgacttaaaggttttttcctcctcttcagttagcactgaggtcaagtcagacaggtttctgtcttgtctttctgtttagggcagattttttttacccagtttgtattttcatttggggtgtaactctttgcatcagcttttttggacttctcacattgggcctgtcctaggctttttcctttggccattagaggagaagctcaaactctagttgtttctgtgcctgtaactctaaatttcagccttcatattatttttggacattgaggatcattttactcttctaccagctcagtagtacatttggtacctttgtgcaaattagaaaaatgttccatttcatccaggccattgcaacaacatgctagagtaaatagattggtgggcagaatataggctggatttcagtcctaacttgtcctttcagttgagtatctttacaggtgaccctgtaagcttgtgttgtagtgctgtttttgttttgactgatgacacatgacaatcttttgtcatttcagatttgtgttctgtgtgcagacattaatttggattatgttattttataatttggattgtgtttagccagctatctataaaattacatttaaaaaatatatagcacagacaattagtgtttggttcttcaaaagtaaagagttagtaataacttaagtgtggtcaactagatcctctgaaaggccttttagctgcaaaataatcagatcctgggcttacagtaagtacatgaaatttcttaggtttttatttttcttcccactcctctgctctctgattctgtgtctctcctttctctgacctcctccctcccagcctctcccatcatccagatcaaaaagtgaactttaatcggggtgggacgggtcaaacagcaaacaagggcaaaaagcagggttgctctcaaagacagataataaatatcaatgatgaaattcgtgacaaagccttaggccggtagcaagataggtgtaccaacctgagactcttgtattaagttgaaccctcaaaagggtataaaatgtttttaaattggtagataccctggcttccagcagaagggaatgaaaacctcttccaaaggatcaaccataatttagggccttggaaatcctgcagattaagttaaacaagtgttcatagtaaacaaaaacaataaaagccagcacataaacaatgaagtaagctgccatgaatgagcactaacaaaaataagttatctatttgatttagaacccctatctcctaaagactcttaagatgttggaattggataggaatataaagcaattatgtgcgaaatagttaaagaaataaaaaatagaatcacaaatgagcacataacaggagtgtgaaaaacaaccaggaggatatgaaaaggacctgaaaaaactttttttattgaaaactttgtgatctaaaatttcatggatgtgttaaacagtaaattggacccaactgaggaaagagttggctaactggcagttagaactgaagaaattttcaagactgcaggaaaaaaggaaaatgaaaatattaaaagagacgttaaaggatggaatgaggtcaggtatgtcaaaatgagtcccagaaagatagaatagaggaaggaggagaggtgataactgaagaaattctgagaatttttttgacttaatagaagacatgagttcatcaatacagcaagcccaacatatacccatcagaaacagaaaaacaaaactttagtcaaactatataaccccaaagacaaaatgttaaaagcagctggagaagaaagatcacttagaaagtagtgtaaactggactgataactcaacttctcaacagtaaaaatggaagccagaaggtgttattattctcaaataactgagcaaaaataactgccaggctgttattgtatatcagcaaaaatatctttcgagaaaaacgatatacaatagagatttcagacaagtgaaagcagaaagttttctactagccgatctttcattaaaggtttttattaaacattttaaaggttattttcgaggaagaaggggcatggtcccagaaggaagaaaaggagtacatggaaattggtaaactcaaaaattttattttatttatttatttatttatttatttatttatttatttatttaagatgcagtcttgccctgtcaaccaggctggagtgcagtggcatgatctcagttcattgcaacctctgcctcccaaattcaagccattctcctgcctcagcctccagagtagctgggactacagtcatgcaccatgccgggctaaattttttgtattgttttagtagagacggagtttcgccatgttgtccaggttggtctcgaacttctgatctcaagtgatctgcccacctcggcctcccaaaatgctaggattacaggcatgagccaccgcacctggctgtaaacacattcattttaacattcatagtctgtacaaaataaggattatgtgtaatttgtggaattaagaacagaataaaaacatgaaaagacagaagcatgtcagagagagagtcgggggagtgatgagaattaaaattattttaagtccttgtcttatttaggaagggaattaaaatggcagcacttcaagggtaacaactaaaagagtagaaactgtatgattgtctcccataacccagcaaagagaaaataatgaaatagaaaaataagcaaattcaatttttttaaaagccaagaaaggaaaataaccagagacaataggacaatagacaataaaaaaatggtaggagtgttccagatatgttattaatccaataaacataaatgagttaaatttacagttaaaccagattataaatttgaatattttaaaaatagccaattaattataagttacatactcaaaacattaaaacatggaaagttgaaagtaaaaggattttttaaaatgtgctatgcaaatatgaacgtataggaggctagggtcattgttaatatcaaacaaaaatgacttgaagagaaaaagcattattaaaactagagctaatagtttgtgtaccaggaaggtacaggttgagcacaccaaattcaaaaatctggaatctgaaatgctccaaaatttaaaactttttgagcactgacatgatgctcagaggaaatgctcattcaagcattaagaatttcagatttttggaattgtcattgtcacccaggcacgcaaatattccaaaatctgaaaaaattcagaactgagagcacttctggtcccaagtatttcagatcaggggtactcaacctgtataacaattttagatatctagtacttagtgaagtagtatcaaaacatatcaagcaaaaattgatagtcgtgcagggagaaatggacagacttgccatcataatggaaggctgcagtacacttcttaattgttggcatatcaaataagtagcaagttagtaaatttaggagggatttgaacaatgtgattaacagactttaatgaattgatgtatataaaacactggaaccaacagtttgaaaataccagttttctccagggcacatggcgtgttttaaaaaaaattgtccaagcattagcatatgaagtgagtctcagcaaatgtcaatgactcagtgtcatagagaccacttttttttttttgcagtgtagttttaattgctgattggttaaaaaaaaactaaattgcaaaacaaaacaaaaaccccacaaaaccccatacacttgggaatttaaaacatatacttgtaaatatgaggtaaaagaaatcttgaggaaaattttaaaatagagttaacacataatacagaaatacaacatttttggaatatagtgaaagacttaattcaaaggagatttattgaccaaaaagcttatttagaaaagaaaaaaggccagaatgttgggacctaagaatctaacttgagaagttagaatgagaggaacagattaaaccctgagaatggagaaagaaggaaacgaagcagaaattaatgaactaaaaaataaagatacagtagaattaaaaaatcagaagttagatctttaaaaagacaagagtaacaaacctcttgtgattaggaagaaagaattcacaaatatatactattaggaacaaatagaggaaatttaataatggatacagcaaagatttaaaaggtaaaatcattcttgctatttccggaggtcaataaatgaggaaatgaataaatttctagaaaaaatactaaaattgacttaaaaaagagacaagaatttagaagatgtttgcaacacacactaagcaagaatcaccatctacaagaatatgggaagaattcttacaaatcagtaaaataaacagttctttaggaaaatgatcaatagcaaataggcatctggcagaaaaacataaatggtgcatatacaaaaaacccaacttcattaccaataaaagaagtagaccacatgaaatatattttcctgtctactgggaataaatcataagaaatcttacagaaaaatgtgagtcaaaaggaattcttatatacttctggtgggagtataaagtggaatcagttggaaatggaatagaaatgaatttggtgtagtcttgtaaagcagaacatttgaatacccattgacctgacccttgcaccgtcacatgtgtcctctagaacaggggtccccaaaccccaggccatgaagcggtactggttcatggcttgccaggaactgggttgcacagcaggaggcgagcggcaggtgaacaagcattactgcctgagctccacctcctgtcagatcagcagcggcattagattctctcataggagcgtgaaccctattgtgaagtgcacatgcgagggatctaagttgcacactccttttgagaatctaatgtgtataatgcctgatgacccgaggtggaacagtttcatcccaaaaccatcacctccccttcctccccagtccgtggaaaaattgtattccatgcaacctgtgcctggcaccaaaaaggtaggggactgctgctctagaaaatctgtacacaaaatgtacaataatattcatagcattattgtttataatgtcaaaaagtggaaacagctcagatgctcatcaatatgaagatgaataaatagatcataatgtaattatacaatattatataaaaaaatgaatgaactatacctagtgagtgtcagagataagatgtttaatgaaaagcaactctcaggaagctacatacagcatgaaacgtaataaagtctccaaacaaatgagacttgaagtgtcttgtttaggaatatatgtatatgtgaggaaactttaaaaaatcaaaagaacaataagcattaaatattgactcatgcttacttctagggtggaaggtaaggggacaagctcgggaatggtatggaggtagatgtgacagtattgctaatgcattgattgttctactgggtaggtgtttgttttgctacacttcatatgcattacatatatgttttcatatatatcaattattacattaaaatgtaaacagattcagttggaaaagacctattttccttcaaaaggatattgaatgaagatatgaatgttttaaaatacatgaatcagttagttgaaatgtaataatttagtggtattacataggactatctcttgaataaaatgccagacctcattctttgttaatataaaccgaaggagtttttatagttggatacactatgcagttttagtaaaataacatttcagagtctgtaatataatgcctagtacttagaaaatttttaatagtattagtcaaaaggtcagtgggaaagaatctgtctgcccttttagagatatctgtggtctgctcaaaatgatcattttatattatgaaaaatgcctaacatggccctagtttgtatacactgtgtgtagtagtattagtttttttgcgtgtgtgaacacttcagttagtgttgaacaaagaaaattatatgctcttgttatatgtgctttaatttagatgcttaatggcttttaatgttacaaaataagtttattattatattatgatctcatttgtattatattgtctcgctcttctgtatttgtggtgatatggtcatggtttacgaaaacaataatccgtaagaaataggtcattaacagtagttaacgtttacttgtgatctatggtaatgactgatttctttgggattactgcagttataaaccataattacagattattacagcaataattattttgttaaggaaaaaatgttctatgtttgaacagctgctaaaacaagcaccctgaacatttcaggataaatagaaaaatggaaaattataatggaaatttagtattattataaaatgagatttaaaaaaaattatagatatgaaacttatgtagcagatttttttctctaaatgcaatttagatacgtgtatttacatggttctttaaattttgtgaatgtaattatgttaccaaaataacattttttgtatatatttaaggtgtacggcatgatgttttgataaatacgtagcgaaatgactactacagtcagccaaattatcctatcaccttccatagttaccatttttaaaatttttgtggtaagagcacttaaaatctaatcttttagcaaataaagtattactaactatagtcctcatgctgtacattagtagacttactcctcctgtacaactgcaagtttgtaccatttgacctaatttctaatttcctccctttccttacctctagtaaccaccattttacactctgttcctatgtattctacctttttttaaggttctgcatatgagtgagaccgtatagtatttttctttctgttagtagctaatttccgaaagtagcttcttaacatttactgttttgaacactgtgagtctaaaattgttcagggttaggaaatagtttaacgtttatgagaaatactgtttctctttcatctaaatatcaaaattgtatttgacagcttaataagaacgtctttttttgagacagggtctcactgtcacctaggctagagtgcagtggtgcgatctcggctcactgcaacctttgcctcccaggttcaagctattctcccacctcagcctcctgagttgctgagattacaggcgcatgccaccatgcccagctaattttcatattttttggtagagacagggttttgccatgttggccaggctggtctcgagcccatgacctgaagtgatgtgcctgcctcagcctcccaaagtgctgggattacaggcgtgagccactgcaaccagccccaataataatgtctttatatttcactgttcatctctaacattaattctaactcattcagtacttgctcgatttttaaggtttaagaaatatcttcttttcatttctcatacaatagaaaccattgctttctaaaacagagtaaatatgtactctatttttctctaagtaaacttcctttcaaaatttactgtaattttagaagaaaatgctcataattaatcacatgctatctttgcacagcattctttgatctaataagtttaattccaaggtcacagaaattagtacaaatttaaattttgagaaattcacattttatatttagatactttactcattctgtttttaaacaatggtgctcatcatactgcattgcaaaaattattgattttttcctctatcttatctgtctctcactaggctcagttccctgagcatggagtctctctctcccctgccccagcctttcccatacatttgtgtatttagttatatccctagcacagaacatgatacaaagtagatacttacagcagatgtttttctggaatgtcttttacttggaatttttttttttcctggttggagggtgtttgttttactaacagcattagaaagtgtatatggctagtcgtaactagctttaattgtaataagcctctttggtagagaggaaagaacttaaaaattcttattgtgtgacttcattttcttgagcagcatctgacgtaaggcacagaaagaacatggatgttacatattggtatgtcttatgtttttttgtaggtatgatacagaaccacgttaaaaaggggatgacaatttaataatagttacactagccaacatttactgagcacttatagcacttactcatatactttacatgcaaaataccagttggtgcttgtcacaactctatgggccaggtattattatccttgtaagattaagtagcctagtgtaaataagtactagaggcaggatttgaacctaggctgtgttcttattagctaaattgtactgcttccctttttttaaaacaaatatttatcttccagtagagaaatataaaaaattacatgcacggtgaggtctttgtctgttttcaggtaggcatgttttatcaagggctaataggcaggtatttctatgtttacattattggtaagcccaaaaaattaagcttgcttattttaaattcagctatatcaacaagtattcattttatgtgtcttgtttttggaatcaaaaaaagtgtgaaatgtctccttggtaatgatccccaaagcatatgcagtctcatctgtgataaagactcaggagacagctaaagaacagttcagggttaggactcataatgtgttaaacgcttaagagattgttggattataagatactgttggatcttgaaggtctgtctagctaattgacaactgtattgctggagcattcccttttaccaatcttgagaggaagtataatagtttgagaatgaacttttggaaattcattgcctagatttcagtcacagctctgcacttttaaatagggacttgtaatattaaatgaatatagatacagtacttagaacagtgcctagtgcagagtaactactatataaatgtttgctattatttttaatagtaataaaggcttgttttaagaaaccagtatctaaaaatctaaattgataaaacataacaggaaggtaattatttacatttaagtgtttttcattttgagaaataatttacaataggagattttaaaaagaatgactcctacagagagtcattacatatgcattcaccaaaagtcatgcttgcaatgttttagattcacatccattacatgaagtgtataacatatcctacacacaattggagcatagtctgttaatagcgacctctgtaaaattctaagaaatactactaattgtcattgtttggtagttatgttatataaagtcgctgtgaacaataaattagcaaataccgaaccattgctcctgtgggcctctgaccacaacattttcatcagctaaccaacacatgacctttttttaagtatgtttctgtagaaagacaccttattcagtatatattgtcgatttattgatactgaactcatagccagcagcactatttttcatgctggaacaaagcttatctaacatgtgttttctatataagacacataacaagctttttttctttaggaacactgcatagcatttcagcattatgcttagatcatcttaaacagtgaaatcactaacaaaaaacacaaaaatgtggcagtagatagaccattaaaaacatacttgtttacattatgaagctgaaacaagaaggtagagtttcactttgtttgctctgagcttgaaacatgtgtactggacaactacagattttcactgctttgcacattagcaggtgactgtgagtattgattttgggattataaataaattttatcaagtaggcaaattcacaaataatggaatctgtgaataatgaggatcaactatatcatatcttatattgagtattattggagaagttgctttaatttaagcaatagaaatataattactattaccattcattattaataatgggtctacattttaatacatttattaaattggtaatgttaacctttcctttcctttttcatgccatgttttctatataatgatttcttaattcagtaacccatatctgttgataatgtataatatacccagcgttgttttaggctctggagatacaatagagaacaaaacagacaaaaatacctgttttcatgcagtttacattctgttggaatacacaggtaacataaaagataagtatgtaaaatatgttagaaaatgttaagtgctaagatttaaaataatgaagcaaggaaagaagataggaaatgctgggggggattgtattatctattaccagaacttaatggcttatcaggtaacaattgcattattatctctcagtgttctgggggttgataagtctcagatggttctcttcaggggtctttcagtcattgtaatcagatgacagctggggctggagttgcctgaatgcttctttactcacctgtctggtgtgtgtgctggaatgcttagagtgtatactctatctagttgggcatttctctctctgttcaatctctccagatggctagttcgggcctcctaatagtataatggtctcagggtatatggtcttcttaaatggtggcaggcttccccagagtgaacattctctgagagactggaggaatttgccagttcttgtaaaggttaggcacagtactaggatggcgtcactttcaccaaattctattggtcaaagcagttacaaatttccaaagattggaagaataaactccacctcttgatggcatatacatacatggaaggaattggtgatgagtatttgaagacagactaccatgctaagtattgaaaattgataggatatcttggtaaggtctgagaaggtgacatcaagtaagactggtcagcatagttgtatctttccccagttatattaaactgtgtgagtactggcaaagagtagtggtgtatcggacataaacagtcatggttttgtaagatgagtatatcatagcaaaagaggagctaaatgtaagtgcaaggcagagatgataatgattgaccatataattaaagctaagtacctaggatagataatatgtgaagggtataagagagagtgaaaaaatggcagattcccaaaaactaataaaagagatcagcaaacttgcaggatacgggatcaataaataaaatcaatggtatgtctattttttaacaatcagcaattgaatatgaaaggaagaaaggaagtccatttatagtattatcaaaaaggataaaatacttaggcataaattttaaaaagaagtgtaagaattatataccgacactgtaacagtgttgaaagaaattaaagatataaataaacagaaagacttctcatcgtcgtggatcagaagacttaatattgttaagatggcagtactcttcagattgatctccaaatccggtgcaatccactttaaaatcccatgggttttttgcagggattgacaaactgttcctaaagttcatatggaaatccatgggacccaaaatagccaagataatcttgtaaaataatgaaattggaagactcatatttttttttatttcagaatttactagaaaacaacagtaatcaagactgtttggtaccagcatacaggtagacagacatataggacctgggtgcggtggctcatgcctgtaatcccagcagtttgggaggccaaggtaggaggatcacttgagcccaggatgttcaggaacagcctggtcaacctagtgagacacctcatctctacaaaatattttaaaattaggtagctatgttgatgtgggcctgtgatcccagctgttcgggaggatcacttttgcctgggatttagaggctgcagtgagctatgattttgtcactgccctccagcctgggtgaccgagtaaatcttaagtgactttgggttgggcagctatttcttagatatgacacctgaagcagacaacagaaaacaaattagatagaccagagtttatctaattaattagacaaattagataaaacagagttgcaaattttgtgcatcaaagcatgccatcaagaaagtacagcccacagaatgggagaaaatatttgcatatcatatgactgataagagattagcatctagaatacataaataattattacaacccagtaatgaaaaagacaacccttaaaaatgggcaatggatttgaatagacatttctccaaagaagacacacaaatgaccactaaacatatgaaaggatgctcaacatccttagttattaaggaaaggcgtatcaaaattataatgaaatacctcctcacaccaactaggatggatataataaaaaagaaaactacaagtgttggcaaagatttggataaatttgatcttcatacattgctggtgggaatgtagaatggtgcagccgcttttgcaaacattatggcagttcctcaaaatgtgaaaagtagaggtgccatgtaactcagcaattccacttctaagtatactcaagagaaatgaaaacatacatccacataaaatcttgtacacaaatgttcatagcagcattatttataatagtcaaaagatggaaacaatccaagcttccatcaactgaatgggtaaatgaaatgtgatatatccatagtaaccaaaacagcatggtattggtataaaaacagacacatagaccaatggaacagaatagaaaacccataagtcgtatgtttacagccaattggtttttgacaaaggtgtcaagaacatacattggggaaaggataccctctttaataaaatggtgctgggaaaattgtatatccagatgtggaagaataaaactggacttctacctcttaccgtatacaaaaatgaaatctagatggattagacttaagacctgaaactataaaactactagaagaaaacatggggagacacttcaggacattaatctatgcaaatattttatggctaagacctcaaaagcacaggcaacaaacataaaaatagacaaatgggattatattaagctaaaaagccccttcacagcaaaggaaacagtcaacagagtgaagagagcctgttgaatgggagaaaatatttgcaaactgaccagggaggaatagaatatgcaaggatcacaaataacagtaaaaaaaacaaaaacaaaaaaaaaataactcaaataagtggcagtcaaatgacatgaatagacatttctcaaaaggagaacatacaaatggccaataggtatatgaagaaatacttaacatcactaatcatcagggaaatgcaaatcaaaaccgcagtgagatgccatcttaccccagtcagaatgattattattaaacagaaaaaataacagaagctggcaaagatgtggataaaagggaactcttacacactggtggtgggaatgtaaattaaaacagccattatggaaaatagggagatttctcaaaaatgaaaaatagaactaccgtattgtccagcaatcccaatactgggcatttatccaaagggaaagagttcagtatgttaaaagaatacctgtacttccatgtttattgcagcactgttcacaatagcaaagatatggaatcaacctacattcccgttgatggatggataaaataatgtggtatatatacatagtagaataccgttaggccataagaaagaatgaaatcgtgtcatttgcagcaacataggtggaactggaggttaagtgaaataagcctggcacggaaagacaaataccatgtgttcttatacatatgtgggacctaaaaaattcatttcattgaggtaaagaacagaatgataggagaagctgagaatggtgtgtgggtggactggggagtggggcaggatgaagagaggttggctaatgagtacaaacatacagttagataaaaggtataaattctaatgtttgatagagtagggtaactataactatagttaacagtgtattccatatttcaaaatagaaggcaggatttgaattattctcaacacagaaatggtgaatactcgaggcaatagatatgccaaataccctgacatgatcattaaacattctttgcatgtaacaaagtatcacatgtaccccacaagtatgaacaaatatggtgtatcaataaaaataaataagatctatacaaacaatggaatgttattcagctataaagaaaaataagtattgatatgtgctaaaacatgggtggtccttgaaaacattatgctgacttgaaaggagatagtcacaacactcacttattgtatgattccatttatatgaattgcccagaatgggaaaatctaatgagacataaagtagcttagtggttgtttagaagctaggggcatgggggtaggatgcagaatgacagctagtatgaaaatgttctaaaattagattgtggtgatgcttgcataaccctgttaatttactaaaaaacattgaattatatcctttaagtgggttacttgtatggtatgtgaattatatttcagtgaagctgttcaaaaagtgataggctcatggattgaagattcccagtaaaacaaaggattatggagttgtgagattcatctttgtagatattgaaatcactagtgattatgatataaatattgttggaaagactgacagccaagaaccaatactttcaaaaaacagggggaaataatctgcaggagagtagataattgcaataagaagggatatttgttagtgttgttgatgatgtaagatgtaaaggtgaatgctttcatgatgaagaaagagaaaatattaagtagaaatgaggaacgtgaagatcacctactccatattcaaggcccaagatacacgagaagtggaagaaaaagcagctaccacttgatagagcctacagagaaagcagggtcatcagagtagagcttctatgatagacttttatattgaccctaaaacactgaaattcataaggtaactttctggatactttcagcttcctacatgaagtttttgatctgttacgtttttcatgaattgtatgtcatgaaacttgagtctgtttttcagtggattacttgatcaaattagtgttcttattctcctacttaatctatttcacattcctaatgtataaggctgtataattggtcagttctggtttatttttgttttgtgagagaataaaggatgtgaatacttgccaggttagatttctaatttacaggaatcttgtcaccctaataggttgatatgtctcaccaaaaattataaaagagttgttgattaattgtagtataataatgactgctagtatccatgggagaacagaaagaatttgttctttttctaacttttatttgtcctttctgagtcttctaacaagcagatagcctcttttcttcattattcagttccataccttttaaaaaaacatttttacttgaaagcgtttcttaatcagaaacaattgatttcagtattatgaaatagccctctcatctttgaaaaatcagtctccaagaatagcataaaatttgtttttagcaagataattttatgttgttaattatttgtaaaggtctcaaaagtactgaaggatcacctagatcaatgaatccagagatgtaaaataatataccttaagcaaaaatcattgaataaatacctccatttctaaattagtcaatttcagctgcccccaaagtaagatttatgaaaactgtagatgttgccatttgtgccactgccttaaatctatttaatcctctactactatcagctgtgaagttaactctaccatcaaacaatgtgaaatcttggattttttaatacatcatgcataaaaatacagaaggaacaaatttattactatctattatgttccaagcaggggaaatatttaaaatgatcacactggtactaacatgacattgaccattcagaaaagatgctggtccttggatcatgagagtacatcctgactgaataacagatctggtcctagacagtttagtgttttgtactcaaatttattttcagtcatgtcttcatggtagacattgttttttccattttacaaatgaaaaccctaagacttaaagagataagtaacttatgcaagatcacatagcaaattagtagagctgggattcaaattagttttatttggctctaaattctatgccattttcagtgttctactgccttgataaacttaaaaccgatctgctttctatccagaactgagttcacaataatttatcactcatttggaagaacagatcattgtgctgattttggaatttcccccaagataagctacgtttctatgaatacttactaaacttttttcttccttattctatattaggacgtcttgcatggctggtatacttagttgggacagttgtaggaggaagattaacatataccagtacagatgagcatgatgctatggatggagaattatcctgtcggtaagtaagagctatgtaatttactgaaattcactaaatagttaaaaaaaattagttattgaactagtattatgagtgaagacattttgtatgtggccttttgaggaaggtattatttccctttttattggtgagaaaaccaaggctcaaaggttaaatgatttgtagaagtcaaatctctaataagtgatagactcaaaatattttgtacatgtttgtgcaaataatgtgataaagatttaggttgctttttattacttaggatgtgagcaagcacatacagttggtgtgtattggaaaggtggcaaaattgggtgacatacatccaatcagaaagtattaggtagtcagttacccatcgcaggttttgtcacctattggccacagtcttaggaaaaagcagttgaattattctcttcaagtttctattctaacctgaggaaaatttctatatatgaataatacaagtgaattgattttccatatattttaatttatttttaataacaaatctccttataacagcgtcatacatgtttttattgaagacttaaacattcaaatgaaaataaaaattatatactaatttggagataaccactactgttattttgtaaagtccgtttgagtctttttaattaacgtgtatgggtgtatgtttactgcatgtgtgtttttcaacttttcttaaacattacaaaacaatgtaagatggagctaataataatacctaacttattttgggctattataaggaatttatttttttaaatgcttagaacagtgcctggcaattagtggtatattttacacacacacacacacacacacacacacacaccccaaccccacccacccacctcaacaccactttttaaaatcaaatgcaatatcaacattttacctggacattaaattttctaaatttagaaaattccttgtttttggaattttaggttgttcctcaattttttttattataaattacttttagatatactaaattgtttttagttatatctttatgtagactgaaataatttcattagagttcgttcctaaatgcagaatagctggtcaaaagttatgtagcattttaaagactttcaatactcaataccacacggtgttctgaaaaaggaccaatgtatcctctgaaccaagggtccccaacccctgtactggtccacagcctgttaggaactgggctgcatagcaggaggtgagctgcaggtgagcaaggattactgcctgagctccgcctcctgtcagatcagcagggacatagattctcataggagggtgaaccctaaactacacatgtgagggatctaggttgcatgctccttacgggaatctaatgcctggtgatctgaggtggaacagtttcatcctgagaccgtcaccccacaccaccccaaaccccatccatggaaacattgtcttccaggaaactggtccctggtgccaaaaaggttggggaccactgtgctgaacccaaattgtatgatagttaacatttgttagtggttgaactgccagatagtagggttcatattgttgccagtttataggtaacaaatgtattatttcaattggtatttatttggttactagtagaatcaaacattcttttccactcctagctttgccattttttctttgtgatttttatatctatattgattatattatttacctgcttttcttttgtgatgatctcttctaacttatttgaaagagctcagtatatatatatatctatatatatatatatatatgctcagtgtgtatatatatatatgtatatatatgctcagtctgtgtatatatatatatgctcagtctgtgtatatatatatatgctcagtctgtgtgtatatatatatatatatatatatatatgctcagtgtatatatatatatatatatatatatgctcagtgtatatatatatatatatatatatatatatatatatatatatacactgaatgaactctgtagaggaacgaactctaatgaaattatttcaatctacataaagatataattaaaaataatttagttatatctaaaagtaatttataataacaaaaattgaggaacaacctaaaattcctgtatatatatatatatatatctcagagatcttaatattttgctcctcattttgaaaatgttttctctgtatttttacttcagaaatttcttctttactggctttaaatattatgtattcagatctatggactttttccttcatatttctctgctgcttatatttagaaagattttttttccacttctgattaatgaaaatatccacctgtattttctcccagctgtctttggtattaatagctttttatatttatttttaatatatcttgatatttggtttcatatgttttttccaaattttccaattaatgccaatcctaccctctactgatttgaagtggcacttatatcttacacaaaattatttcatcttttttcaggcctttcatacttttccattgatcttagaagtatattgttatatatttttaccctattaaagaccttaaaattgttatacctacttgtgatattctccttcatttttattattaaatatatttctaagtgcttaatgaatttattgtacttttggataaaaaatttcattttgttccatttccttttcaacctttaaactatttcttcaataaaatgtgaatcttcatggaccatgaatatttttagtttttctaagacttattattttctatatcaaattgaattacttgaaaatatgaataacaggtgtttggggcctccttaaagtgctttagttacttttcaaccaaacaaaaaatttgctactcaatctctcgagtagctgggattataggcatatgccaccacgcctggctaattttgtatttttagcagagatggggtttctccatgttggtcaggctggtctcgaactcttgacctcgggtgatctgcctgccttggcctcccaaagtgctgggattacaggcgtgagcaactgtgcccagctgttgtccctttagtttgctcctcatgcttggctttttgtcactgggctctgggtttgcctgtcgttcgtcctcgaatattagggaaggtccatttgtgatgggacttggtcattctttattccagctgcttcttttatcttcctcttgatagattctagatttctagaggactggggatatataggtcttgtactttgttgtattctgaatgcctgacacatatctgacgtatagtgggccctcaaatttgttgactgaatcaatgcttatttagttggatacctaggaaaattcagcacagttatccaaaattcatttcatnnnnnnnnnnnnnnnnnnnnnnnnnnnnnnnnnnnnnnnnnnnnnnnnnnnnnnnnnnnnnnaaacaaatattagttttttatttaagcagcaaacgtattgaacatgttgaactaagatttgtgttttggcctgcattccctggaaaacagagccttgggtgaagttcatgggccaatatttttctggaggttagggagaagagtacatttttagagaagaaagaataagaggaaagggaaagtaagtgagacaataagagaaaacaaatacagtcaatctttattattcctggattccattttttgtgaatttgcctacttcataaaatgtgtttctaatcccaaaatcagtactcatggtgcttttgtggtcatttgcagacatgtgcttagggatgaaaaaatttgagttttgtgttgcactttcccaactgaggttgaacaaggtgatactctgccttgtttcagctcttgtactgcaaataattgccctttttatattctgtttagagccacatttttcatactgttgtgctttttgttggtgctttcagtgtttaaaatcgcccagctgtattgttaaagtgctatttagtgttcttaaatacaagaaggctgtcatgtgccatacatgggttagattagctttgtttgggtaccagtgggagtactgtgaatactgcagtagtctgtgagttcagtgttaacaagtcaacaatatatttgaaaaagcctctctaaacagaaatacacatgaaacaagattgcaatccattgaccaaaatgttgtcaccagaggcttgcaggaacctaatcctgtattttacctaggagcaatggttcattattcactaattcagtgttcacagtgactacagaatataactaccatgaataatgagaaccaactacgtaaggtggtgtattactgagaaaatacaactggttgcttgcttttataggaatttttccctggaggccacacgaaaccacttgtgcctcagaacaactcatgactgggggagtaaggacaagcagtatatccattggcttctttctgtgtctcgtttcttactggttaatgtctactcctgggatatttcacttttccacacttcttagttatgtttcctggcctctttgaggagctgctgggaagacagagctttaattggtcctgttagagttatgaacaggaatggtggtttgtctctcttttctgggaagatacataactgcagaaactgtgagagtcttttctggggctacaagacaagtggctgaagccaggggtgaggtgagaggtgatagtgtggttggtgggtgtgcaagcagggccaagcaaattcaaggtggggcatattctaggacttacacaacagtctggaaataaatatgtattttagaatattgagattctaaactaagaatgatgtcttacgtaaaattacaaaaaaaatcactttcatatgaagatgttccaaataattggaactacagtactgtgactttctatatgttatatataatagcattccaactcctcagagaacactaccaaattagaagatcatgaagctcctgccaaaacttcatgtgctattttggcatgaaaagttgaagagtcataaaagctcctaacattgtgatgatttataattatgactgaaacatgctactttaaacatagcaaataaatatatttacactcaggccacataattctaattaaataaagacatttatagtcattttagtttcattcatcatgactaaaatgaaaacctcttgagagattctccagggattttgtcttattcatcatgcatcctgttaactcatttatgtatgcagttgcaatttttaaaatttttgctatcagaccttggcgatgaccttgagcagtaggatataaataactcccacatgcttagcgttccaataatggaacactaggcataaatgtaatccactagtgctagtagattgagtgctagcttctttcagacctattctacttagctgtgccaccctgtgtctctcattgctctcacctacccatctcccagtcatccctcattatcaagactttaataactagctcagagttttcctctctctcccaaaccctgctattatataaataacttcagctgctttctgatcagataatatttctcccattttcttacccataagcctccagtggcttcctatcacacttgagacaaatttcaaggcccttgtgatggcccagagtatcctgtgctacttctgacctcatttcctaccctttcccatttaacactggcctccttgctgtcctttgagtattaccagtgtgttttcactttagggcctttgcacttctctttcttctgctaagaatactttcttccagatgtttgtatagtacatttggcccttgaacaatgtgggagttaggggcaccaaccttccacacagttgaaaatctgcctgtaactttagactccccccaaatttaactactaatagcccactgctgactgtaaaccttattgataacataaacagtcaattaaaacatattttgtatgttatatgtattctatgctgtattctaacaaaggaagctagagaaaagaaaatgttactaagaaaaccataaggaagaaaaagtaaattttctgttcattaagtggatcttcataaaggtctttatcctcttcatcttaaacattgggtaggcttaaaagctgagaaggcgaagttggtcttactctctcagggatggcagaggcgcaagaaaatttgcatataagtggacctgcacagttcaaacctgtcttgttcaagggcaaactattcttcctcacttcagtcaggtctgtactcagatgtctttttcaaagagggctcctctgacctccctatccaaaatagcatccttaccccactttatttttcttgatagtacttattacctcttgatgttgtttgttctactagagtacgggaaggagtaagctttgttttgcttactgctgtattttatctcctctgtgtagcaaaaccttaaccctgagggaatttagggttttctctaatttgttgagtgatagtaacagaaattgcacacttctgtggataggacccattgtcacttgttgtttttaacctcaactaggccctcagcattgctcagtgattctattttgtttcagtaattcttgtcttctgacttctaaacacctattgggctgttgcactgggatgttgtatcccacatgcacctctaattcagtgactaaaattaaactcatcttttccatcacctaaccctggctctcttcacatgtctcttcatcatacactcagtttcccaagcctgaatcgtgagagttatccttaacttttcccctttttctctctagcattcatatagtcatcaagtcctgtcagttctatcttttagttacctcagttagtccacctatcctatctcctctgccagtttagctactatcatctttcacctggattagtagtaagtttttaaacggacttcttgcttccttttgcagccagagtaatctttctaaagtacagatctgattatgtcaatgcttggcttgaactatgcaatgacgtcattgtttttaagatgaacaacatggcttatcaggctgttcattatctggctcctgcctgtcccattagcctcattttctgccattcactacattatagccatgttgaacattatacagctgagtagctgggatacaggctcctgccaccacacctggctaatttttttatttttagtagagacagggtttcaccatgttggccaggatgatctcaaactcctgacctcaagggatctgcctgccttgggctcccaaagtgctgggattacaggcgtgagccactgcacccggccccctgcccctttagatggttacacatgctttcctttttgtcgcaacactctatggctttgccttgttccgtcctagaatattaggaaatagcatttgttataggacttgtcattctttattccagctgctgcttttatcttcctcttgatagattatagatttctagaggactggggatatataggtcttgtactttgttgtattttgaatgcctgacacatatctgacgtatagtgggccctcaaatttgttgactgaataaatgcttatttagttggatacctaggaaaattcagcacagttatccaaaattcatttcattgtgtttgaaatggcatgcttatacttggatcaaaaattatttatctttttattctgtgctttttaccagaaataatttaagataaacgaataatacatgtaggacaataaattgaaactgggaatggatattatatacacattgaacatccctaatccaaaaatctgaaatttgaaatgcttcaaaatctgaaacagtttgagcatcaacatgaatctcaaaggtcatgcttaaaggaaatgctcattgaagcatttcagattatggatttttggattcgagatgctcagatggtaagtataatgcagatattccaaatttcaaaaaaattaaaaatctgaaacacttctggtctgaagcatttcacaaaaggaatacttaacctgtatatattggtatgtataggcattagtcttatacacttgttagaggtggcagcacatcttcagagggcactgtggtagagactgtcaattgtctttcatctcttcttcctttcccttcccataataaagtgcttgattgttttcttgagcaaatggccactctgaataaagaccagattttctaggttgttttgcagctaggtatggcaaagtgattatgttcttagtgtaaatgaacgtgttatgtgtaatatatgtagatgtaatgggtggagctgaaaaagctacctcagaccacagagtgcttgtggaggcaagtgtaacaataagatggaaggaacctgagcccctgatacatcttggagcaccaactagctttagggaactaccctggatttttgcttgagagagaaataaacatctatattatgtaagccattgttattttggatttcatacacttgcagctgaaccagtacaactgctaaaacttctttgacaaatggattgtgtaccctgctgggaactcattcctactctcttgctggtggggatgtcattgcctcttaggcaaatgcagatcaccagcttaaaatgagttgtaaaggcaccccaacaaatttttgttccacatcttctttgaatttgggaatgtgtgctataaaaaggaaataaaagtaaacaagagaaagtgcataaaatcaacacagaacttgagtaggagaagggagatcctatgcaatgaagaatttaaaaacaagatacaccttatttaaatcacttgacaaatcgcttggctccagagatgaaatttgatgtatatatctatttatttaactaaaacttactccagtaatctgctaattcaccagtacacagattttaaaatttagctttactcctcatctcaaaattagaagataaacgtatcacacatcctattaggaaaaaaacctcaaaacctgtttataataatctaattcttaaatctaattcctcagcaagttctccataaatcttagcagtactgagaatatttggtatgcaaagggtacttttaaataagtagctttatttataaatataggaaataatcactataaaaacgcttgtcaaaatattttttcttaacatgttggcaatacgtagcaagtttttaaaaattttcgtatgctgtgacctagacgttttgtttcgagaagtcattgagggtaaaggaggggaaagtagttatgttttacttagaaatatgaatttttatccaaaataagatgattaaattttgatgtagccttaattttatgcaaccattaaaaacagtgctttggaaaattacttaataacatggtaaaaataattggtcaagatatatttagtgtgatggattgtagaaaagaataaaaggttcagtaagtgttctgaatgcataagtgaatcctagtatatatgataaatacttcataatggtgaacaaaagatagtctgtacaggaaataaatggttttgaagcaactgggtaggcatctttaaaaaataatgttagctccttgtctcacactgtataatcaagatgaatctcagtgtatcatagaggtaaatgtagaaaacaagaatcacaaaaatacctgattcaggtaagaccttgctattatgcaaaatccatgaaagaaaaaattgaacaaattttctgcatgagaaaaacaataacaaaaacttctgcatggcattaaacattataaagcagtaggccccagggactggtttagtagaagatggtttttccatggaccggggcaggggatggtttcaggatgaaactgttccacctcagatcaccaggcattagattgtcataaagagcacacaacctagatccctcgcatgcacagttcacagtagggtttgcactcctgtgagaatctagtgctgcagctgatctgacaggaggcggagctcaggcgataatgcttgcttgctcattgcccacctcctgctgtgcagcctggttcctaacaggccacagactagtaccggtctgcagcccagggtttggggacccttgtcataaagtcaagagacaaatgaaacacaaaattgtttacagttcaattatagacaaaggggtcaaccctctgatatataaataatttgtaaaactcagtaattaaaagacagccaaatagaaaaaaaatcaggaaaggatatgagcaaacgggtcacagaaaatgacatggaaaatttttaacctcgcctaaataagaggtgtacaaattaaaatacaccgagatgccgtttttcaactttccagaaattctaattttctgtcatcctgaattatcttgtctgtgtgtatatagacactcttatggagtgatggtaagagtataaattatttcaatttttatggagtgcactttggtaatagctatcaaaattataataatttatgctgttcgagtgagtagcttgactttttgaaatgtgtgttatagatggacatgtgtgaaatgacatatgcaagattgttaattgcagcattttgtaacagcaaaaaattataaacaaccttagtgtccatcaataggggaatgtttgaaaatattatggtgtattcatataatggaatgtttttttgttgttgttgttaattttattattattatactttaagttttagggtacatgtgcacaatgtgcaggttagttacatatgtatacatgtaccatgctggtgtgctgcacccatcaactcgtcatttagcattaggtgtatctcctaatgctatcccttccacctccccccaccccacaacagtccacagagtgtgatgttccccttcctgtgtccatgtgttcccattgttcaattcccacctatgagtgagaacatgcagtgtttggttttttgtccttgcgatagtttactgagaatgatgatttccaatttcatccatgtccctacaaaggacatgaactcatcattttttaaggctgcctagtataccatggtgtatatgtgccacattttcttaatccagtctatcattgttggacatttgggttggttccaagtctttgctattgtgaatagtgccacaataaacatacgtgtgcatgtgtctttataacagcatgatttatagtcctttgggtatatacccagtaatgggatggctgggtcaaatggtatttctagttctagatccctgaggaatcgccacactgacttccacaatggttgaactagtttacagtcccaccaactgtgtgaaagtgttcctatttctccacatcctctccagcacctgttgtttcctgactttttaatgactgccattctaactggtgtgagatggtatctcattgtggttttgatttgcatttctctgatggccagtgatggtgagcattttttcatgtgtcttttggctgcataaatgtcttcttttgagaagtatctgttcatgtcttttgcccactttttgatggggttgtttttttttttcttgtaaatttgtttgagttcattgtagattctggatattagccctttgtcagatgagtaggttgcgaaaattttctcccattttgtaggttgcctgttcactctgatggtggtttcttttgctgtgcagaagctctttagtttaattagatcccatttgtcaattttggcttttgttgccattgcttttggtnnnnnnnnnnnnnnnnnnnngatatgcagcgttatttctgagggctctgttctgttccgttggtctgtatctctgttttggtaccagtaccatgctgttttggttactgtagccttgtagtatagtttgaagtcaggtagcatgatgcctccagctttgttcttttggcttaggattgacttggtgacacaggctcttttttggttccatatgaactttaaagtagttttttccaattctgtgaagaaagtcattggtagcttgatggggatggcattgaatctataaattaccttgggcagtatggccattttatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcagtagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaacgaaatccagtaccacatcaaaaagcttatccaccatgatcaagtgggcttcatccctggaatgcaaggctggttcaatatacgcaaatcaataaatgtaatccagcatataaacagaaccaaagacaaaaaccacatgattatctcaatagatgcagaaaagacctttgacaaaattcaacaacccttcaagctaaaaactctcaataaattaggtattgatgggacgtatctcaaaatgataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaagtaatgggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttacacaccaataacagacaaacagagatccaaatcatgagtgaactcccattcacaattgcttcaaagagaataaaatacctagggatccaacttacaagggacgtgaaggacctcttcaaggagaactacaaaccactgctcaatgaaataaaagaggatacaaagaaatggaagaacattccatgctcatataatggaatgttaagcagcttcagaagagaatgaggaacctccttatgtctgatgtgtaaagagctctaagattcattgttcaatggaaaaagctaagcttagaaccatgtggataatatgttctatgtgttcagaagggttgggaggagaatctgtagtcatatttgcctgtacatacataaaacattctctggaagacatataaactattaataatgtgtgtatatatgttcatgtgtgcatatatggaagaaactgggtgggtcaggcctagacagagcttcctttgtgcaaattagaaaaggatactgcttcctcaacaacctctacttctgtctcaaaaaattattatattatattcattttgttagcacaaggtacttggcggtcatccaccagaaaattttaatgaaaatagataatattgaaggattttttttgaggttctgcactaagtttttcattatattgaattaagctttttctataggaaatttaacataatcttcagttcatttataattttctaataataatagttttgaataataatagaaaagttgtgattttctcttaataatagtttaactgctgttaggaatatttgattttgtaaagatcaccttgtagtttatttaaggtaaaattttattattcattaagggcaggatataacttttgttagatgtacctcttgatatttttttgaactttgagtcatgacctcaaaatatttaattatttagaaatacaagattaagtaaaaaggtgaaatacaagactacatacttaatatccttcttcttttactaaaaatttatagtaaatttttactatagtatagggttttttatgtgtatgccatgcatttattttatcagtttttagtaaaataatatctgtatatacatacagagttttgcatctatatgcatgtatgtgtatgtcttaggaaaaaaaggctagaatgaattagaccaagtagtaatatctctcagtagtaggatttcagatgattcaaaaaatattttctttatatttttttattttcccactttttacagtgattatatgttatattacatttatggtaaatgttttaatgttgtttctctaaggttttgtactgaaggttttttttttattttcccttcatgaagagtttttcagcttatatctttaatggataccggattgcctcgatgttgtaatgagaaaatagagcttgcaattctgtggttcttggatcagtttcgtaaaacatatgttggtgatcaacttcaaagaacctcaaaggtaggtttctactagagagtttaaaacatgttattggggatgaagaaagatgtacatatataactgaatgatatatttgggaaatttctacataagacgtgtaattgattaatgaattgatgaattggtgatgaagtgcaatgtaaaattaagttgcttgttttatacctagtttaccattttctttaaagattgagtggcagagaggtaatgaatatgttttacatggatggtcattaaacagttgagattattttaaacactaatcaattttgccttattgtatttcaagactgaaagcataagatttgcttttttagtagttccagggttttttggacacttatttatttatgtggcttctagtatatttcactaatttcttggcatttgtacatgattaaataatgaggactaggaaaattagatgtgtccttaagagactgcatataaccttaatgttaggaatactcatagtatgataattgaatgtttagcatcagcaagttaagatgacttgatcttaaagtataatgaaagattattaagggcatttatgtgaaacctaagcagatatttagtagcattagatactgacactgagtaaaatcttcgccataagaagttctaaggatattctcatttcatttgaacttagtttgttttagtgatgttgtaggattttttatttgaaaattctaaaataaactttttatactcattttagctgttttatcttaggaaatgtaaccttcagtttacttaggattttctgataataataattgtgtagtagtgtgaaaaaattttttgtttgattttaagattatcctttagtttatttcaggtaaaatattcttttttaaggaaatgatgccattttataatttctttctcaaatatattatgatattatcatttaggattaatatcaataaaattctcttagaatttagctgccaccaaatgagaccatttggaagaaaaagagtagctagaaataaatgttttaggttgtcagtaagacaacttagaatcagacaataattacatactataaaatttatataacagcgtgcctttttaataatcccagatgtgatacttgaagattgaatataaatcaaatgatgataaattttcttgtttaatatgtccagagagtatctttgcttttgcaaaagggttactctcaaaatattgctaatacagtatccatttggtgtaggtcttaaatcaaaacagtataatatggagtagaaaatccttctaagtgttgttttgaaggcacctggaaggaactatgtaaaatgagactggttgttttagggctatgggatttcggattttgtttcaaaacttttaatataaggtaattgtgaaaaaaagcgaattacagattagtttttcgtttttgaaaaagcttgcactttaggaaaaagtaaacacatcaccagaatggtattggctcctttattgtaactttaacattgttggtgtgtgtatcttaccctattaaaggaagttagtcctaaggtgacaaaatttctaaggcatttctattgcataaccccagagtgaaactaaatcttcctactttttggtttctctgacttacctgccaatctgtcttaatagaaatcattttcagaagtccttaattatgtgtcccgtcactctcctaggtactcttcatgctagctttattccttacagtaggcttgcaaggttggtattaatgtcctcattttactaatgaaagaacagactctaagacatttcgtaagtactatatatacaatttttttagcaaccaactacgtaaggaagagtgagtggaacatatttcttggtgggtgtattgtccgattccaaattgtggcaaaaagtgggagaatactagataatagcaaatgaatgtttaacaattaatgcgtgcttattttgtaccaggaactgtgctaagcacttttgagcagtctcatttaattgtatcatgtagagtatgacttcaaggttcttcccaatctcttttcggcatatgtcaccagcttcatacttcagtacaccatacttgcactgcatactttatatgtggtaaacttatttcaggttcttcagcagtctgtgctctctgttaattccaggtattagaagaaaatgtttcccctgcttaattatgcctagtgttccattattggaacgctaagcatgtgggagttatttatatcctactgctcaaggtcatcatcaaggtctgattgcaaaaatttaaaaaattccaacctcaggcatgaatgggttaagacactattttttttaaatccatcttttacttctctgccttattctgccaactacttattgttatcagagaccccatcctttagtatcccctttttaactctcaaattctgagagtgttcgttttgtctgtgttctgtagcacccatttgttccctgttttaatatttattacactgctttgtaattacttgttagtgaatagactgtaattttggttagtactatttctgccttgtttattgttatctgaaagagcctggcatgtatgtattgtttgtatgctttcaacttactgttgaatgtgtgtatttaatagaattctataggaattcggcctagatctcatgtataatactttcaggtaataaaggatatattcttgagttggaaaatgatgctgacttgagtgaaattattcagcagttataaataaggtgtaatattaagcatcttgaacattttataaaagcctgtatagacaacagaatataatttatagaagtaagttcttcaggaaccaaggtggaattactaaagtgtcctaagtgatgtatgtgatagaagtcctatatgtgagaaagaatgttgtaaatagtagccataggcatttattgagcaacaagtctgtgtcaaatactttgctcagaacttgaaaggcattatataatttcattgtcacaaaaatgctatgaaaatagcgattttgttaaaatccttcctttctgtagacatggaaattgaggtttagaggggttaaccaatgtgtttaagtggttcaacctggatttgaaccctaggcacctgactgcagagcctgagctgctgaccactttggtatattgcctcctttttattggatctttccactgggatgttgaatgggcccttgaaacttatttccaaaaaggaactcactatcttttagaactctgtcttcctacttcccatattttaaagaagaatgacattgaatttcccttttgtacctcttgtatccaatctgtcacctaatcctgtgaattttacttttggagtatctctcaggtgtactcctttcttctgcccctttctttttagcctcactttcactgcttgttatttcctatggaatttcaaaagtattctacttgccctctttgtttccattttgcttctccccactccactctattttccatactgccactggagtatttttttattagaaaaccaaagaataatgtaataaacactcatatgcccatcattcagttttgtcaagtcttaatgctttgctatatttgcttcagatctgtatatttttgagttaaacatgaataatcctgttgctgctctgatttcacttctctagcttcttgccccactgtcctaaatttagtattattctcatccatgattttgtactttttctacatttctgtgtatatataaacaaaacacagcactgttaactttatataaaagtattatgcagtttggatctttaggatttttttttttttttttttttttgaggtggagtttcgctcttgctgtccaggctggagtgcaatggcgccatcttgactcactgcaacctccgcttcccaggttcaagtgattttcctgcctcagcctcccaagtagctgggattacaggcatgcaccaccgcgcctggctaatttttttgtatttttagtagagacgaggtttcaccatgttggccaggctggtttcgaactcctgacctcaggtgatccacccaccttagcctccctgagtgttgcaattacaggcgtgagccaccacatctgaccagaattcatctttttttattaccatttttgagatttattcataatgacacatatagttctaattattttaattattgagtggtattagagtgtatcactatgccattatacattgattttattattgatatgttagattgtttccagattttcaatttttacaaacaatactgcagtaaatattctcatgtctgcatcctcatgcatatgtaagagttttgtgaagataaatagtagaattgctgggctgtaaaatgtacatatcttaagctttactagatattattaggttgccttcctaagtgttataacagcttatttcctctcccccagccagggtaggtgtctgtttctattgtcattatatgtgcttttgtcagactttaagttttgccagtctttcagaaaaatttttcctgtgcaatttttctgcttaaatttttttattggtttctcgttacttataaaatgaattcttgcttatgatgaaactttgcctacctttgaaatcatttcttttcattccactttatgacatgattcatatgtgctgctgtcttttttcctttggtttattcctgttcattactcagtgactattgataagtaaccactatgtattaatgccagggatgcaaaagtgaataggatcatccatctcccctgtaagtttttagttaaagggaacatggacaagtaaggaaaaaaaattataaaattgattcatatatgcatttaaacagcatatgatgaaatgaagaccagacaaactattaaatacatactgctgggatttttggttatctgtatgtgaaaatttggattaagacttcatatcatgcaaaaatcaatttctagtagaagacagactctaaatatgaaaagcagaatactatgatttagggatagggaagaattttttaagacataaaaaagctaagctctaaactcaaaagttggtaacttctacctatattaaaagtaaaaactcctgtgaatcagaaaacacaatagacaaagtaataaagaaaagctgtaggaatacattcataatacatgtaacttatagagaatcaacattcggttatataatttctgtgaataaataagagaaaagctacctactagtaaaatggccaaaatacatgaataaacacttcacagagggagaagaaatcacaatggccagtaaacatggtcttagtcctctgggctgctgttaacaaataccataaacaacaaacatttgtttctcacagtttgagagcctgagaagttcaagatcaaggctagcagattttgtgtgtggtaggagcccttttctgttttcatagttggtgccgtctctctgtgtgttcacatagtggaaagggcacacaaactctctcagaccacttatgaggacactagtctcatccatgagagctctgccctcatgacctaattgtctccaaaggccctacctcttaatatcatcatgctgggaattagatttcaacatacgattttgtcagggacacaaacattcagaccatagcatttcacatttgccccacaaagtgcatgtccttctcatatgcaaaacacgccattccattctagtttagtccccaaagtcttagtttatcctacaatcagctccaaagtctgaagcctagagtctcatgtaaatatcatctaaatgagatgtggttgagactccacagtgattcattctgagccaaattacccctctagctgtcagcctgttaaatcagataacatcatatgcttccaaaatacaatggtgggacagacacagggtagaccttgccattccacaagggagaaacaggaatgaaggaagaaatgacaggtcttgaacacgtccaaaacttaataaggcagcattaaatcttcaggctccagaataatcttctttgacttaatgtcctactttctgaacacactggggtagggattaggctcccaaggctctaggtggtagagttctcatatactggagttgggtgcttgctgctctcccaggatggaatcacatgccagtggctcttttagtctagagttccagagatgaatgactctgcccccatgactccactaggcattgccatagtggggactttctctggtggccctgtccttccagcaaccctctgagttgtacagctgaagctccaggcagctctatttttggaaatggaggtggccacacccccatggcttgagcattttgcaagctggaggaagtggtactgcatgtatgccaccagtgtttactctctatgccctctgaaggggtaatcactttagcctaggctgcacttgggcctatggaactgtacctggggcagccaaggagcactgcatgagaatgtggggagtggagtattaaggcagggccaggcagcaagtgctagggtcctgtgagtacccatggcccttcctttgaaatcattttttcttccaggcccttgcgctctgggcctgggagacagaatgagagacagccccaaggatctgtgatacactttcagggtcattttttccttgtccctgccagtccaggcacaccttttgtgttctctcctgaacatactttctcatttttcacaatatggaaaggctgataatttttcaaacctttaagttctctttccttttgattgaccattttgtctttaaatcatttttcttctcacattttattattataaacattcaagggaaaccaagccattattttgcttagaaatttattcagccagctgggcgtggtggctcacacctgtaatcccagcactttgggaggccgaggtgggtagatcacctgaggtcaggagttcgagaccagcctgaccaatatggtgaaaccctgtctctactaaaaatacaaaatttagccaggcgtggtggcacgcgcctgtaatctcaactactctggaggctgagacagaattgcatgaacctgggaggcagaggttgcagtgagccgagattgcgccactgcactccagcctgggtgacagagtgagactcctgtctcaaaaaataaaagaaagaaatgtattcagccaaatattctatatcattccttacaaattcttttttacaaaacagtaggacacaaacaattcttctaggttctttgccacttttataagggcaccttttataagggcactaatcccccttataattctctcccaaaggccctctctcttaaaaccatcacattggaaattagattttaacatacgaatttcccgcattttttctgcagctctgtttgttttttattctttttctctctgtcctttgaatagtactagggtcttaatatagatgtaaaagctaaaaaacaaaaaaacaaacagaaacaccaaaatggattccagcatcttataagtgctttctcttatgatcgagagtaagacaagcatggctactcccttctcttctattaaatattgtactaggggttctattgagataaataggcaaaaaacaaaacaaaacaaaacaaaaaggcatccagatttaaaaaaaaaaggaatctaggaataaagggattacatctctaattgcagatgacatgatcttatgtataggaaatcctaaggatccactgaaaaactgttagaactaataacatcagtaagtttgcaggattataagattaatacaaaaactcgactgaatttctgtgcacttgcaataaacaacccaaaaacaaaaggaacaaaacattccattataatagaatcagaaagaattaaataggaataaatttaacaaaagtgtaaaacttataatctgaaaatcataaaacattgttgaaacaaattaaaggggatgtaataactggaaagatatcttatggtcatggattacaagacttaatattgttaagatagcagtgctcttcaaattgatctacaggtttaacacaatctctaccaaaatcttagctgttgtctttgcaggaattgacaagcttatccttaaatttgtgtgaaattaaaagaacgcagaatagccaaaacaatcttggccaagaacaaagttggaatactcacactttctaatttcaaaacttgctacaaagcagcaataagttgttacttacaataatattaagttatagtaattatagtaagacagtgtggtaagcatatacatataaacgaatgaaatagaatggagagtccaggtaaaaaccttcacatttgtagtcaggtgattttttgacaagggcatcaacataactcagtagtggaagaatagttttcaacaaatgatgctggtacaactggatattcacattcaaaagaatgaagttagtcctctctctcacaccatatgcaaaagttaactcaaaatgaatcagatctaaatgtgagaaaaatataaaatgcttaaaacatagaagtaagtctttatgactttggacaatggtttcttagctatgacatcaaaagctcaagcagctaaagaaaaagatacattggacttcatcatttaaaaacttttgtacttcagaggacatcatcaagaaattgaaagcgcaacctacaaaaatgggagaagatatttgcatatcatatatttcataaaggtctcgcatctagaatctataaagaattcttataactcaataataaaaagataaataacccagttttttaaatgggcaaaagatctaaacagacatttctccaaagaaaatctatgaatggccaacaaggacatggaaagatcttcagcatcattatttatggtagaaattcatgtcagtgccagaaatagataccactttacactcactaggatgaatatgattaaaaaaaaaagataataacaattgtgagtgagaatgtggagaaataggaatcttcatacactgttgcaaggaacgtaaaatattgcaaccaatttgaaaaacagtctggcagttcttcaaaaggttaaacatagagttaccatgattcagtatttctactcttatgtatatatccaagaaaatggaaactacactctacataaacatttgcacacatgttcacagaagcattatttccaatagccacaaagtggaaaaaaatttgcatgtctattagctgatgaatggatagataaaatttggtatttccccaagtggaatgttattcagccataaaaaggaatgaagtactgatagatgccgtaacaagtatgataattgaaaacattacgctaagtcaaataagccagccacaaaaaaacaaataccacatgattccagtggtttgaaatgtctggaataggcaaatctatagaaatagaaagtagattattgggtgcctagggctggggttattggagattgggtagtcatggacaaaaggtatgaaatacctttgtggtgttgaaatattctgaaattgattgtggtgatggctgcacatatccatagaaaaaaacactgaattgtgcacgttaagtgtgtgaattatatagtaggtgaatatgtcaacttgttaccaaaaaacagaccaaaaaactcacttttaaaatgggcagaagatttcaacaagcactgaaaaaaggtatctaaatggccaatatgcatataaaaaggtgttcagtattattagtcatcatcagagaaatactaattaatacctaagtgaaatatcactgctcatctgacaaaatggctaaaaattttaaaaactgatcaaaccttgatgatggagtggaacacatgataacatttgttgctggtggcagtgtaaattaataaaatcattttggaaaactatttggcgatgtactaaaactggatatagtctaccttatgactcatcagctctactcttatttacccagaagaaatgaatttatatgtttgccaaatgcagtgtacaagaatatttatagcaactttatttataatatccaagaactgggaacaacccaagtgtctgtcagcagtcaaatggataaataaattaatgtatactcatacactgtaatactatacaacgatttaaaaaaagaaaaactacatgcaaaaatttggatgaatttatgatgattttacaataatcacttcagctatgatgaagaatgaaaaagatcaaaagtgtacatattttattattccacttaccaatttctataacagtcaaaactaatttatggtgatggaagtcagaatggtggttacctttgggtagggagaatattttgactgggaaagtgaactaagggagccttctggggaccttgaaatgttttattttgatggggcttaaatgagtgtatacatatataaagacacactgagctcatattatgatttgtgcacttcatattttgcctcaattaattttttttacaaaagattcatggaagcctggtgtgtaattgtgtaaaaaagtggaaacttgcctatcagtagaagaatggatgaattacggtattgttacacagtgggattatgtataacagtgaaaatgaatgatctaaaactacgtttatttttgggtaactctataaaaccatccacaatatggtatgaaaaaaagtcatacaaggacacaaatgacattcctatgtcaaatatgttaagaaaattgtatgctcatgaattctacctatggtaaaaataatatgtgcatgggattagtaaacactaaattcaggataatggttatctctggttgagaagaggaatggattagagcaaaaggcatagttcaaccatatctgtaatattttcttagtctgcatggtgggtgtgcatgggtgtttattaaattttatgcctttctctatatttgaaatatttaatttgcaaaagaaataattataagaactctagttaaatacagcaaattaaaatttcacatttaccctcctatccccttgcaactgtatcataatgagagtagaggaataaaaaatacatttgcaaggaagaaattagagaatgatatggtctggctgtgtccccacccaaatctcaccttgatttcccatgtgttgtgggagggacccagtgagaggtaattgaatcatgggacaggtctttcctatgctgttctcatggtagtgactaaatctcacaaaatctgatggttactataaaggggagttgtcctgcataagctatcttaatttgcctgctgccatccatgtaagatgtgacttgctgctccttgccttctgccatgattgtgaggcctccccaaccatatggaactgtaagtccagtaaacatctttcttttgtaaattgcccagtttcaggtatgtctttatcagcagcatgaaaatggactaataaagtaaattggtactgggagtgggacattgctgaaaagataccagaaaatgtggaagcaactttggaactgggtaacaggcagaggttggaacagtttggagagctcagaagaagacaggaaaatgtgggaaagtttggatcttccaagagacttattgattggctttgaccaaaatgctgataattatatggacagtgaaatccaggctgatgtgatctcagatggagatgaggaactggagcaaaggtgactcttactatgttttaacaacaaaactggtggaattttgaccctaccctagagatctgtggaactttgaacttgagggagataatttagggtatctggtggaagacatttctaagcagcaaagcattcaagaggtgacttgggtgctgttaaaggcattcagttttaaaagggaaacagcataaaagtttggaaaatttgtagcctgacaatgtgatagaaaagaaaatctcattttctgaggagaaatgcaagctggctgcagaaatttgtataagtaatgagaagctgaatattaatccccaagacaatggagaaaatgtccccagggcatgtcagagacctttgtgggagcccctcccatcacaggctcagaggcctaggaagaaaaaatggtttcatgagctgggcccagggtccccatgctgtgtgcagcctaggaacttggtgccctgtgtcgcagctgctccagctgtggctgaaaggggccaatgtagagctcaggccacggcttcagagggtgcaagccccaagccttggcaccttccatgtggtgttgagcctgcaaatgcacagaagtcaagaattatagttgggaacctccacccagatttcagaggatgtatagaaatgcttggatgtccaggcagaagtttgctacaggagcggggccctcatggagaacctctgctaaggcagtgcggaagggaaatgtggggttggagcccccacacagagtccctactggggcatcgtctagtggagctgtgagaagagggccactgttctccagaccccagaatggtagatccactgacagcttgcactgttcacctggaaaagccaacgccagcctgtgaaagcagtagaggggagtctaccctgcagagccacaggagcggagctacccaagaccatgggaacccacctcttgtatcatcatgacctggatgtgagacatggaggcaaaggagatcattttggagctttaagatttgactgccctgctggatttcaaacttgcatggggcatgtatccccctttgttttggccaatgtctcccatttggaatggctgtatttatccaatgcctatacccccattttgtgtaggaaataactaacttgcttttgattttacaggctcataggcagaagggacttgccttatctcagatgagactatggactgtggacttttgagttaatgctgaaatgagttaagactttgagggactgttgggaaggcatgattggttttgaaatataaggacatgagatttggaaggggccaggagtggaatgatagggtttggctgtgtccccacccaaatctcatcttgaattctcgtgtgttgtgggagggatctggtgggaggtaattgaattctcacgtgttgtgggagggaagcaggtctttcccctgctgttcttgtgataggaagtctcatgagatctgatggttattaaaagggggagttttcctgcacaggctctcgtttttttttttgcctgccactatccatgtaagacgtgacttgctgctccttgccttgtgccatgattgtgaagcctccccagacatgtgaaactgtaagtccgtaaacctctttcataaattacccagtctcaggtatgtctttatcagcaacatgaaaacggactaatacagtatgttaggagacttgaaactagcaaccagatgtataagcggtatctgtcttaatgtacctgagagattctaaccttaaattcctgcagtgaagaaagctagtagttaggtgatttgcactaagaaccctggaaaagcccagaacttggagactctagatacctttgaatgctgcagttcggggtgtggctaaaaataggataactgatttaattaggattagttatattcccagaacgcttacctgtcccagcacaactggagattgtctctccgaaattcttgcaagagataggaagttttttatggaagtttgaacaggaggttctaggggataagaataagacactggactgaaaaatattcctagacactttacaactcttagttgtcatgaactgttagctagggttaaaaccccaaagcaggaaattagtgaaatgcttttgtgatgaagaagcttattcaagagagagacctacagatatagatatagatatataggatcctcaattttaaaatcagcctaactgcttatgaccctacagtgaggtttactggatgagaagccctgttgtgaacataaagctcctattcttttttgagtaactcattctgataatacaattgacaatagctagcctcttgaagaaaacctcatatgaaaaccaaagagaaaaacagaaaataggaaattggaggaaaacagaattaatattaaaaccattaaaaggattttgttaaaagatgattcagagaagagctctttggaattaagacatgatagaagaaattaaaacttagtaggtttggaagataaagtagccaatatcacctagaatgcagaacagaaagttaaaataaaactggataataggagagaaaatagagaatccaggaggtccaacattggattaatgggagttccagtaagagaaaaagaaagaatactagaaattctcctgtagtgaaagataacaggttccatactgaaaaggactatgcagagttccagcaaagtgagtgaaagaagatccatattaaggtatagtattggaaattcacagcatcaggattggaaaaagaggagatccttaaagcttccagagagaagaggggttacattcaaaggactaagaatgaaaattacattggtcttctcaattgcaatactaaaatagaagacagtgaaacattgtcttgccaattttgagaaagaaaatgaatttcaacttaaaattgtatatccagtaaaacttaagtatgaaaatagaataaagaccttttcactcagacaaagcctcaactttacttctcttatatcttttaccaggaagttgctggagactgtatactactcaattaaaaaagtaaaccaagaaaagaggaagaagggagagatgggatctgagaatcagaggatcaaacacaggagagaggctaagggaagctctcggataacagctgtgcctcaggccttgagagcaaccagttcaaactggagcagatggaaggtcataggtgttttgttttgttatttttctttaaagaactgatagattacttgctgtcttggaccaggttgagaggaattgagttttacagatctggaatagtgtttgagggtcaactagtaataaatagaatcacataaaacttaggtaaatgaaaaggaagtcaaactaaacatttgtgcacaaaagggaattgaatcatagtaccatggaacttagttatgaatgatgaatacagtatcataaatatgttagggagtcaaaagataatgtgaaaaattcttatatcaggaaatagctctgtctgcctgtttatttagaagaatgaatgaaaatagtaaaagaaatagccgaaagagttgaaaatgggttgacttgagtattggaatcagatatggagaggagtatgtcagaggatggcagttttttattactgttttactttttaaatcatgtatgtgtataattttagtagaaatacaaatttggacaattacaacatagttttatgcatgaaaaaataatggtaagcgtttggtgccctgaaaacacaggggacagtgtatttaacccagattttgggaatcagaaaggcttctgggagagaagattcctgaatgaaatccagaagaattagttgaagctgctgaagaggaaggaaaatgggatgcttgttctaggaggtagaagcagaatgtgcaaagccttaaagctctacattggaagaaatccagataggttagtatagctaaggcttgtggtattcccagtgagcattacagagcctaacattagattttcagcaaatactgaataaataaataaataactgatgtaagggaaggagttttttaagagtaggaagtctgggaaagcagacacatagcagtcacatgcagcctaccttgtgtctagagcaccagaattctagtcaagaaggtacagcaaattcaggtctctacagactgaccagtttgtcatccgggtgtatggtttctttctgaggtacatagataacccacccaggagtttagtaacatataattaaagtactccagaatgttcatggaataaaatattctaaccaaaagtgtgtttaggccaggcacagtggctcacccctgtaatcctagtgctttgggagataaggcgggaggatcacttaaggccagaagtttgagaccagcctgtgcaatatagcgagaccctgtctctacaaaaaattctaaaaattagctgggcatggtgacacacggctgtagtcccagatactcatgagggtgaaatggaagatcacttgagtccaggagtttcaggctgcagtgagctgtgatcacaccagtgcattccagcttggatgaggcagcaagaccctgtctcaaaaaacaaaaacaaaaaaaaagtgtagctaatagttaaatacatatgtaaatgatcacctatttattagggtataattgaaaacgttaaaactcttagaatatttcttagactgtatcagaattttacagtatttcctgtttatttttgtatccattagttgttacctggtgtgtcaccatttactctaattataaattatcttagtttattgataacaattttaagtattattttttatattaaatgtctattagaaaaggtccattttaatttttaatccaattaaaatgtgatttttaagttttaaaaatggataaggaagagtccttttaaaatacagacacacacacaaagacacacacatatacacagacacacagacacatacacatatacacacacagacacacaggcacagacacacagacacatatacacacacaggcacacacacacgcagaaccacacatatacacacaaacacatacatacacaaacacagacacacacaaatgcacacacagacacacacacacacatcttagcttctgaatatctaccaaaagttagaagttttgaactttgttcttaaatccctttattcaagcttaccctaccataaacatcagttttgtcttggttggttatgaaaccttatcagtgagtgaaattccaaaaattaataaatacgtgttgttaaggtcctggaatgtattttcctttaaaaatagacccataaacagtgatactgatcaagcatagtataatagaatttgcctgaattctgtcctcccaaaacaggataccagaaattgagcaagaagtaattccctttctctcttccatttaaattttgaaatagacaagttaatcttcaaaatttttgctctcattcttcattccttgttttgatatcctattcaatctttcaccaccaaagggtgaaatcccttgtatctcttttgttcatcaccatctaggtatacaggaaaacacacacgtgtgtgcacttgtgcaaatctgctttctttccagtacctttcatctgccagatgtcaactggaaaacattccaattgaaggatgtcatgctattgtataaatgaattctcctggaaaggattgcctttcctaaagaaaatatttattagtgccaaataattcaaatggtataacaaagtgaagtgaaaaaatcagtatgtgttgtggtagctgcttggataggggtaccatcttgtctgggagtgtatacctatgctagtttcctcctttttattttttgccttcattcttctgaatttacatatttcctaaaaatttccaaattgcttttcaggaagattttcaaggcattgggaaggttatgaagccagagggagtgaaaacagaatagtaatttataaataaagttaccatacatccagatttgcctgagatttccccagctcacgcttgttgtcttggcagattgttagttaatagcttcatctttcattctcaaaaatgtctctgtttggatgataaattatatgatctccttgcatataaaccacaagtttctaaagaggataatatagtaattcataaataagtttgtaaaggccaggaagtgaacctttccttttgactctgtggctctcagtacctgagtaaaagccttgtttataagtgtcatgaactagtgatatataagcatgtttagatcttttttgtggaataacttgaaatttgcattaagccgataagtgctccagtagtgtaactatagtgaacaataatttattgtatattttaaaatcacgaaacaagtagaattggaatgctcctaacacaaatggcaaatgcttgaggtaatggataccccaattaccctgatgtttattacacactgtatgcctttatcaaaacatcaaatgaaccccataaacatatatatatatatacctgtgatgtacccataataattgcaaatctagaaattttttaaaagataagttctcattgatgtattttcaaattgtccaaaataaaaatggggaattatctaaactttcaagctttatctgtgtatatggatttctaaattgttttgtgtaattacttattattcaacctttttcctactgttgagtacacatatgaagcagcagatggcattctttccctgcaattgttatgtcttcctgtatggtatgttactgtaataacagttactgttaaattgagtaggaaaacacttgaataaggaaatagaaaaacatttcatgatagtatcttcaatggactactacaactttaagtgcaatccaatgttaaaataatgtactagctgctgtttcatggtacttggatatattctgattactggcaacttgtatgtttgtatttgatacacaatttgggggaaaagtgtttagaaagttcatcctaaacaaattgtttcatacatagaattttcactttggtgaaaaataggtagcagctttaataccttttaaacactaaacattgaaacattttaaatatttcagcatgccaaatatatcatgtagattataggggaaaggcacctgtgacctttaagattatatgttgaagcttgattgttacagaataatgcttagtgactttagggatttttttctgttaagtgttttaaagcttttcagactatttctgggctgctttttgactaccatatactgaataaatatatcataatcagtttttgtaatagataacaatttgacctagttaggttttccttcttggtgagtggttagtgcttatatttcaagttaatgtacatactgctagatagttttattgttcagggatttgttattttaatagtcatgtcatatgctcaatacatatataatacattagtattcagataggcctttttaaaaaaaaataatttctctataccgcttcccacttttttatcctacatggtaatatatattaactgtttttaaaaacacacattttatacctgcttaacagaaagttgagcaaataattagactaaaggcctaattattttatttaaaaacgtctttgctgtataaatagatttgccaaattctacttttgagaatgaattccataagtgcatttaagtgttggtgcaagagcattaagcactagacgaggatgtttggggcagaaaaatctagttaaaatctttgcagccactggtaattaaaattatggtgtaagttagagaaatacaggaagtaaattggaaaaatatgggcttagtttttttttaataagctgacttttactatttatttatcataccaaatataccattatttgacatcaaatcttgtgagaattatattttgttatgtaattatatatacattaaacacttactctctcccttgtgctatgctagatcctggaagaattcaaagatgatgattttttgtgattacttaataaaatatatgcttacccacagaatatttttactctattttttcctctctttttttctacttacttttaatgattataaattctcaatcattataaaattcggtatctgtggataaatgcacaaagtaaaactccacgtgcattctgatgtgaatggcactttttggattgttctcgagtaattatagtttgatgattgattttttttttttaagtaagggagagggtgataatttcatctggtagagaaaagttttctgtattccacctatcttttagtgtttgatttttttttttttggtgattctaggaataagaataataaatgaaataccatgtagtatgtgactaaatacccaaataccaagtagatgtactttgaagagttgtcagcactaaagaagactttcaatttgaaagaggttttagttactaaattttacgacttgaaaacccagtccctccatcagtctgtaattttttttaatagtcattggatcttgtggaaatcatcaacaaggcaatcttcgtccacaaatcagaaggctagggccacaaatatgcatattttccctgataaaagattttcatacttaaaattttatgtctacagttcattatatatgtattatacatacatgatctttgcacttatgtgatagttcttgcttctggaataaggatggatgttgttgaacattcagagactctgccagatacctcttactgtttattatttttgtaccaaattaaatatgccattatttgactggaaaaaaattagccaggcatggtggcaatgcacctatagtcctagctactggcaaccagtttgtaagatgaagatgggaagccttccttaccggagtcttgggtagaatttgctatcttaaaaatattcaagttgcttaaagtaagatcatgtgtgaatacacgtcagtaactttggtatttcagtaataaagtcataggcaaaccctctactaagtttttactagaaatatgttcacctgtaatggtggtgctaaaattattatttgtcaaaaatagttgtcagtgagaatctcatactacatacttggaagtattttctaatgcttataattgatttaagtatcttgcttgaagggaatcaggatgagatataatctatcctacttgtgctgcagaaacgctgaagctattcagtctgtgtaaataatccatcccacatctttgcttcctcttcagtgaatgcttaacatccatatattatgatggcttgagtatcatttggaaacataagtcataatagctacaagtttgtaatcgaaatattgcgaaaagaattttaggtttcaagatagtgatcctttaatgtcaaatgtttcctgcaaaactgaatgaggaatattgtggattatttaatttttaatcatttatttcatgattatttaaaagttccctatattaattaatcacttctatactaatatgttatactgttttggtaggataagtgtaagaagataatcattggatattattcccaaggcaaattagtatttggagaatagatacgtttagcctgagagcttggtattaagtagtttaaacatcttaataatgtattggagtatgtgtgtttttatattttttcctcagatgtatactggtctttgctaactcatgttcttatctaatatccaggaaggaaagttaagaagttaggcttactgaaaaatatatatgactgttaagccagaatttcagactatcaactttcatgtatacagtatgattacaaagatgtaaaacaaacaatgaaagctaaagtattagcaaaaggacagaggaaatatgacaaaatatttattgtctttagtactaaaacaatgagcatgtattttcttgttttttatattttcacattttccctacttgttatatacatttgggaaaatcagcaaagtccaagttaaagtgcttaactataattgtctaagtttgaatggtattgccattgttcagatgatacttttaagcaacaatttaattcatagcatagtttgcaatttattgaataaaaatttaaaaatatggtatcaataattattctccaattatactatattgtcttataactttagattctactacacataaatgaatgcaatgtgtatttattagattcccactgatttcagcgaaagttgtggcttactatatttctgcttattttatcaaagtagctacctcttggttatgtaatgttaagcgtcttgccagcatgtggcagtaaaccagataaatataaactttagtagtgtggaatataatagtttatttttatattccatctggtacatttatttttttccttcctctgaaaaggccaacaaattttttcagtttaaacaaaggataaatgagcattctgaataaggcttctttagtgtcctaatgattaatgatcactgaacacttttgaaagattagcatttttcagggctggtaaaaaaatatactgttttatttaattataagaaagtaaaggcgcttcacactgacaggtggtggaaattagcaggcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtaggagatgaaaattattaagtagctttatttttttgaagattttacagcagctttgggaagaattatttcaccatgcatcaattatttttaattgaactgaatatttttcagattgtaccaaatgcctctcatttaagtttatcagttaggatttaagaaaacatcataatgagaactgcatatagtctctgttatttgttataataagacaatgatgattatttattttgaatttttaaaaagcaacccaattgttgcttgtaaaggtagtcaccgtattcgggtagtcaggatggagaattagaggctatatattctagaaacttggcttgtgattccttttctttcctcaaataaggtagttatcaacaatccagttaagaaagggttcatctgttcagaataaagatgcgggaagcagcttggccttttcatcagatagatctccagccagctctgggcttcaactagctctcactacccctgggaaatctcattactttttctgcgtatcagtttcctaacctgtcaacagaagtgataccttttacagaaatttgggatgattaagtaaaatatggcaaataccaagcacagaatttagtacagtacagatgttcaaaaaaacatagctgctgttattggtaagaataagaagaactatttttaaaattttaccactatttaaatttaatgggaaaattctctttgaaagaattatgtgtaatctttagaacatctaatgtaattctaaatttgtgttggaaaccaaccaatttatcacagattgatttttggagaagaatttggaaacagttggtctttggggcatgtatttatggtgattatacatgttgtttcctaataccaggcagaacttggaattaaaaccagacagtttgattctaaagtcaagactctagaaaaagacaaaagtgtgacttctggcctgatgaaatctgtaatgagttcaaaagctctgcttctcccctcagttgcttttgatgcttgtgttgcatttgtgtttccatccattcctcctcttttgctctcctctgctatccttttcgggggtagtagtcatgaaataaactggctattaactctatctgtgacactaattctctcttttgttttccttgccagtaaaataaaataataatattcattgctctttttggtaattgaatcagtgtaatcagtgtgttatgccaacatcccttcattagttatgttgcctcttttgtcagaaaataatttgaataggaaagaggagagagcaggaaagacatttcataattaatcaagatatgaatactgtactaccttaaaaaataagcattgcccagtctacttaacagaattatgaatgctaaataaatatactgtatgtgaaagtaagttgtaaactataaagcattgtgcatatctccatggtacatgtcaaatcagcatactacctttcacctgcttacaaactgaccaaaaagaaaattaaagtggtgattctgaagagaaggaaaatgaatgggtttgtttctgtggagggtataggagagtgggagagaatgtcagagaggaagaaaggaggtaagatttttatgtatatcaaaggggatggggttttaaaaggttagaaatgttgaattagagtagtggcctcaaactgaggtcccagattagcagtgtcagtccacctggaaacgttaaaaatgcaaattctcgagccctgctccacatcttctgaattagaagctctgaggtaggcccagcaagcccttcacgtaattctgatgctcacaaaaatttgagaactactgaattgttatttgaaggcagatgctctgccttgtttcttttttatcatcacaaggaactaggtttgtttgtttggtaatatcccctgcccctttttaacctgactgccagatcctttcttttatcttacttaacctgtgatctagagaagggaagggggaaaaagccacttgtccattatatgttaaacattgtgctaaaatactctaggggaagttataagtcaataggatctgtgttctcctgttccaataactaaaatttgtatggttatacacagtttttatttaaattgttttaaattttctcctaatgacttttcagaaaactgcaatcagaccaatgccttagttctcaaatgtaactattccctgttcctggcattttacatgtattatattgctggttatctgtagactgtaactttctaaaatacatatttttaaagaaaagtacttgagacactgtaccaagattaggtcagcagtcacactttgtttctaggattttggcttcagaatcagattgtttggatttaactgccagttctgtcttagacaaatatgtaatatctctaagccattctttcttcatctagacaatgagaataatggtacctatgttttaggaaagttttgacattaaatgagagtgtatatgaaatagttggcacagtgcctgacatgtaagtgcttaataaatattaactgttgtaatgatgatgataatgatgaccattgcatggctgtcacttttctggttcaatttaaccaatatacactgtttttagagttacaaaatgttagagccctgaagaggctacagatgtagtttaaatgagcactctcccagctgttttctacatatcacaagactcttgcaaacagaatttaacaagttaacagcaattattttaaaaaaggattttttttccaaaataaacttggaaaagccagtctattgtatctctacttggaaatttataatgcatattggcatgttaaacgctttaaggagctcataccttaaatgatccttagcagctatcaaaattacttaaccatagaaaccttttctgtgggaaatacctacttatgttttgcaaaatacagtctgggaaatgctatctagaccaggcactttcttttattaagaagcatctcccccaccccactccatagaaattgatgacttgccttaggtcatacagctgtagactcagtttggaactcaaagcttttcctagtcttgtttcacctgtttatctaatcaagttcggatatagaaaggaaaattatttgaattggtggaaaattagaggtggttctattatgtagaaggaaagaggaatgaaagataattctaatatagtgctgcttatttttgcctgattgtaggagaatccaagatacttgtttaaaacacagattcttagacttctgtaaattttaatttgtagggatgaggtaagattatcattgctggatcatacgtgaaaaggtccaagattttcagagtttgatctttataaattgtgtcttatgattctgagtaactagataattggtgttaactttctgtattgggagaaagatgattaaatatggaccagattctatcccaagaaatgctgataaacctcatttcatgtacatttagatcttaaagaatttggtttacttgcttatttgttgtctttcttttcaataccctctagtagatagtgcctaatgcaattatagaaatctgtctattaaggtagctgtaaggtcatttagagctatacattttaatcagcctaacaaattatcaacgagtttaagctctcttttcataaatgactcattatattcactttttactttttgaccatgacgttgttggatttattctaaagggatagtatacctataatttaaacttaaatctagatcttatgtcagaaaacatctaagaatttgtaactggtaaatgttgataatatttagaataataacattgcctttataactgatacctattcaaggcctataaagacagtaagaattccctatgaaatgagaattagttctggtgtatattcagatgtctgctttcaaatattcctagttaaatcagccagttgaagaaagtcaaactgtatattgcattaattaaattattaagatttttatgatcttacgtggtgattttatgtgttacagttgaaacatttccgagacatgttgtatgcatatcttttctttaagatcttgacatttatggccaagctacgtacccatttttgcatttaccatgttgtcttttacaaggtgtcaattagcatgtattttctatgtattaggttaaagatgggtttgtgtggtttttactttcaaagtaaattgttctccaatttattttgtaacctacttttattttgtaacctacttttctttcctgttttgacttcagagaaaccaaaccaaataaaattatagtatgaaggtccttaaaaatattcctatctgttgacacagtgtttcatgtctggaagtgcagtctgaataaataatttgaaatacagacaaagctttgtataccaaggtattaatcccagtgatatttaatagagtcgatggttgattaaataggttgtacagccatatgatgaaatatgaggcagataatgaaacttgtttactgaatgtaaaaagttttgttctttaccccattgtactccctctttctaggcataaccactgtatcactctagacattttcctttatgaaaaatgttttacatgattgatgttttgcatataatcttacatttaaaagggagggggtgaacaaattataaacatataaatgtttttaaacatcactaaaacgattggaagaaaatacatttaaatgttaatgctgttcacagtagcatgtgccttgtagttccagatacttggggaactgatgcaggaggatcccatggggccaggattttcaggctgcagtgtgctatgatcacacctgagaatagccactgcacttcagcctggcaacataggagaaattgtctcttaaaaaaaaaaagttattgctcatctcagggcctgttatataccttcagttaccctccatagcccctcaaataattttatttttaagaaaagctcatggaaaaatgataatctttctacatcaaaagggctagaaatctaaaagtctgagaaagagaatgcttgagggaccctctccttcctcacggttattaagtgttagttaaagctgtttttttccctaaaaagcaaggcaatgaatgaaaagataaggataatagtagacaataatgtcaatgaaataaaatgaggaatggaaaattttttaatggaaatttgacttggagtgattgtcataatacctgtaatggagttcagaggaagcaaaaatagtcttcatgagattggttgtcttgatcatttgaaattgggatttgttttatccgtactgtgtaaaatagcttttcagccactatactaggtgaatatgaagaaagttttctgttctggagcattttgatttcatagttatgccaaaaagtttttgcagataaaaagtcatgaagacagcattcagacctaggatggttgtactcaaaagcacttgccgtaggtgtacataatgtttagcattttactttctgggtaagatgtactgcttcagtttggaaataaaaaatgtatcttaggttacattgtcatcattactacttttccttttagaaaagaataatttatctttctcaactatatgaaagggatgaacatttctctgtgttcctactcattttgcattagtttctataaaattgaagtggattgctagcaaaagggggggaacccaattacagttaagtccccaaaactgcattttgactccaaatcttcagtgtgatgtgtctagaaaggtgattaaacacataagaatcctgaatgatacggttaagctttgtgtccccacccaaatctcattttgaatcataatcgtcatgtgtcaaaagagagaccagatggaggtaattggatcatgggggcagtttccccccatgctgttctcgtgatagtgagtgagttctcacgagatctgatggttttatgtgtttggtagttcctgctgcattcattctccctcctgccgccttgtgaagaacttgcattgtttccccttcgccttctgccgtgattgtaagtttcttgaggcttccccagccatgcagaactgggagtcaattaaacctctctcctttctaaattacccagtcttgggctgttctttatagcagtgtaagaatggactaatacacggagtggagggcggagagtttgttcaatccagcgtcctgtatccctcagagattcatatgcagtaaatctgaggtaggacccagaaatctgtattttaacaagcacttctggtaattttgagatagatgatccctcaactactcttgaagaaactggtccaaaagttcttcctcccagtccacatagtaaatgtactaccaaggtttgagagatttctttataagtcctctcagaaagtctttctagcatgcttgacataggttgctgtttgcctatttggcttagttaaatactacatacccattcttgtgtaattccaaactgttagaaaagcgtatactaatccagtatttctgtttaaattcagtatgaacagactcacatctatcattagggaaattctgaaatcacttgagaaaaaagtttcctttatgttgtgaatggaaaacaatacacagtattaaataatataataagatctcaactgtatgacaataggaggaacaaaagcaccataaggaaatgaaccaaaatgttcattttctttagttctcatgacacagagaatttattttcctctgcttttctgtattttccagtattatttcttataaaaagaaacatattaattttaaaaatgcccttctttggcctggtgcagtggctcacacctgtaatcccagcactttgggaggctgaggcgggcggatcacatgaggccagggatttgagaccaggctggctaacatggagaaaccccatctctactggagaaaaaaaaaaaaaaccctttttctgtcttcacagttaacttgattatatagatgaaagtctaacaatttcatattacttttcttttatacttagttgcacagtatgctatgaggtctgtgaaatgcatgtacatttctcattggaatattttattgttatgtgtgtagatttttgaatatagcattttgaacataatggtcacgttggagcaattgccatttcaaatcattaggaacactcaggtcactttggcatggagctattttgtaaaagacgtagaagccatttataaactttggtttgctttttaaaaatttatttcattctgaggcttatccgtgtaaaattaccaaaatgattgtggttagactctacattgtcacagtatttaaatgtgcacaatattccacttagaaataatgtcagtactaaaagtagtagagggctttgatagcaatattaatacatcgttaagcccttctcattaaacagtgtaatagtcttgttgaagtttgttaggcattttaaccactactaattaaaaatagacctactgactagtctgttttactgtgctttattgtgtcttggatgttcattcagatacttttgctgttgagaaatcaaatcgtctcttatggttttaattacaaaatacatattagagggatacagttcttagggctgtgatttttaatttgtgtaacctttttttattttggaaaggaaatttcagattttttctagtaatttttcatttgtgagtgttgttttctagatacagaaaatgtacctagatagatgatcacattttaggatattttgcttacgtgttattttatatttatatactataataccattgtatagttcagaacaagaaaatatcttgataaatcatctgctactgtgaggcagttaaaaaaatttgaggctcactgaaaatgtgtgacttgcccactgtctcatattgctagtattggagagaaaactagaatctaggcctttattttcctgatgtaatgattttagctaattattatttattttcttaaatcattgcattaattcatttttcacaagtagagcctatatcagtgtttgcaataattaaattttaagtatatttctataattgtaaataaaatcctgacatttgttacaggatggggttttctttcatcatatttttataataaaaattaagcagttataaaaataaatagcctagtttttcaattggtataagctggctttattttatactgctaataaaggcacattatgttcaagcattgcaattatcgctgaaatgcatgtccattaactgaaacattaggctgagtatataattactgtctagagccaatatctttgtgaagctgtacctataatgctattaaactataaacaatatttgtaaactaatatttaaataattcagaattgatataatctttttgtaaacttaaaaatgaatgctatatacatttagtttgattgtttttacgtgcttagaaaaatatgggaattctcaaagataattgaaatatgtgtcttgagatagatgaatttttaatatagttgctataacctaatacctattattctttctgaagtcttttgttccatattttttattgtggtaagaaatatacaacataaaatttactatcttaaccattttaaagtatgcagttcagtgatattaaatacattcatattgttgtgcaaccatcaccaccattcatctccagaagtcttttcatctgcacaactgaaacactatacccattaaacaataatttgcatcctcccaccagtccttggcaactaccattctagttattgtctcagtgattgtgacaaccctaggtacttcatgtaagtggaatcacatggtattagtgtgcttgtgactggcttattttacttcacataatgtccttaagggtagcttatattgtagcagacatcagaatttttttctattttaagactattattcccttgtatatgtatatcacattttgcttatccattcattcatcagtagacacttgggttgcttccatgttttagctatcatgaataatgctgctatgaatatggatatacaaatatctcttcgagatcctgctttcaattcttttggagtagaattgctgcatcatgggtaattttgtgtttatttttttgaggaacctccatgctcttttctacagcagttgtaccacttaatatttccaccagcattgcacaaggattcgagtttctccacatcctcaccaacacttattttctactttgttttactgaagtcttttattcatacaaaatatgtataaattctgtttacaaaaaaaatgatgtagctatagtcaagctttttaacttgaaaggtcttttgaggcctatcaatgcaaaattgcttttaaatctgaatatattgactattgaaatctactgtgtcacacgcatccgtgtcatgcgcgtccgtgtgaagagaccaccaaacagcctttgtgtgagcaacaagtctgtttatttcatctgggtgcaggcgggctgagtctgaaaagagagtcagcaaagcttggtgggattatcattagttcttataggttttgggataggcagtgagttaggagcaatgttttacgggcagggggtggatctcacaaagtacattctcaagggtggggagaattacaaagaaccttcttaaggatggggagaattacaaagaacctttttaagggtggggaagattacaaagtacattcatcagttagggtggggcagaaacaaatcagtggtggaatgtcatcagttaaggctgttttcacttcttttgtggatcttcagttgcttcaggccgtccggatgtatatgtgcaggtcacgggatatgatggcttagcttgggctcagaggcctgacattcctgtcttcttatattaataagaaaagcaaagcaaaatagtggtgaagtgttggagcagtgaaatattttgggggtggtatggagagagaatgggcaatgtttctcagggctgcctcgaggggattaggggcagcatgagaacctgcaatgggagagattcaactgaagaaagattttggggtaaggggtgatattgtggggttgttagaaggagcgtttgtcatatcgaattattggtgttggcctgaatgcggttttgtatgaattgagaaactaaatgaaagacacaaggtccgaataaaagaaggagaaaaataggtgttaaaggactaagaattgggagtacccaggacgtccaattagagagcgtccaagggggttcaatgttattgtttgcttggttggcgactttcaaggctctatccaagtttttggggtacacttcaagttgggctggtgtctggaatgagactggagcctaataaaaaggagtgtccatgcaggagcttaaatgggctgtactctgtagcatctcgaggacaggatctaattctgagaagggcaagaggtaaaagtactgtccagtcctttttaagttggaggctgagcttggtgaggtgtgtctttaaaagaccattagcccattttacctttcctgaagattgaggatggtaaggggtacaaagtttccactgaataccaagagcctgagaaactgcttgggtgatttgactaatcatggccagtccgttattggactgtatagaggtgggaaggcaaaaccgaggaattacgtctgacaaaagggaagaaatgaccgcagtgaccttctcagaccctatgggaaaggcctctacccatccagtgaaagcatctaccgagaccaagaggtattttagtttcctgactcgagccatgtgagtaaagtcaatttgccggtcctgggcaggggcaaatccccgagtttgacgtgtagggaagggagggggcctgaacaatccctgaggagtagtagaatagcagatggaacattgagaagtgatttccttagggatagacctccacaatggaaaggaaatgagaggttctaagaggcgggctagtggcttgtaacctacatggaagaggttatgaaatgacgatagaatagaatgggcctgtgaggctggaaggagatattttccttggtccaagaaccatttgccttgtgtgggaagagattgataggtggaggtttcggtgggagagtaggtgggagtgactgatgagaaggaggaaaactggccgtgagggacagaagttggaatgctagctgcttctttagctaccttatcagcataagcgttgccctgagtgatgggatctgatgccttttgatggcccttgcagtgtatgactccagcttcctttggaagtaaagcggccttgagaagagtttttattaaagaggcattaatgttggaggacccttgtgtagtgaggaaacctttttcagcctatataacagcatggtggtgcaggatatggaaggcatatttagagtcagtataaatattgacacatagtccctttgcaagagtgaaggcctgagttaaggcaatgagtttggcttgctgagaggtagtggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggattaagaaaatgtggcacatatacaccatggaatactatgcagccataaaaaattatgagttgatgtcctttgtagggatatggatgaagctggaaaccatcattctcagcaaactatcgcaaggacaaaaaaccaaacactccacgttctcactcataggtgggaattgaacaatgagaacacatggacacaggaaggggaacatcacacaccggggcctattgtggggtgggggaagcgggagggatagtattaggagatatacctaatgttacatgatgagttaatgggtgcagcacaccaacatggcacatgtatacatatgtaacaaatctgcacattgtgcacatgtactctaaaacttaaagtattaaaaaaaaaaaaaaaagaataggtcggccttctggcccctctgggtctagggtggtaaagcatctaagggttgctgctaagcgggccatgaactgggctgggttttcgtctttacgttgggtattttctttaagtttgtcataattaacagctttgtaagctgccgttttaagcccttcaactaggcaggaaaccacgtaatctcgcttagctatacctggggaatctgcctgatagttccattggggatcttcttggggaactgctctcatgccttccgggaggtctggctcatgaagccagtggttatcagtgtgagattgggctagagaaaaaagtctttcccgttcatctggggaaagggtagaagttaggatgacatttaagtcactccaggttgaattgtaggacagagttagatatcagaattcctgtgtatatttagtggggtctgatgagaaagagcctaaacgctggctgatttgggaaaggtctgatagagaaaaaggcacacgtaccctgactgttccttcagctccagccaactctctaagaggaaattgtcgggcagtgggggagagctagttgcagaaagaaactgtaaaccagaccaggtgtggagaggggaggtaatagaagggttatagggtaggggagcagaggctgaagaagagttggagcctgattcagcctggcggggagcgacttgaggaggagcagtctgggaaggaagtgagaggtcagatgggtcagtagaaaaggaagattcacaagactcagcgatgcttggggttgggactgaagggacaggtgggagggaaagaaggaggatttgggacaagttgcattgggaacagagactagggagggaacgaagtgtgaaaaatgcctggacgtaaggcatctcagactatttgcccatttttcgacaaaaattatctaggtctcgtaggatggagaaatcaaaagtgccgttttctggccatttagaaccattgtcgagtttgtactggggccaagcagtgatgcagaagaaaataagatgcttagattttaggtcaggcaagagttgaagaggttttaagttcttgagaacacaggctaaggagaagaaggaggaatggagggtggaagtttgcccatagtgaaggaggcaagtttaaagagaagggtagatatggcgaagccggtggggagcaaccctgggctgcaatgtgggtgagcagccaaagcaggcatccctgcaattgacttgccaccaagggaatatgggtaaatgaccaaggcaggagtccctgtggtgatcagacaccagtggaatatgggtgaataatcaggcaggcatccctgcaatgattaaacaccaagggaagactgtcttcctgaatctgtgaccggtgccggagttttgggtacacagataaaatgtgtctcctttgtctgtactagagagggaaaagatctggaattggaaggacagggagattgaagggtagcgagagaggctggagaagagagtgaaaagaccgcttactcgaaattggtgagatgttccttgggctggttggtctgaggacccgaggtcataggtggatctcttcacggagtgagggtgaggacaggggactggtctcccaaaggagtccctctgacccgggtctttggcaccaaatgtcacggacgtccgtgtgaagagatcaccaaacaggctttgtgtgagcaacaagactgtttatttcacctgggtgcaggcaggctgagtctgaaaagagagtcagcaaagcatggtgggattatcattagttcttacaggttttgggataggcagtggagttaggagcaatgttttgcgggtagggggtgaatctcacaaagtacattctcaagggtggggagaattacaaagaaccttcttaagggtggggaagattacaaagtacattcatcagttacggtggggcaaaaacaaatcacaagggtggaatgtcatcagttaaggctattttcatttcttttgtggatcttcagttgcttcaggccatctggatgtatacaggcaggtcacaggggatatgatggcttagattgggctcagaggcctgacatactggccttatgttttcaattaaatgtaccacctttctttactgttaccacatttgtaagcgtgttttgatgactattaaatatagatgcttcccaattttctatagtgctccttttcaatttgtataatttacaggttattaaatggcattacttatttatttggcactgctaaatgttcatttcaatgccatggcttgggcatgttatctccaagctatttaatgaggaagacagagtcaagagacttcctgcctcattttgtccctgccactaaggctgcaccttgtagtggaaatcattttggctttgaaatctgaacttgatttcagtgccaatctttatcacttagtaggtttgtgacagttaagcaatttacctaacttttctgcatgtcagtttccctaaataaaacactgctggactgtttgagggttagagataataaatataaagagtgtcaaacaagattggtgttctctaaatcatagctattaacattgctttacttgtaactttgggtaagttgcttataatctaaatcttagatttacttcatgtaaaatgaaaggattgaactggattggtataaatgggtcttaggacccttgaggtaatatacagatatttttattttgtacacttttgtgaggtttgtagtgttcatcagattcataaagtgatttgtaaatcccctgaataaaagggtaaattctaaactaggtgatctccaagttcttttcttatgataaaattttctacctataggctacatagtcaacttcagtgtgactgaggttagggaaattatttttgaaaaattttttgaatcaggacctccagaatgtaaatgtttgttgctgttaaaagtaattattatagtcttctagcttttggtaactgatggaaacacttgtatcaagtaaccatcttgctgataacaattataacctctggacaaaacattaaagaaaaagaaacactgtttgaaggcactggagagtgatcaaaagtaggtaggaattggaggtaagatgcacctttatggaaaggaaccaaactggttgaggtctacatttatctgacttattctttaaataaatgcacaagtttatgcagtatatgggaatacagctcaagcagaaatcagccctctttttgatgagttagaggatgatatttagggcaatgaaagcaggtgaaaaattgagagtgatcccagaaaggaaggagccacaaagtgagggaacccccaaatttgtatgcaggtttcccccacaaccatgcgggacaagattccaggaaacccagaggcaatgaaggaacaataggcagaaagcttaaagaattaaagagagatcttagcagttgctggagatggactttagagttcccaccctgctaaaatagaggaacttggtaaatgcctcaggcttgctacggaaaacctgaaatggccacacacagtatggatcttatcctatgattaagatcttcacgataaaaccaaagccaaactgaaatagctatcaatatgttctaacctttaagcaagcccttacaggttaaggtgatcctccattaattcagttgtctgtaagaataaaattcattattttctggaggaagctaatacaatacagagttccaagattatatgaagtgcccagccagaaattaatagacaagtgaggaaataaggaaaggcaactcattggaaaaaaatctgcagaaagagaccagcagttcactcagatgctggattactagacaggtaccttaactataataaatatgctaaaaaatctaagggggaaaaatgaggaaattcccctatcccccacaaaaaaccagtatcaggaatgaaagagggtacatcagtatagatcctatagatgttaaaaggattattagggagtcttatgaataagtttataccagtaaatttgacaacttagagaaaaatgacaaaatcttttaaaaacagaacttatcaaaactagtaagagaagaaatggaaacttgtaagtgggtttacattttaataaaaggaattgtaatacgtaatttaaaatcttcatacaaaggaaattgcaggcccacaggatttcactgacgaattctatcaaacattggaggaaaaaataataccactcttacataaacattcagaaaaaagaggaagagaagaacttcccagtttcttttatgagtctaatctaactaatacaaaaacctgacaagggcatttccaaaaaagattgcagactaacatctctcatgagcacaaatacaaaaattcccaataattttaaactttacccaaattactaggtttcaaaaagaattcattagtttttaagattaattcaactaacagtagatattgtactgcttgtatttgcttagtttgccatcacataagaatgtgaataaatattgatgttattatccaatttattatcagaaatgaccaggtatcatatgaggataaccaactagtatgttttttggcctatatagtctcccttagtacttgtataatgggtagttattcgttctgttcttttttttaatatgtgtttaaaaggaattgaattttaacccatttttcatgataattatggaaaattattttttccaatgacatattttggaaactttcaaacccacagaaaacttaataatttaacaaatgccttcatactgtgcattttgccacatttgttttacctctctctttctacatctatatatacatttatgcatacatatgatatataacctttttttggtaaaccatttgaaaataagttacataacatcatgagagttaacccctagtattttttatatacctcctgagaacaagaatattctcatacacaaacgcaatactatgattacactcaaatgttgtaatgatataggaatattatttaatacatagttcctagttgtttctcgtttgtcccagtaatgtcctatataactttaaaaaaaatatctgaaccggacatgcattggatttaatgtctctttaatctaacatcgttttgctaccttttatgttttttcatgattttaacatttttgaaaagtccaagccactgttttgtagaaagtcgtactatttgagctattctggttattgcctcagtaatatatttgtttaaacaaataatatatttgtttaaacaaattatataatttgtttaaacaaatatattgtttatttgtttaaacaaataatacatttgtttaaacaaataatataatttgtttaaacaaatatatttgccaagaatactgtgtggctgaggaaagataattcttaataaattgttttgcaaaaagagcacttcagagcaatgaactatggagcaaaagacaaaatgacggaaacagcaaccttaagttcatatggttatcctggagatactgattctgcattgcattgtcgttgcttgcttttcatttagctggtcttacatgaaggaaatgaactgatatttagtatttatccaaggtaaaattctatagctgtttttgaattgccagtctttttggtttacataagcccttgctgaaaacgaaaaatctgctgcctggaatctatatattatagttattgtacatttcctaggattcttttgagaaaactaattttgatcaagattctcactctttactgagaagaatcattgggcaaagtatctcttcatcttttaagaagtttgcttctcataagttaaagtagaaattgttaaatagtcaattgaaacattttcagtggtcatacccaaagagaaagtaataacagtattatttcttgtttaagtcattatttgctgttcctttttcagttacctcataattttcatgacagttttaataggtagaaataattactttctaacttggactttttctacgagttgaatattttcttttagttgagaagtttaaagtatacttttaaaaacaaatgtatatggttgcttgcagatacgatcaaatcacagaatagttacattttaattccttctatcatacattttaatttctcctgttgtgttaagatagtctgtatagcttcattgttcatctgtcagcttttcagttaacccaaatgaggaaacagtcactttttgaaagatatttagaagctttgaatgtctagtttgactttagagttaaatctcagaagacatattgcattgagtgtatgtgtacgttcagcttagaactgccttacactgctgcaataatactgatgcacatttagttgatactgcttacagttccttatgaacttgttcagagcagttcccagaactcaaggataatctcaacattcatcacccaccatatggcccaaactgctgctttcagcccaacttccagccttcgtggagcatcagactgaagcagagctctcaactattggacttctaactgtgatccagccgactttcctattgagaaaccacatagcccctttattggttactacctcatctttttttcttgttcataaccagtcttcttagaaatgttgtctgtaccacttgtctccatgccctcatcaactgctcatttctcagcctgttctagatatttttttaacatactagtatcaggttgttgcagcactattagttgaaaaggctatcctttcttccatttaattatcttggccttttttgaggaaatcaattaactatatatgtgtagatctttttctgaactctctattttgtcccattgatctttaagcctatcctatcccaatatttggattactgtagcttctaataagtcttgaagtcagatagtgtttaaacctccaaattcgatattcttttttaaaaatggctttggctattttagttttgtgcctctccatgcaaattttagaattaacacatgcatttctacaaaaaatagaagagtatggtgtttattggaattgcactgaagttacagatcaatttgtcttaaaatttgacattttaagaatattgagggtttttgtattcttcctgattctctttgtacttggttctctcagttgttgagggagaagtcttaaagtgtctcttactatggatttatcttctcacacttctatacagtttcactttatatattttgaaactctgttgttaagtccacaaatttttatatccttgatgaattgacctctttattattttgaaaagaccctctttattcatgctaatattctttgctccaaaatctactttgtttgatattaatatagcaacttctattttcttttgattaatgttggcatggtatatctttttttcatttttttatctttaacctatctatgtctttatataaatagggtggtaggcagcatatgattcagccttctttctttctttatcctagacgaaaatctctaccttttaattgagctgtatagaccatttacatgtactgcaattattagtatgcttggatttaatctactgttttccctttttatctgttttattcaatggatttttgcctttctttggatcgaacatttagtatttatctccctttttgaacttactagctataactattttattattttgttagttatgctttagggtttatagtatacatccttaattatcactgtcccctttaaaatgatattataccattttacttatcaaaaaagaactttccagcagtgtacttccatttcctccctggctgaccttgttctattgttgtcatatattttacttatatatacattataagcctcataatactgtggtattacttttgctttaagaagttaattatcttctgaagagatttaaataataagaaaatcagtattttactcagatagttaccatttccagttttcattccttttgtgcagatccagagtttcatgtggtatcattttctttctttctgaagggtttcttgtaaaatttcatgtattagagaaatcttaatgacagattctttcagctttcatatgtctggaaaaacatttatttttgcctactgttttggaagatgttaacaatggtatataattctaggttgatagtttttttcccctttcaatacattaaagaagttgtgtcattgtcttctcacttgtattttttatgatgagaaatctgctgtaatccttttctccatttcactgtatgtaatttgcctttttactctgtctgctttcaaaattttttccttcttactggatttaagcaatttgattattgtgtgccttggttgttttcttatatttcttgtgcttggagttgagcttcttgaatctgtaaattttgagtttcatttgtaaaatttggaaaacttttagcttttatttcttcaaatattttttctgttcctcccccttcactttcttgaagactgcagttacgcatttattagaccacttgatgttgcccaacagcttgctgatgtctttgtttctgtatgtactttactttggataatttctgttgctgttgataagtttactaataccttcctccacaatgtctgatctcttattaatcatatccagtctattttttaaaatctcagacattgtgttttcttctcaggcagtctggtttgggctgtttttatattttctatgtctctaaatatattttctaactttttgaacatatgaaatacatattatattggttttaatgtctttgtctaataatttaataatctgtaaatttttcttctctttgcatgcctagtaatttttatattggattgcagacatatttttttgtattcctataaatatttttgagatttgttctgggaaacaaattacttggaaacagtgtgtttctttcagatcttgcttttaaactttattatgcgaaactagaaaagcacatagtctaggactaatttttctcctatgctgaaacaaaatctttcttagtacttgatgcaccatgaattagaaggttttctgtatctgttgatatagagattatttctggccttgtatgaaccctagatactattctgtctaatccttctgatggttttctttccctctgtaacattggatgcatgatatctcacatgcatgtgttgattgatccccttcacatctctagacttctcattggagttctctcctctccaggacttttgcaaactctagctactttgacctctggatttcgctttccatctcctcaacttaaaaagagtctgctggattccactaaggttctgcttttctggggcaatcccagggctcacccttgtgtcctgtttcttagggatcactgctttttttttttttttttgcttgactccaatgtcttgaaggttgttgtttcatatatttaaagtgtctaggtttttttagttgttttaggcaagagggtcaatactccctgttactctatattggcacaagttttaaatttttttggaaaatttttcaaaatttctataagtgacaaagctattcttagcttacataccataaagacataagtgagaggcttagttttgcctgtaatctgtagtttgctgacttctctttagaccatttttctttaatatgattatcaatatggctaccaccttgccatttgttttctatttatcccatctggtttttgttcttttttcctttatatatatttttgttgttgttatactttaagttctagggtacatgtgcacaacgtgccggttttttacatatgtatacgtgtgccatgttggtgtgctgcacccattaactcgtcatttacattaggtattgttttttgttctttttgagtattttttactattccattttatcttcactattgacttattagttgtacttctgttttatttgttatttgtttccctgtgatttataatatgcatttttttatgtcttctttaaaaaaaaaagcgggatacacgtgcagaacgtgcagttttgttacataggtatacatgtgccatggtggtttgctgcacctattgacccgtcctcttaagttccctccccttgcccccccaccccccaacaggccctggcatgtgttgttcccctctatgtgtccatgttttctcattgttcaactcccacttacgtgtgagaacattcggtgtttggttttctgttcctgtgttagtttgctggaggatgatggcttccagcttcatcccatgtcccagaaaaggacattatctcattccttattatgtctgcatagtattccatggtatatatgtaccacattttctttatccagtctatcattgatgggcatttaagttggttctatgtctttgctattgtaaatagtgctgcaataaacatgtgtgcatgtgtctttatagtagaatgatttatattcctttggatatatacccagtaatgggattgctgggttaaatggtatttctggttctagatccttgagaaattgccatactgtcttccacaacggttaaactcatttacattcccaccaacagcgtaaaagcattcctgtttctccacaccctcgccagcatctattgtttcttgactttttaataatcaccattctggctggtgtgttatggtatctcattgtagatttgatgtgcatttctctgatgatcagtgatgttaagtttttttccatatgtttgctggctggataaatgtcttcttttgagaagtgtctgttcatatcctatgcctactttttgatggggttgtatgttgttttcttgtaaatttgtttaagttccttataaattctgaatattagacctttgttagatggatagaacacaaaaattttctcccatctataggttgcctgttgactctgatgatcgtttcttttgctgtgcagaagctctttagtttaattagatcccatttgtcaattttggtttttgttgcaattgcttttggcgttttcatcatgaagtctttgcccatgcctatatcctgaatggtgttggttaggttttcttctaggggttttatggttctggtttttacatttaagtctttaatccatcttgagttaatttttgtataaggtgtaaggaaggggtccgatttcagttttctgcatatggctagccagttttcccagcaccatttattgaataggagatcctttccccattgcttgttttttttcaggtttgttgaagatcagatggttgtagatttatggtggtatttctgaggtctcttttctgttccattggtctgtatgtctgttttggtaccagtaccatgttgttttggttactgtagccgtgtagtgtagtttgaagtcaggtcgtgtgatgcctccagctttgttctttttgcttaagattgtcttggctatatgggctcttttttggttctatatgaaatttaaagtagttttttttctaattctgtgaaaaatgtcaatggtagtttgatgggaatagcattgaatctatgaattactttgagcagtatggccattttcacaatattgattcttcctatccgtgaggatggaatgtttttccatttgtttgtgtcctttcttatttccttgagcagttgtttgtagttctccttggagaggtccttacatcccttgttagctgtattcgtaggtattttattttctttgtagcagttgtgaatgggagttcattcatgatttggctctctgctagtctattgtaggtgtaaaggaatgcctgtgatttttgcacattgattttgtattgtgagactttgctgaagttccttatcagtttaaggagtttcggggctgagatgatggggttttctaaatataaaatcatgtcatctgcaaacagagacaatttgacttcctttcttcctatttgaataccctttatttctttcccttgcctggttgccctggccagaacttccaatactacattgaataggagtggtgagagaggatatccttgtcttgtgccagttttcaaagggaatgcttccagcttttgcccattcagtatgacatcgactgtgggtttgtcataaatagctcttattattttgagatatgttccatcagtgcctagtttattgagagtttttaacatgaagggatgttgaattttatcaaagttcttttctgcatctattgagataatcctgtggtttttgtctttgtttctgtttatgtggtagattacatttattgatttgtatatgtggaaccagccttgtatccgagggatgaagctgacttgatcgtggtggataagttttttgatgtgctgctggattcagtttgccagtaattaattgagaattttcacatcaatgttcatcagagatattggcctgaaattttctttttatgtcatgtgtcttcccggctttggtatcaggatggtgctggctgtataaaataagttaggaaggagtccctccttttcaattgtttggaatagtttcagaaggaatggtgccaactcctttttgtacctctggtagaattcaactgtgaatccgtctggttctgggctttttttttgttggtaggctatgaattactgcctaaattttggagcttgttattggtctattcagggattggagttattcctggtttagtcttgggagggtgtatgtgtccaggaatttatccatttcttctagcattttctagtttatttgcatagcggtgtttatagtattctctgatggtagtttgaatttctgtgaggtcagtggtgatatcccctttatcattttttattgtgtctatttgattcttctctcttttcttctttattagtctagctagaggcatatctattttgttaatttttttttttaaaccaggtcctggattcattgatttttttggaggggtttccatgtcttgatctccttaagttcttcaattcagttcttctctggtcttagttatttcttgtcttctgctagctttcagattagtttgctctttcctctctagctgttttaattatgatgttaggatactgatttgagatatttctagctttctgatatgggcatttagtgctataaatttccctctcaacattgctttagctgcgtcccagagattctagtacgttgtctctttgttctcattggtttcaaagaacttgattcctgccttcatttcactgtttactgaggagttattcaggagcaggttgttcagtttccatgtaattgtgtggttttgagggaatttcataatcctgaattctaatttgattgcactgtggcctgagagactgttatgatttccgttcttttgcatttgctgaggagtgtttcacttccaattatgtgattgatttcagagtaagtgcgttgtgtcactgagaagaatgtatatcctgttgatttggggtggagagttctgtggatgtctattaggtccacttgatcctgagctgagttcaagtcctgaatatccctgttaattttctgtcttgttgatctgtctaaaattgacagtggggtgttaaagtctcccattattattgtgtgggagtctaagtctctttgtaggtctctaagaactcattttgtgaatctcagtgctcctgtttggatgcatatatgtttagaatagttagctcttcttgttgaattgttccctttgccattacgtaatgcccttccttgtctctttttggtgctttgttgttttaaaacctgttttgttctgagactaggattgtaacccctgcttttttttttttttcttgctttccatttgcttggtaaattttcctccatccctttatcttgagcctatgtgtgtctttgcatgtgagacgggtctcctgaatacagcacaccagtgggtcttgactctatccagtttgccggtctgtgtcttttaattggggcatttagcccatttacatttaaggttaatattgttatgtgtgaatttgatcctgtcataataatcctagctggttattttgcacattagttgatgcagtttcttcatagtgtcattggtctttatatgttggtgtgtttttgcagtggctggtaccagtttttcctttccatatttagtgcttccttcaagagctcttgtaaggcaggcctggtggtgacaaaatccctcagtatttgcttgtctgaaatggattttatttctccttcacttatgaagcttagtttggctggatatgaaattctgggttgaaaattcttttcttgaagaatgttgaatattggcccccactcttctggcttatagggtttctgcagagagattcgctgttggtttggtgggcttccctttgtaagtaacgtgacctttctctctggctgcccttaacatttttttctgcatttcaaccttggaggatgtgacaattatgtgtcttggggctgctcttctcaaggagtgtgttagtggtgttctctgtatttcctgaatttgaatattggcctttcttgctagattgggggaggtctcctggataatatcctgaagtgtgttttccaacttggttccattctctctgtcactttcaggtacaccaatcaaacgtaggtttggtcttttctcatagtcccatatttcttggaggctttgttcattccttttcattcttttttctctactcttgtctttgtgacttatttcagtaagttgatcttcaatctctgatatcttttcttccacctgatccattcagctattgattgtatatgcttcacgaagttctcctgctgtgttattcagctccatcaggtcatttatgttcctgtctaaactggttattctagttagcagctcctctaaccttttatcatgtttcttaacttctttgcattgagttggaacatgctcttttagctcagcatagttttctgttacccatcttttgaaggctacttctgtcaattcatccatgtcatccttcatccagttctgcacccttgctggtgagatgttgcgataatttggagaagagtcactctggccttttagattttcagtgttttttcattgattctgtctcatcttcgtgagtttgtctacttttgatctttgaggctgctaacccttgaatggggtttttctgtgggctttttttttgttgttgttgatgctcctgttgttgcgttgtttgtttgtttgtttcaatattcaggtccctcctctgtagggtttgctggggcttctgtaaggtttgctgggtttgctgggggttcacttcaggccctcttcatccggttcactcccatacctggagatgtcactcaacaaggctggagaacaggaaagatgggtccctgctccttctcagatctttgactttgaggggcgccaacctgatgcccgtaggattgttcctgtattgggtatctgccaacccctgttggagggtctcacccagttgggtggcacagggatgtggacccatttaatgaagcactttgtcccttggtggtggggtgtgcttcactgggggaaacccgctcatctgggctgcctggattcctcagaactacgaggaggaaaggctaagtctgctggtccgcaaagactgtggccatccttccccctaggggctcaggcccagggagatctaggttctgtccctgaccctctggctggagttacagagttcctgcaggggaaccccacccagtgaggaaggatgggtcagagtcaagcctgaaaaggcactctgaccacagtctgccacagccggtgtgttgggctgtgggagacatgtcttcgtaccaagccttccagcctccctggtcccaggaggggaaaagtgcagcctggagctatacagagggatgctgccttctcctgcccagggaacttagcgtgttaggcagttgtgagtcccagtgttgtttcatacgcctcccacaaggagctcaaatggcttagacagcaggcaaccgcagctatggtgctggttgcccctccccctgggagcttggtaggcttaagcagattccagctgagaggcggttgagaatctgtagggctctggggttgggatgctagccccagtggtgtggttttgtgagtgagatcatccaatccatgggttgcacagttctgtggaaaaagcacagtttcccttgctgggtagcatgctcattcactgcctcccttcactggtgggagggggctcccctgccccatgtggctcagatgggccactacaccacattgttcttccttcctctctggatcacactagtctcctagtcagttctgatgagagaacctggataccttggttgccagtgaaggattcacatgcctattatagttctttttaatgggaccctctgaacgccgctgttctgtttctagtcggccatcttggccctgcccccaatatgcatctttatctacttcctcaatggtattacagtacttcacttctaatgtaagacttttataacttttatacttctgtcctttgtactattgttcttatagattttacatctacatcaaacctgtcaaaacattattattttttaattgcctattaagaaattgaacagtgagaggaaaatttttgtcacatgtgtgctatttacacttcttttctttgtatagatctaaattttgatgtgatatcctttttattttctatttgaaaaactcttcaacatatagtacagatttgatgaaaatggattctctcatctactttttttctaggtgaaaaatttattttctccttaattttgaaagacattttcactgggtataaaattccagtttggcattttgtttttctttcagctatttaaaagtgtattccactgtcatctggctttcatagtttctgacaagaagtctgtgacaattccagaactctaccctgaaagaacaagttaccttagactctgaactcttatctctgtcttctcaactcagtgaaatttctgtactttacttaggatcctgcctttttctctgtagtttggaatgctcaccttattttctgtctcatacattctagtccttcactggctgtttgctcttggatcaaaagtgttacttcatatatttaatccagttttttgttgttgcaaaaatcaagagagtaaatctggaccctgttactgtatcatagctagaataacatgttctttatttcagaaagttaaaaaataaatattcattgaatccactaggaacgacattccttctttagatgctagaattataaaaacattaactgtataggcttggtctctagtgtcatgaaatttgcattccattggaatcagaaacatttaataactgcaaatcaaaaaggtaatttaagataatagagaatctgtgaagacagtactgcagggtggtatgatagagtaatgggggaaagagtatactttaaataggaaaaacatgaaattgctgaggtggtaatatttgactttagccttgtaataaaaaacaggaattgacagactgtggtctgagggccagtgtctgttttgtaaataaggttttatgggaatacagccacagtcattcttttacatattgtctatagctgctttgtaacaataatgggaaagttgagtagttggaccataagcctaaaatatttactatctggtcttttcagaaaaaaattgccaatccttaacataaaagaagcacaccacttgctgattgagctgagatcaccactgactacattacttataaacctggtatatactttctatccttattcaacataatcaaccacttactccttctagaaatcgtttcttctttttcttagcttgtctgataccatgttcttttgttttattttctaatctctgtagcaacttcttcctcagcttctttagtctaataattttcctgaatctgatctttagtgttacagtatattagggctaggtttcatgtctgtcttctcccttttttttttcttaaatagcatcatgcactcctgtgtcttcaattactgtctatttcctcatgacttccaaatacatatctctagctaggcctgtcttctgaattttaaacctatgtctccaactatctacatgacattcatcaatctaaattcaataggttataaacagaattcatgatatcctctgaaaaagctgctttacctttatatttctctctttcagtaaatggcatctattgcttatgtcagtactctggaattcatcagtgtaaccaatcagtcattaagacctttcaaaattcccccttctatgtatttgattgtttatagttctttctgtgcttctatattcctagtccaagctgcctttccatgacctctgtggtaacttcctgtttgtctccacatatccattctcaaagtggttcattggacaccatagccagagttactgtaaatgaaaatcagtggcttcccagtgtttttaggataaagatcaaagtcttttccatggtttatagagtccactgaagaaactgtcctccctagctttatgctataccattttcctttttctaggtaatctggcattcttttacttcctcaattctccaaatgttttattagggtctttgcatgtattgtttctttcttgcatggaatggctgttttctttcttctttgcttacttaattcctgttttctctaggcagccttccctcaccctcactccctcctcttaggttctcatattattttgtccttagtccttttttttttctttttttcttttttttttgagacagaatatcactgttacccaggctggagtgcagtgatgtgatcgtagctcactgcagccctgaattcctgagtttaagcaattctctgtgccaaagcctcccaagtagctgggactacaggtacatgcccaagtaattgttgttgttgttgttttcagtacatttttttgtaaagacaagatcttgctatgttgtccagccatgtcttgaactcctagcctcaagtgatcctcctgcctcggtctcccaatgttctgggattgcagacatgagccactgtgcccagcctatccttagtcttaagtgcacttattacatctgtgattaatcacaactataattaatgtaattatttgtcttcctcacaaaactgtaaactccataacagaaggctttgtgtctgtgttgttcgccattgcatcgacagcaccaagcacattttctgatactaaatatttgtgaaatgaaataataaaggagtatattatgtcttttaattatcacaaaacccctgtaatttattatttctctttgggaggcttttaaattgcttgggagaaatttggtaaagaataattgtaatagctgccatttattgagaaactcccatgtgcttgctgttcactaggctacatacacaatcttattttaacccttacaacacccttacaatgtagttaattttattcccatttttatgtggggaaacaggctcagagaaggtatttcacttgctcagtgtacacagttagtgacagagccgtgattcaaacctaattgatctttctctatatgctcttatactctaccactgtatgttgcgccttctaaccagatagttactgcgaaaactcctgcaatttctaattttatcacaaggctcccactatattttcccccttttcattcctttaacagaagagtttaaagttagtatctagacataccagcttatatattcattaattaataatttatattcacacaatgattgtagaaatgtgagtgtttcttagattaccaaacatctgtgaaatcgtgaaggagtattgaaatttagtaatttggtttggatctttgaagatattctgtagaattgttttccaaaagttacaactggtttacaatttttttcttaattgccattaacaagttttgaccctgagatattattcacaaatttcaattaaatactggaatgcttcatattttctgtactttaggacagggatccccaacccccaggccacaggttggtactggtttgtgacctgttaggacctggactacatggcaggaggtgagcggtgcgtgagaagcattactgcctgagctccacctcctgtcagcgacagcattagattctcataggaggacggaccttattgggaacacacacaagagatctaggttgcggactcctcatgagactctaatgcctatgatctgaggtgggacagttttatcctgaagctcccccactatccgtccagggaaaaatttggtcccttgtgccaaaaacactggggacctctgctttagaacatgcagtaaaacttgaatggattgtttaacagattgtttctttaatgaatttatcacataaaatcaggcattgctttgaaaaagtgcagtttatttcactctgttattactgcgtggttccagattgttaaagattcagctactttaaagcagtgtcttaaagaattaatttttgtcctttcagcattggcagattcatttttgtcatggaacatcttatctccttatgatgcttttgaagtattaatataggtggaattacctatgatagtttggtggaactaaactctttgtcactttttctatttgtgagatttgcatatagtattgtagcttttttctgaaattttttgttttgcaacatgccttcataagaaactcatcgatttgtatatttaaaaagaggctgtaaagcatttgaactagccccagtaggatcatattataattaataataataataatattaatgtcaccagggcttgcataacaattcataataattgtctttacacttaagtttaactgctaaactttgtagcctaatatagtgatttttatcacaatgataaacttttttatttacctcttgaactgtatgtaagaacagagaccagtagacctagtttttcctggttattttgtagaacgggaattgggaactggaattgaggaagtgatttcaatttcatgtaaatttttctgctattaattagttggcctattaaatttttagagtagctattgaacttttgcaaccagttttattttgagtactttattaaagtatcatctgttagcttttcatatcatctcaccatattatcttactgaggtaaaatggaattttttgcttactgattttttacataagaattaagtgatacccatacataccaataacattgaaattccaggctttcccatgaaggaaaacagttaaattaatgctagatttataaggcactacaaaaaaaagcactaaataaatttttaatttaaaaataaaaaattaatagtgttgatggggggtggaatagacattgtagaatcctaatactatttaatgttgttcatatgtgtaagaaagacacattatattttaaaatatagattctaatattgaaagaaaaaaatcatcagttttggagatgaaacgcatttttaggaatcttatatggaaacttcaataaggacatttttataccagtggaaaacctgattggaacaccttagagacatattaggcactgttgtttggaatgccagataagttaacctctgtaagatatatattcttataaatcactgctagcatagctgtaatatgtgaagataatttattaatttggactgatgctgaatgtagacatcttccatatctaaccttaagcatttaaaaaaatattttaggactaattattttgtccaaaaaagcaatcttttgattattgatcttcacagaattgatttgtaagatgtcatgatcaattgtggttagcatctttattattatatccattccaagataattttaggcttttgataccttgatacctttgtctcttccaacttttgcagagactttccttgcttgcatacagagaagagctagtagctaatgaagaatgtgcaaacctgccttttttccctctcctaagaaaggagaattcatccactgccactgtaccttttttttcttttcttttttgtcttgcacagaagacagacatcttcctgtgaagggcttgtggcaaacctatccaactcgggtttcttcttccttgagaacgatctgattcatcatcatctgaaccagggatcacagtctaaggtccaggtgagggcaagtcagtctatatgttaagccagttcttttctggtcaggtaagtcatactcaggcatgaactcactcagcatcagtcagccttagttttttaaaagtttcctagtccccagagagataatacaatttatctattcatttattctaggatgcacctaaactattgatgattaatcaccttattaaatgattccattctgtgtataatgtgatcattttcaacacacttgttcatcttaaattccagaactcttaaaaggagtatatgtgtggggtgagagggagaaaaatactgaaacagataggtatttctagctgcaattttaatacttatccttatcttcatttttattttatgcgtaagagtttagaacaacttaaaatcagcctagaatatatgatcttataccttcgtaattttaataacgtttgattatgtttgtagatggcttggaaccagaagctgattgagaatattagagctaacatttgcactcatggtcatcacggaggtctttgttggcttgccatgaattctttcctttaatgtcaaaatgactaagacagagacaagaattttcctgttctgtatcccacttctatatgctagtaataagaaacttctgattgtgcctcaggcaagtggtcatagctaattgaaatccagttttgtaccttgatgctatcttacaacttgggaagtaaattaggtctgtggctatgaggctattttctggacaaaatagcctcttatttttcaaaaaaatttttttatttgaggaaaaaaatctacatgtattctgacatttataatccttcaaaatgcacttgggcattatgtgaaatttgttttataggtggacattttaagtaaattagtttaagtcttacaaaacattaatttgtttcatcatgataatgacattgtgtgcatttggttttgaaaaaaacagaagtagtactttaatataccttgtctctgactttcacccacacatagcagatatgaataaattgggcatttatttctcctattggctaattttccaagtgactcttaagttatgaactgaagttaatatacttcagtgagtttgctacagtaatgactcctggtcactaggaagaagagagattgtcttcctctgaaatttttccaaccattaaggtaaatgggttgtaagaatactgttggcttcttgagatacattgttttgtgtttattattcaaaaacatctgtactagttttgagcaagagaacatttctttggctggaaaggcaactttttaaagcattcattatttggaaccatgttactgttggaacctaaataaagtagttatttacttgagtctatattaggacaactaagttagtatggacttagaaattgttgggtacaaaccctgtgtttctatctcgttatgtttgtgtaatatgtgcagaagaatcaaaatatttattgggtgttttaaaatgtctccagtggtatctctcttgaacagaaaagccatttatttaattctgcttcagattctagtagaaaattatttcccactagatcataagtgttttaagatgattaggttcctgtatgtgcattgtatgagtatgtgaacatatcctaacccaattttataaatatataaagtaatttaaatatttagaaatctcaacattaaacccaagaatgtcatccacattaaagtgtgtattaaatatttgaatctgtattgtaatgaactcagtaggcatgtttcaaagacttaggaagtagcacagatttccattatgctcttgggctgggcaagtcaattacatcctcaaagggttgtaattttgtagaaattagcagactacaaaggatgcttgatggttgtatctgactggctttggaaatgcttacatttctaagactgtgaatttttaaataatctttcctactttttttcctacttttatccttcttgtatgtttttgtaaccagtagttttttaggtagacacatatgtgaactttaaacatttccatatttatagttagtgtaattattacaacatctgtttcaatatatgaatgaactaaaatttggaaacttaaaagatcagtttttagtctttaaaacattagagcaggatgagctcttaatcatctacacaaagatttacaggctttaaatatgtagatttagattatctgtgatagcattttcattctataccagttaatgcatttcagagacatgtggtgtgtgtattaagggacatgctagctgattgtaccttactgtaagcaaaacaaaattataaaagcagatttgttatgaaaaataagaaatcgatgatttccaaaatcaaaaatgtgactttcggactattcccatgtgttgttggattgatctgccttttcttacacaagagcatactgctgaccccaccacaagctttacctgttaagtaaaatatgttgtgtttggaatatagcatagcctagagccaggcattatggagatgatatgctgaaattggggtttcttttcttcattctccctttccagttaggatttgattgcattactgtaataaacattaacattgaaatcatgttttaaatttcttcatgttcattttctggcctctgtaggacacacacagaaaagaccagtgaatgccatttcatctaagaagctctttaaatgcatccaagatgccagaaataaccctttcatacctcctgagtagtagcaacatgtaatggtataggaagaaatattccacctagcttttcttttggtggtgtcttgccattaactcataaaaacgtatatcctactattatctctaccataccttcatgtcattggttagattgcctgatggctactaatgtctcaagttaatagccacagaatatttcagaaaggtggcgtccactttataaaatgtgtctatgattgccaaagtcttatttggctagaaacaactaaatttagttgaccgagtaaaattgtatattcttagaatatgtcacttaaaacaaacaaatagtgatttactttcagttctgaaaatatttagaaggatttgttatctcttgcagaccttcctgcagactactaatgggatgaacacaatatatcacttttataatagtgagctattaaaggcaagcataaagcagtctgaagcccataagtgctgccaacagctcctgctttaatgaattcccttttagatgtccattaaatgctcatggcaaatgtactcataatggaaatggcaaatctaaatgggtagatatgaataatccatggagtttaaattctgtttatgatcatcttcacatttagttttcaagacaacgcagtttagttttcattacagtttggaataaagaggacagggagtaattgattgcttcaagcagattaaaatcaatggttttcttttcaaagaaccagttcaatgcagtaattccaactttaaacattgatttagaggactcaacacaaaatgttttgtgctgtgtgaacttttatataggaagactaatattaattttattcccctgtatatctgtatagtgaaatatagaggttgttagtaacatgtgcatgacttaatagtgatctatattaagtcattttgatattattgcagtcatataatgaatcaatgagattcccgtcatcactgtaatactgtttgtaacccattagcacagagaaattacagcccatcatacatcattactgtgattgaggctttattaccatattctcaaattgcttgcttgctataaaactaaatagacacaagacaactataggtagagtagagactgcgcattattgtgctacagtaatgagggattattgtaccataatgggttgaaacttatgaggaaaataaacttggcagtaatagaaaactggagactctttttacatttgtttttattactttaaaggtcaaatatatttgttatgctcaggttattgtttatgtattacatgaatcatagccttttaatattttctaaagatttttttcacccccacccccacccccaattgtatcctttcaaagtctgtggcctgatgcactttgaatgcttaggactggacttggaatctgtgtttttcctgttgtgagatgagacgttttactgctactaagcctaccatttctgagggtaggtagaacgctttaaactttaggctattttcagcatactatacattttgtttacagtgtggataggccagtggtcttcacgctcttcagttgaaataaatgtattaatgcagcaatattctaagcaatgaatacaggtttaaaatatggaactgtctagggcctgattgtaaaagacttttgatgtttcaaagatgaaaatagaaaaaatatactgcgtccatattaaagaagaaaatcctacgacagtagaacttactgtagttataacctgggaccatgctgtcctctttggaagaatatgttgcctatgttgccttttctaacttcagaggttattgttgctttggctaaaaatttatatgtaaagtgttttataatcatgaacatatgctaatttctgggttttgttttatattattatttttatttatttatttagtgttattttttagagacagatctcactgttgcccaggctggagggtagtggcactataattagaacttattaaattgtgcatatgttcattcactctctgttgagtcttgtttatgagttataacattgagagcataatatgaacagtgtaaagcccagggtactgactttggagataagattgcatggatttaaagttctcagtgcagagtggttttctgatctcaatctcattgtgatttgataccacgacaatttaaatatcaaacaatgacccatctgggcaacatagtgaggctctgtctctgctaaaaataaaaataaaataagagctgggcatggtggcgcattcctgtagtctcagcttctcaggagactgaaacaggaggatcatttgagcccaggagtttgaggctctagtgaaccctgatggggccactgcagcccagcctgggcaagagtgagacctgtctctaaaaaataataataaatgaatgaataaatatcaaataatataaaatgaaagccagaaattagcatatgttcatgattatgaaacactttatgtataaatactttgccaaagcaatagtaacctcttgttaacttagaaaaggcaacatattcttccaaagaggacagcttggtcccaggttgtaattacaagccacttacacattactcttagggttatcatatgtaattaccaccccctttgtaaagcatatattttatttataacacatactgtagttgtagtggtataaaacctgaatgcttgcttaccaaagaactgcaatgagacatgctgcataaaaggaaagcttagaattggctgaggggactatgcctaaatgatgccccagccaactctacctggtatattcttcaatgaagaaaactgtaaaacatcctaatcaaccaacttctttccatgcttgccagagtatatagccactttgaattacatgaatgtttttgtgactcggttcatttcatcacttcatgggagcaccttccatgttaaaaacagatgcagtgcaaaagcagaaagccagaaataatagtgagaggcaaagttagagaaatgtgcatattaaatctttaaaatactctatgactttttcctgcccagcatcttttgggggaaaaagagagaagatgaataaattaaaggtttttttctttctttgtttttttgagacaaggtctcactctgtttcccaggctggagtgcagtgttgccatcatggctcacggctcctggcagcttcaacctccaggctcaagtgaccctcctgcctcagcctcctgagaactgggaccataggcatgagccaccacaggtttggtttttttttcttaataggttggacatatggctataaataaaaaataagaaaattaaaaaagagtaagtgctaagaagaaaaataaaatgaaattataagtataagaaatgctagatggggttgttatatatatgattttttgtagaaggcctttctgataagatggcatttaaggaaaaatctaaataaagtgcaggacaagccaagatatttatctatggtaaaaaaatatcccaggaacagtgaatgtaagtgttctgagagagaagcatatttgatatgtatgcagaacagcaagactgctatggctcagcagataaagggggaaacataagaaattaaacatgataccttagtaattttttaaatgaatttaataacattaaagtctttctgtgtagttaggtttttgctattagagaggtggttctaagtcaaatgatgcttctaatatctttcttaatatattggatatgaccttgttttttaagtatttaaatatgcttgaacatgttaacccgatcatgtatcttttgtggaggtctagagtttttttttgttttgttttttagggtttttttttttaatgatacaggctttattatcttccccattttgcagatgagaacactgaggcatttacccagtggcttataagctgataggtgctaaagccaggaatcaaattcagaaagtgtagcccagattctgaacttttagccattgtttgcactgtttgtttctttttttgtttttttttttttttttttaagtaatttcaacttttattttagattcaggatatgtgtgcaggtttgttccatgggtatactgtataatgctgaggtttgggatacactacaacccgttaccaaggtagagagcatagtacccagtaggttttcttttctttctttctttctttgagacagagtcttgccctcttgccaaggctgaagtgcagtgttgtgatctcagcttactaaatctccacctcccagtcttaagcagttcttgtgcctcagcctcccaagtagctgggactgtaggtgtgttcttccatgcccagctaatttttgtatttttacaaaatacaacaaaatattcaagctattttattggccaagctggtgtcgaactcctggcctcaagtggtccagccaccttggcctcccaaagtgctaggattacaggtgtgagccacctctgtgcctctccccagtgtctcttgttgctgtctttatgtccatgagtactcaatttttagctcccacttataagtgataacatgcgatatttggttttcttttcctgtgttaattcacttaagataatggcctccatctgcatccatgttgctgcagaggtcacaatttccttcttttttatggttgcatagtagtctatggtgtatatatgctactttttccttttgttcttacaattttctatctttttctttataatttcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtccatcattgatgaacatctagattgattccacatcattgctattgtggatagtgctgcagtgaaccatatgagtacatgcgtttttttgatagaacaattcattttcttttggatatatgcccagtaataggattgctgggccaaatggtagttctatttcaagttctttgagaaatcccaaggtactttccacagtagctgaattaatacatgttcccccccaacagtgtataagcgttcccttatctctgcagctttgccagcatctattgtttttttttcttttttgactttttaataatagccatcctgactggtatgcaatggtatcttactgtaattttgattttcatttctctgatggttagtgatgtggagtattgtttcatgtgtttgttggctgcttatatgtcttcttttgagaagtgttgattcatgtcctttgcccgcattttaatggagctgttttttgcttgctgaattgtttacatttgtcataaagtttggatattagacttctgttgtatgtataggtttttctctcattctgtagattgtctatttattctgttgatagtttcttttgctgtgcagaagctctatagtttcattaggttccatttgtcagttgttgtttctgttacaattgcttatgaggacataaacataaattctttcccatgactgatgtccagaatgatgtttcctaggttttcttctaggattcttatagtttgaggtcttatattaaaatctgttaatcggtcgagttaatttttgtatatggtatatacagctacatatagctagccaactatcccagaaccacttattcaataggaagtcctttcccgattgcttagttttgttgaccttgttgaagatcagatgtctgtaggtgtgtagctttacttctggctcctctattctgttccattggtctatgcatctgtttttgtaccattaacatgctgttttggttactgtagccttatagtgtagtttgaagttgggtaatgtgatgaatgcctccagatttgttctttttgttcaggattgctttggctattcaggctctttctgttctgtatgaattttagaatagtttttttttacttctgtgaaaaaatggcatggtagtttgataggaatagtgttgaatctatagattgctttggacagtgtggccattttaacaatattgattcctccaatccatgagcatgcaatgtttctccatttgtttgtgtcatctgatttctttcaacagtgttttggaattctccttgtagaaatctttacctttttgtttagatgtattcttaggtattgtgtgtgtgtgtgtgtgtgtgtgtgtgtgtgtgtgcacgtgcgcagcaattataaatgtgattttattcttgatttgtctctcagcttcaatattattggtatatagaaatgctagtaactttttgtacattaatttttgtatcctgaaactttactgaagttgtttatcagttctaggagcctttgacagacttaagggtttttttcaggtatacaatcatattgttggccaagagagatagtttgacttcttttcctatttgcatgccttttatttcattctcttgcctgaatgctgtggcgagggcttccagtactatgttgaatagggtggtgaaagtgggcatccttgtcttgttccagttctcaaggggaatgcttccagcttttgcccattctgtatcatgtcgggtatgggtttgtcatagatggcttttattattttgaggtatgatcctttgatgcctagtttattgagggtttttatcataatggtaagttggattttattgaaagttttttccacatctattgagatggttttattgaaagttttttccacatctattgagatgatttgtttacatggtgaatcatatttattgatttgcatatgttgaaccaactttgcttcccaggaatgaagcttacttgttcctggtgaattaattgttgatgtgctgctggattcagtttgcttgtatattgtcgaggatttttgtgtctatgttcatcatgggtattgacttgtagttttcttttttcattgtgtctttgccgggatgtaccacattttctttatccattccaccatttatgggcacctagattaattctatgtctttgcttttgtgaatagtgctgtgatgaacatgcaagtgtatgtgtctttttagtaaaatgatttcttttcttttggttatatacccagtaatgggattgctaggtccaatggtagttctgatttaagttccttgagaaatctccagactgtggagacagtgcctgaactaatttatcttcctaccaacagtgtgtaagagttcctttttctctatagccttgctagcatctgttgttggtttttttttttttttttgctttttaataataactattctgactggtgtgacatggttttgatttgcttctctctgatgattagtgatgttgaacatttttttcatatccttgttgccacctgtatgtcttcttctgaaaagtgtctgttcatgtcttttgtctattttttttaatgagatgtatttgtttttgtttttttgcttattgaattaagttcctaatagattctggatattagacctttgttggatgcatagtttacaaatatttcctcccggtttatagattgtctgtttgttgatggttacttttgctgtgtagaaactctttaattagttcccatttgtcaatatttgttttgttgatttgatagactgctagctagactaagaaagaaaaaagagagaagatccaaataagtacaatcagaaatgacaaaggtgacattacatctgatcccagaaaaatacaaaggattctcagagactattatgaacacccctgttcacacaaacttagaaaatctagaggaaatggactaattcctggaaacaaaaccttccaagtttgaatcaggaagaaattgaagccccgaacagaccaatattgacatttgaaattgaatcagtaataaaaacctaccaaccaataaaagccgcagatcagatggattcacagccaaattctaccacatgtacatagaagagctggtacaaactctaccgaaactattccaaaaaatcgaggaggaagtgctcctccctaactcattccgtgaagccagcatcagcctggtaccaaaatctggcaaggacacgacaaaaaaaactacaggccagtatctctgatgaacgtggacaaaaaaaatccccccaaaaatactagcaatccacatctagcatcatatcaaaacgttagttcaccataatcaagtagacttcattcctgggatgcaaggttgtttcaacataatgcaaatcaataaatgtgattcaccacttaaacagaatgaaaaaccatataatcatttcaatagatggggaaaaagcttttgatttttgttcttgataagatatgacagaaagtctcagagtcagagccagggactttcttaaataattttagagcttttagttgcaaaatgtctttgtttttactgctggcataaataggttttccatttatttctagcactcagtaaaaacatattatttaatttactggctcttccaatgtagtatatgagtctcctaaagtttgtgaagtcttgttcgtttatttatttaggttgctgacaagtggaaataggtgagatatgaagttttggggattttaatcctgtagaaggggtccttgaattgaaaaaaagttttgagaaccagttgccttcttcccagggagaagatggagcagaggtcccaaacatggtaaaactgaggtagaaaagaagaccttaggagaagcttgaggttcaaagagagggaataagttaaaaatgtaaaaagttaacttttgaaacagagaagaggaaactagtgaagaaggaattcttcctcgctgcattctgcattagttatctattgccgcagaacaaattacccctaaacttagaagttttaggaaaaatcatattctatttcacagacttcctgaggcacaggaatttcggaatggcttagctgagtaattctcacttaaggtcttttatgaggtttcagtcaaaatgttgatccagggctgaaaattctgaaaacttgactggggttggaaggtcagcttgcagaatggcttgctcacgtaactgttaacagaaggcctcatcagttctagcctgttgttgacaggaggcctcacctccttgccacatgaagccctccatagggctgcttgattgtccccatgatatggcagctaatttccccaaagtgagtgatgcaagagagagggtgggaaagctactgtaaaaattgggggtcatgttattaattatttgttatttatttattattactattaagcagtaattgatagcactcattttcttcatttatattgtgattcctcattgtttttgatcatctcagggcacaaaataacaatctcccaaaacaaagaaaccaagctaccaccaccaacttgtgataaatacaaaatatacataatatatgtattttgaaggaagtcctgtaatatcctagttgaaattatttcttgaagtacagtcacacatcacttaacaacaagagtatgttctaagaaatgtccttttaggcaattttgttgttgtggaaacgtcaggaactgttcttacacaaacctggatggtatagcctactacacacctaggctgcgtggtatagcctattgctcctaggctacaaacctgtacagcatgttactatactgaatactgtaaacaattgtaacacaatggtaagtacttatgtatctaatcatagaaaaggcacagtaaaaaatacacttttttttaaatttaatattattttaagttctgggatacatgtgcaagatgtacaggtttgttacagaggtaaatgtgtgcgatggtggtttgctgcacctatcaacccatcacctaggtattaagtcccacatgcattagctatttatgctgatgctctccctcccactgcacccccgacaggccctggtatgcatcgttctcctccctgtgtccatgtgttctcattattctgctcccacttataagtgagaatatgtggtgtttagtcttctgtacctgtgttagtttgctgaggataatggcttccagctctatccatgtccctgcaaaggacatgatctcattctttttcatggctacatagtattctatgatatatatgtaccacattttctttatccagtctatcattgatgggcattagggttgattccatgtctttgctattgaaaaatacacttatatttttcatagatcctaggcctatacagggtcaggatcagcaagacacaactaactataaaaattcctatcatgtagttaggataggacctaactatatagttatatatagttaactatataggaactaacaatataattaggtcctatcctaaccatatgataggaatttttcaactccatgtaatcctaagggatcaccatcttagatgcagccaattgttgaccaacatgtcattatatagtgcatggcttttgtacgtcatggctacatttaaatatgcttgttttcagtgttagggaaatatatgtggtgaaagagatgattaattaatgctggtgtgttgtttgcatcaaagaggaaattttccttttacttatattttgaggatgattgggaacatcaagaatagatttatattacagtagcactcacatttgaatcatctttggattaaaaggttctaactagtgtcctttttgcattgcttttcttaattataactataaatcaaaaacatgtaaaactatagtgtgccaaatgttttctaagacccatttaatgattgtaataacccactctagggggggtcatcatctttttgtcaggacaatcaggtttacggataggctcctactcttaaatttgtgctttgtacagagggagtatatattacagacacttggataaatcatttcataaagtattttctgcagtatcttctaaaatataaagtaatttgattaaaaataaataagattgtacttagtgggcacaaaagtggatgaatatgggataacttcagaaaaaagagatatagctgatggtgtgtattgattgatgactactttcctgtacttaaacagtttatactgtgcaaatattgacctgtatcaagtgactgactacagtattttcatgcagatattccttgaattacttttgtaatcagtaattctttttgagacaaatatgtaaaatgaagtattcttctttaagaaaacctaggatctttttatttttatttaaaatattttattccgaagattccaggaacatacataggataaaatagtggtttcaaactggtttacaatcagtggaactgtttcttcaaatgaaattttacatagaagcaaatggctcagactgaaatgaggatgtggggttgcaagaagccagatgttccaatggttcagttcttactctctctgtggtgcccttggggtgtctctctggcatcctaagcctctaaggagtgcattttgagaactgtggacatatgtaggaatttgtaattcataggccatatgccattcatttgggtgttagatgacactgcctcagtgtcattgttagatcacataggctagccaacagtaaacaggaatatatttattgcatataaaagttattattagtgaacatgtttgtctaattgacactgataattagatgtgtgatgtggggtcagacacttccaattctcaatttctttatatgtatgtaactagagggagttggactagggtaagcagaagctcctggcacctgccattctatggttctgataatatttattgaccttcaatgaagagtctagaacttttctgctatgagataaagaaaaagtcttaagccatggtttggaactctaagagatttaaactcagattggtgagataaaactagccaacatgaaactattagagacaatctatcaaagtattaataaattgttttgcactataggatctaaacttatacagaggcaaatagaaaggatctattttaaaatccttacatttaaaataaaagtgcctgtttgacatttcatctaatttggtgaactggcaaattacacacacatgtatttcctactaagaactagaaatcaatcctgttgcactattatgatcttaaatatgatctcctaaacgtgtagaaaggtattagttgctttctttcccctggtgcctatgagtattaatatatattacattttaattttaatgcccccggtgaaatctgtattcttaaagaactagaaatctgaatttttcagctttaacagattgtattgtttatgagtacaaattaattttttttcacaaggcttttcttaaaatgaattttaatataacattaaagtcatatatatttcagcatattaaagaataaggaagaattttttatgttggaaacttattttaccttattagcaattttaattcattaagccttatttttgcttttgtaataataacattttttcaaaccatcttaaattttgtagagaattttaatttatttgatctttgactataatattcaaattggttttgctttgctcacaaaggtaaagagaattccaaatttactcataataaaaatattagagaaactgtcaataaatttactgttataattgaatcacatgatatctaaattgttgataatatgatctgctcgttaaacaatagtgtctggagaaaatgatggattaattgactgatggctaaagtttccctcaaatataatggtttacccagtttgatttgatttgtgtaaaataactttctctaataaacaatttgctcagaggcaatagaagaaatgaatggttatcaaaccaaacttaattagtctatcctagattgatattacttggggagtctttgttttaattgtggagtgctggatacaaagagtttggttcattattttttcctgtataaacactattgtgtaactacctatggaataataacatgtgaattcattttaataaatgcttgtaaagtgaattagctaattataccaggctaaaaatgattcctttaattattttggatatttaactggtacttcagttttattattgtttgtctgtaaatgtgatttgtattagctctgccaaactaattataatgtataacttaacaaacaatttgagcagttttgtaatgcttatattgttctcttctcttatgcaaaagaaaacattatttctagtttgcatgaaaataaaggtttgatacaaattcacatggaaatatatgtgtaaatagagaagaaaaacctctcaatatgcaaggtagtacttgatataactatatgaatgagaagaatgaacagatttccttcaggagaagataagccagtgactcattagtttaacttaaaatatgatatagcataagagatttgattgttattttaaagctggaaagatgagttttcttcatgccctatctagagagtgaaaaactcgatcctcattctcaaaaagaaagatttatagtaataatgtattgtggatgtcaaaaacaatatgcttcttaatcacttttacttaacagactaattgtctttaaatcagaaataaatgagaacaaaggctttagtaataaaaaatacagattccaagtttaggctttctaggggaaaagcaaaatagcctctaaaacagtatgcaatgtaaatcattcttcttttaaaaattaatatacagtaaaattcacatttccatcttttctggtgtacagttctgttttaacccaagtatatattcatgtaaccactatcacagtcaggatacagagtagttctgtcccctgagataaataaataaacaaacaaataaataaataaagcctccctcatggtgtcacatcttccctctgtccctaacacttgggatccactgatctgttcccattcactactgttttgccttattccagaatgttatgtaaatggaatcctataaaacttgaccttttaaaactggtttctttcactcagcacaattcctttgagaatcctccatgtttttacaatacagtttgttttctgtctccttcttcccaaattatagcaacactaatatcagtttttgaagtaaatataaattatctgccccatatggaaacttattttctccatcataggatccctaaaagaactggaacttgattttttaccctattcatgcctatagttctgccttttttttttttttttttgagctggagtctcactctgtcaccaggctggaatgagtgcagtggcatgatctcggctgactgcaacctctgcctcctgggttcaagcgattctcctgcctcagcctcccgagtagctgggactacaggcacgctccaccacgtccagctaattttttgtgtttttagtagagacacggtttcaccatgttgggcaggatggtcttgatgtcttgacctcgtgatctgcctgcctcagcctcccaaagtgctgggattacaggatgagccaccgtgcccggccagttctgcctttttaatggctgcattgtaattttatgaatgtaccatacttggtttaagctgtctccaacatagatacttagatatatttttttaaattatcttcagtgctacagtaaacatgcttatacagcatatgatatgtaagaatagctgccttcaatttctagaaaagcagttgctggatgaaaaaaaaatacacaaaattatatggttggatggattgcaatttgccttccaagaagattgaagcagtttgaacctcactccattatcttgccatcaatgtcatttgtaatctttgcaagtctagtagatagaaactgtcttactctaatttatatttcattaaatattaggacatttaaactcagtattctgaatatattatttctgtccaatttgagcagtttcagcacaatcttaatttttataaatctcaagtttgtcattttatttttgccattttaatgggattgtagggcatctcattgtagttttattttgcctttttttttttttttttttttgagatggagttttgctcttgttgcccaggctggagtgcaatggcacagtctcaactcactgcatcctctgcctccagggttcaggtgattctcctgcttcacttcccgagtagctggaattacaggtgcccaccaccacacccagctaattatttgtatttttagtaaagatggggtttcaccatgttggccagactggtcttgaactcctgacctcatgtgatccacccacctcggcaccccaaagtgttgggattacaggtgtgagccactgcacttggccttattttgcattttcttaatgggtaatgatgttgaacgttttttttttccacaaacttaattgcctccatatatcctctttggaaaagtatcttttcaagtcttaacccttttttttttgttttgtttttttttttttgagatggagtctcactctgtcgcccaggctggagtgcagtggtgcgatctcagctcactgcaacctccctccacctcccgggttcaagagattgttctgcctcagcctcctgagtagctgggattacaggcgcatgccaccacatcagctaatttttgtatttttagtagagacagggtttcaccatgttgggcaggctggtcttcaactcctgacctcatgatccgcctgcctcagcctcccaagtcttacccattttttaagttagctcatttgttttcttgctattgagttttgagaatactttatatatagattttgactacaagttctttgttggatatgtgatttgcacatttttttcctctaagtatgtagcttgtttttttcattctgaagtatccattaaatagcaaaagtttttattttggcagagtctaattattacatttttatggatcacgcttttgatatcatatctgagaaatctttgactaattctggttcacaaatattttctcctaaaagtgatagaattttatgcaagtcttttgggctatcttttttccttttgctttaactgacttgcatctttacatttaatgtgagtttctgatagatttttttgttttttaattgagatagagtctcatcctggagtgcgatgacacaatcatggttcactgcagccttgatctcttgggttcaagtgatcttctcacctcagcttcccacgtagctgggaccacaggtgcactacacacccaactaacttttttattttttgtagagacatcttctttctctgttgccctggctggtctcaaactcctggactcaagtgatcctcctatctcagtctttcaaagtgctggaattataggtgtgacccaggatgcctagcccaaaagcatatctttaggtcttgtttttaatctgttcacacaatctgtctttcaactgctgtgtttatatcatttgcagttaattattactgatgcttggatgtagatctacccttttcttttttttttaacttttaggttcaggggtacatgtgcaggtttgttacataggtaaattgtgtgtcacatgggtttggtgtacagattattttgtcacccaggtaataaccatagtactcgataggtagtctttcagtcctctcctttctcccatcccctaccctccagtagactgtgctgtctgttgttctcttctctctgtccctgtgtactcaatgtttagcttccacttataagtgagaacatgtggcatttgattttctgttcctgtgttagtttgcttaggataatggcctcaagatccattcatgttgctgcagagggcataatctcatttttttaatggctgcgtagtagtgcacagtgtgtatgtgccacatttttttatccagtctaccattggtgggcatttaggttgatatgcttgtctttgttactgtgaatattgctgcagtgaacatacttgtgcatgtgtctttatggtagaacactttatattcctttgggtgtgtatccaataatgggattgctgggtggaatggtaattctattttaagttcttcgagaaatcgccacactgctttccacaatggctgaactaatttacattcccaagagcagtttataagcattcccttttctctgcaacttcaccagcatgtattattttttgactttttaataatagttactctgactggtgtgaggaggtatcccattgtaattttgatttgcatttctctaatgattagtgatgctgaatattttttatatgcttgttggctgcatgtatgtcttcttttgaaaagtgtcagttcatgtcatttgcccacttttcagtgaggttcttgtaaatttgtttaagttccttatagatgctggatattagacctttgttggatgcatagtttgcatatgtgttctcccattctgtaggttgtctgtttactctgttgatggtttatttttgctgtgcagaagctctttagtttaattaggtctcatttgacaatttttgattttgttgcatttgcttttgatatctttgtcatgaaatctttgccaaggcctatgtacagaatggcattttctaggttagtttccagggtttttataattttaggttttacatttaagctttaatcaatcttgaattgatttttgtatatggtgaaggctaggggtccagtttcaatcctctgcatgtgactagctagtgatcccaacaccatttattgaatatgaagttttttcctcattgcttgtttttgttcactttgtcaaagagcacatggctgtaggcatgcagaattatttctgcacactcttttttgttccattggtgtatgtgtctgtttttgtaccagtaccatgctgtttcagttactgtagccttgtattatagtttgaagtctggtaatgtgatgcctccagctttgtttcttttgcttaggattgctttgggtatttgggctcatttttgttccatgtgagttttagaatagttttttctaattctgtgaagaatcacattggtagttgataggaatagcattgaatctgtaagttgctttgggcagtatggccattttaacaatattaattcttcctatccgtgaacatggaatgtttttcctttgtgtcactctgatttctctgagcagttccctctctgatttttccttcttgctacctttagattacttaacattttagttttccattttatctattgagtttattactataaactataaactactattagtatcttcaaatggatttttcatgattgttctagaaattatacatattcaacttttcacaatctacttagaattaatattttaccatttaaagtagaatgtaagtccccttattcttcactctttgtatataacatattacatacattgaaaacctaccagataatgttgtaacttttgcttttaactgtaatacatatgttatgtggctcacatctttaatcccagcactttggagaccagtgcgggcagatggcttgagctcaggagttcaagaccagcaaagccccgtctctacaaaaaattcaaaaattagctaggcattgtgacgtgtgcctgtggtcccagctcttcaggaggctgaggcagaaggatggcttgattgcaggagtgagatcgtgccactgcacttcagcctgagtgacagagtgagaccctatcttaaaaaaaaaatgtaagaagaaagtaatattgttacatttatttaaatatctaccctttctgttttctttcactccagatagtccaagttttcccctcacatactttcccttttgtctgaagaaattcccttacttcttatagagcagatccacagacaatgaattttcttagttttcttttatctgagaatgtcattatttcatctttattcatgaaggatgtattctctaatagaattagaattagagaatgtaattctgtaatagaattttgatttgatggttctttccctttcagcattttaaaaatgttctacttatatctgactgggtggtttctgataaaaattccatgttcatttggattgttattcccctctatgttatgtgctgtttttcttgggctgctttcaggatttcttttttcttggccttagttttcagcaatatgtcaaaattgtctgggtttggatttctttgtgtttatctttcatgagactgtaagtttatgtattttgctgaacttgagaatttattattccttttttctttatttattgttgtgaaattcacatgctatattgagtgtttttgaatatacacattcagtgacctttagtgcattcgccacctctctctagttttaaaacttttcaccactccagagaaatactttgtacctattaagtaatcactctctattctttatttcccctgccccttgaagataatactaatctactttctgtctgtatagatttgccaattctgtatattttatattaaataaatcatacaatatttgagcttttctgtcttgctgtttttacctagcattatgttttcaaggttcatccaaattgtaacattcacttaacttctttttatggctgaatactatttaatatttcactttatggctattacacattttgatcatcttttcatcagctggtttggatttgagatgatttcaccttttggctcttacaagtaatgttgctgtaaacatttttttacaagttaccatgtggacatatattttcatttctcttgggtatatacataaaagtagagttgctaaatcatatggtaattctttaactgaattgctgtcaaactattttccatgatggccacaccattttacattcccaccagcaatgtaaaagagtttatctttctccacatccttgttaacatttgttatttttagggtcgctttcttgttgttgttttatgttattgtagccatcttggtaggtgtgagattatagcttattgtggttttgatttgcattttcctaacgtcagctgaggtttagcatcatttgtttgttggctatttgtatatattctttgaaggaggatctggatttttaaatcctttgcttatttttaaattgggtcgtttgactttttcttgttgaattgttagtgttgtttatacattctggatatgaaatcccttatcaaatacatgatttgcaaatatgttctccctttttgtaggttatcttttcacttttttgacgatattctttgaagctcaagattctttaattttgaggatgtctaatttatctattctttggttgcttgtggtttttgagtcaaatctaagaatttaataacagttacaaggtcatgaagattcatccctatgtttttttctaatattttatacttttagctcttgtattttgtatagggtgtgagattataggatccaacttcattcctttgcatgtggtcatccagttgtcccagcaccatttgttgaagatactattctttccccataaaagtatcttagcaccatagtcaaaaaatcatttatccatagattatagggtttacttctggattctcaattttgttcctttgttctgtatgtctgttcttacgctattatcacacggttttggttactgtagctttgcagtaagttgtaaaatcaggaagtatgagatctccaactttgtttttcagtattgttttggctattcaggactctttccaattgcaaatgaatttgaacatcagattttctgtttctacaaaaatgccattgaattttgataggtattgtgtttaatctgtagattattttcataagtattgccatcttaataatattaagtcttctaacccatgaacatgaaatgtctttctttttttgagatggagtttcactgttgttgcccaggctggggtacaatggcacgatctcagctcacagcaacctctgcctcctgggttcaagcgattatcctgcctcagcctcccaagtagctgggattacaggcatgtgccaccacacctggctactttcatatttttattagagatggggtttcatcctgttggccaggctggtctcaaaatcttaacctcaggtgatccacctgcctcagcatcccaaagtcctgggattacaggcgtgagccaccgtgcctggccatgtctttctatttagttaagccttctttaatttctttcaacaatgccttagaattttttttttttaattaggcaagttctcttttttctcaacttttattttaggttcaggtagtacatgtgcagattcgttacatgggtaaattgtgtgttgctgaggttcagtgtacgaatgatcccatcactcaggtagtgaacataaaatctaagagatagcttttcaactcttgctcccttacttcccttctaatagtccccagtgtgtcttgttttcatttttctgcccatgtagaattttcattgtacaaatctttcacctcccttgttaaattcattcctagatattgtatccttttgaatgctattataaatggaatttttaaaattttccttttggattgttgattgctagtatataggaacttaacagaatttttgtttgttgatcatgttccctgcaactttgctgaattcatttattagctgtagtagattttttgtagacttttgtagattttctatatatagaattatgtcatctgtaaagaggtagttttgttttttttccccactctgaaatttgtaagccatttatttatttggcctaattgctctagccaggacttccagtacaatgttgaatagcagtggtgaaagtggtcatcctcttgttactcatcttgggggaaagctttcagtctttcaccattgaatgtgatgttagctttttttccttcaaatcctgtcagtgtttagttcatatatatatatatatatatatatatatatatatatatatatatataattgctgtatttgatgcatatatgcttatcattgttatatattcttactgaaatgactattttatcaatatgtctttctttgtctcatgataattctctacttaaaatctatgtattctgatatttgaatagccattctagctatcttttagttactgtttgcatagaatatccttttttatcctttcactttcaatttgtttgtgtctttggatctaaagtgagtctcctgtaagcagcatatagttgactggtgtggtttggttttgttttcgggggttttttgttcacttgttcatttttaaagtgaaagcaagtttattaagaaagtaaaggaataaagaatgactactccattggcagagccagtgtcttgggctgctcactgcgattacacttatagttatttctttattatatgctaaacaagggattgattattcattagttttctggaaaaggggtgggcagttcttggaactgagggttcctcccccattttagaccatatagggtatcttgctaacattgccatggcatttgtaaattgtcatggcactagtgggagtgttttttagcatgctagtgcattataattagcatataaagagcagtgaggataagcaggggtcacttttatcaccatcttggttttggtgcattttggccagcttctttaccacatccttttgtcagcaaggactttgtgacctgtaccttttgccgaccttctgtctcatcctgtgacttagaatgcctagcctcctgggaatgcagcccagtaggcctcaaccttattttacccagcccctattcaagatggaattgctctggttcagacacctgtgacgtgtttcccccctcccttttacaagggaatccttaatcttaagggttgtagagggacaatgatgcatcttctataacttcttcaggctgaaaacaggtgatgatatacatgtctaactattagggtctcttgtattcagggtggagaggcgcacatttagaaagcatccatatgctgagggccattcataactcttgagatccgacagaaggtggtatctggaagactaataagtgttcaacttaagaaaacattgagtgagtttatcctgcatatctacacaaagagtacaatatcagtgtattccacaacagtaaagaaaaataagcaaaattatcccaagtaaagagagctttccatgaactgggccactgtcggaaccaaactgatatggggttgctagctgattcctgtttgtccagaattagaatactgatccagatttttacattactcatccctcttgtttcttgtgagcagcagctagaaatcactggttggtttacaggaatagacagggttagtctgaattgcaggaaaaaaacatcagaaacaactgatgaaactagcatgtactaacaggtgtaccatatttcttgaaacataatttttctctctccagtctcccatttttattaaagacaaatcatggtacgaatgatttgttctcaaaataagatgtattcttatacttggcctgattatttgtataaagttcagcaagaataattaattttcacatatgctttttaaattggctttgatggaactttgttccaaaaaggaatctcaaacaagactttttttcataaagctgagcctaaccatgggtttgtaccatcaaatacctatgagttgagcaaattcctcttatcttgaggttccaagataacttggggcttctggacctgttagaaagtgacattctgtacttagcacagatcaggaaccctctatagggacagtatagacaaggtatgaggccagttttcccaaggggcttttattggctctgtaagtcaagtttgatacctttaagaaaagcatgctattcgagtcaaagccttggcaaaacaaccagtttctccagttgtgtcctgttgccaaaaaaaaaaaaaaaaaaaaaaacattcttattacacttgtgcaagtaaaactatgttgccgtaaattaagattactcacaaatagtttcgaaattctggagaaatcagctagagagaaacaaatatgttccaaattttgtttacaggaaaatactttattcaattgtttaaagttgtaaatagctcaaaagaaaatcttcttgactctgaaaaccaaaacaaagaattggtaacattttaagcaaaaagccaaaaaagattacttcagttttctattagttcagtccatgcagttaactcctgtcctgacttatcatcaccaacatttcagctctccatgagtcctgaaagttttttcctgtattctaatgccacagtctccaaagttaccagaaacctgcattcaggagcacctgtcaaagttctatagctgacttataaaccaccttttaaagaggatcaaaacaagataacaatcgtttgtgaatgacaacatgtcttagggcagccacagtcaaaaacatgattgacaaagaaattttgttatcttggtggcatataatgattttatgtaacaattataattattactgataacatgcactaaatcatatcagaattacaggagtttcccgtaattttggaacagataccaataacaccaataacatattcaaacaaatacatccccaggaaagccaaacaccattttatatttgacagtgtttcttgtgatttttataccagataagccctatatgtcacttttggactttaggggacctaatatctaaaagatgaattaggttagaaaagacatcatttataattttactttggaaagtttgtcatatattaaaggtttaaaacacttgatattgtaaaatcaaatcccaggtcaccagaagtcattgatttagccaaaattgtacctcaaaaattttttaaagccaaaaacctttactcattaaggggaagacagctttccaaccaatcggtctcttttcttttcctcctttttcctacagtttattcagaaggcaaacaaaaatatttcattttttaatataacatgaaaatcttgttcaagaaaggaagctaactttcacctttgcgttagtgcactattgatgtcaaaccttaacaaaaccctatagacaaatccatctagtctcaatcagtatgaccttaaggtaagattcatataaaccttttatagccttttacagcttttgtgaaagagcagatccatgctctaagaaaattctggtgtgcttttattctaatgttcaatttatggaaaaactgagtaccactttaactttagccaatatgttcacacacagaatttcttttacaagattattttttcacaaatcctccacaacttgattgttttctggtttgtggttcctgtgttcctttttatagtgacaaaccattttatatattttaaatgttttcattttgtacaataaagttagcatattttatacatatttatataattatgtttatatatgtgtttattgcattttgcttttttcacttaattatatctcctggaaatcattccatttcaatagatagagttcctcttcattctgtcttatagcttcatagtactccattttgtgtggatatcatagggtattttaccccccagtctccattgctttacaatcacaaatgatactgtacgaataactttgtgattatgtatttattagtctgttctcaactgtgaagaaatacccaagacttgataatttataaaggacagaggcttaattgatttacagttttctgttgctggggaggcctcaggaaacttacagtcatagcagaaaggaaaagagaaggcaccttcttcatagggtagcatgatggagggagtgcaagcaggggtaatgccagatgcttacaaaaccatcagatcttctgagaactcactatcacaagaacagcatgggggaaactgcccccatgatccaattacctacacctggtctcggccttgacacatggagattatggggattacaattggaggtgagatttgggtggggacacagagccaaaccatatcatatgttttcatattgttggagaaacatattttagataaattcatacagggatttctagcttgagatttggttatatgtagctggttagatattgacaaattctccttcatagggattatgacattttctgtatccatcaaaaatatatggcattacctatttctctcttacctcactaataaaatgtatttttttattttattattattatactttaagttttagggtacatgtgcacaatttgcaggttagttacatatgtatacatatgccatgctggtgtgctgcacccattaactcatcatttagcattaggtatatctcctaatgctatccctcccccctccccccaccccacaacagtccccagagtgtgatgttcctcttcctgtgtccatgtgctctcattgttcaattcccgcccatgagtgagaacatgcggtgtttggttttttgtccttgtgatagtttactgagaatgatgatttccaatttcatccatgtccctacaaaggacatgaactcatcattttttatggctgcatagtattccacagtgtatatgtgccacattttcttaatccagtctatcattgttggacatttgggttggttccaagtctttgctattttgaatagtgccacaataaacatatgtgtgcatgtgtctttatagcagcatgatttatagtcctttgggtatatacccagtaatgggatggctgggtcaaatgatatttctagttctagatccctgaggaatcgccacactgacttgcacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcacccactttttgatggagttgttttttttttttcttgtaaatttgtttgagttcattgtagattctggatattagccctttgtcagatgagtaggttgcgaaaattttctcccattttgtaggttgcctgttcactctgatggtagtttctttcactgtgcagaagctctttagtttaattagatcccatttgtcaatttttgcttttgttgccattgcttttggtgttttagacatgaagtccttgcccatgcctatgtcctgaatggtaatgcctaggttttcttctagggtttttatggttttaggtctaacatttaagtcttgaatccatcttgaattaatttttgtttaaggtataaggaagggatccagtttcagctttctacatatggctagccagttttcccagcaccatttattaaacaggaaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtgtagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgctcccagtttttgcccattcagtatgatattggctgtgggtttgtcatagatagctcttattattttgagatacgtcccatcaatacctaatttattgagagtttttagcatgaaggtgttgaattttgtcaaaggccttttttgcatctattgagataatcatgtggtttttgtctttggttctgtttatatgctggattacatttattgatttgcatatattgaaccagccttgcatcccagggatgaagcccacttgatcatggtggataagctttttgatgtggtgctggattcggtttgtcagtattttattgaggatttttgtatcaatgttcatcaaggatattggtctaaaattctcttttttggttgtgtctctgccaggctttggtatcaggatgatgctggcctcataaaatgagttagggaggattccctctttttctattgattggaatagtttcaggaggaatggtaccagttcctccttgtacctctggtagaattcggctgtgaatccatctggtcctggactctttttggttggtaagctattgattattgccacaatttcagagcctgttattagtctattcagagattcagcttcttcctggtttagtcttgggagggtgtatgtgtcgaggaatttatccatttcttctagattttctagtttatttgcgtagaggtgtttagtattctctgatggtagtttgtatttctgtgggatcggtggtgatatcccctttatcattttttattgtgtctatttgattcttctctctttttttcttcattagtcttgctagcggtctatcaattttgttgatcctttcaaaaaaccagctcctggattcattgatttttggaagggttttttgtgtctctgtttccttcagttctgctctgattttagttatttcttgccttctgctagcttttgaatgtgtttgctcttgcttttctagttcttttaattgtgatgttagggtgtcaattttggatctttcctgctttctcttgtgggcatttagtactataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgatcttttacatttgctgaggagagctttacttccaactatgtggtgaattttggaataggtgtggtgtggtgctgaaaaaaaatgtatattctgttgatttggggtggagagttctgtaggtgtctattaggtccgcttggtgcagagctcagttcaaatcctgggtttccttgttaactttctctctcattgatctgtctaatgttgacagtggggtgttaaaatctcccattattaatgtgtgggagtctaagtctctttgtaggtcactcaggacttgctttatgaatctgggtgctcctgtattgggtgcatatatatttaggatagctcttctttttgaattgatccctttaccattatgtaatggccttctttgtctcttttgatctttgttggtttaacgtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatggagtttcttcctagccttgatggtctttacaatttggcataattttgcggcggctggtaccggttgttcctttccatgtttagtgcttccttcaggagctcttgtagggcaggcctagtggtgacaaaatctctcagcatttgcttgtctgtaaagtattttatttctccttcacttatgaagcttagtttggctggatatgaaattctgggttgaaaatttgtttctttaatatggttgaatattggcccccactctcttctggcttgtagagtttctgccgagagatccgctgttagtctgatgggcttccctttgagggtaacccaacctttctctctggctgcccttaaaattttttccttcatttcaactttggtgaatctgacaattatgtgtcttggagttgctcttctcgaggggtatctttgtagcgttctctgtatttcctgaatctgaatgttggcctgcctttctagattggggaagttctcctggataatatcctgcagagtgttttccaacttgtttccattctccccgtcactttcaggtacaccaatcagacgtagatttggtcttttcacatagtcccatatttcttggaggctttgttcgtttctttttattcttttttctctaaacttcccttctcacttcatttcattcatttcatcttccatcactgataccctttcttccagttgatcgcatcggctcctgaggcttctgcattcttcacgtagttctcgagccttggctttcagctccatcagctcctttaagcacttctctgtattggttattctagttatacattcatctaaatttttttcaaagtttttaacttctttgcctttggtttgaatttcctcttatagctcggagtagtttgatcgtctgaagccttcttctctcaactcgtcaaactcattctctgtccagctttgttctgttgctggtgaggaactgctttcctttggaggaggagaggcgctctgctttttagagtttccagtttttctgctctgttttttccccatctttgtggttttatctacttttggtctttgatgatggtaatgtacagatgggtttttggtgtggatgtcctttctgtttgttagctttccttctaacagacaggaccctcagctgcaggtctgttggagtttgcaagaggtccactctggaccctgcttgcctgggtatcagcagcagtggctgcagaacagcagattttcgtgaaccgcgaatgctgctgtctgatcgttcctctggaatttttgtctcagaggagtacccagccgtgtgaggtgtcagtctgcccctactagggggtgcctcccagttaggctgctcgggggtcaggggtcagggaccgacttgaggaggcagtctgcccgttctcagatctcaaactgcatgctgggagaaccactgctctcttcaaagctctcagacagggacatttaagtctgcagaggttactgctgtctttttgtttgtctgtgccctgcccccagaggtggagcctacagaggcaggcaggcttccttgagctgtggtgggctccacccagttcgagcttcccggctgctttgtttacctagcgagcctgggcaatggcgggcgcccctcccccagcctcgctgctgccttgcagtttgatctcagactgctgtgctagcagtcagcgagactccgtgggcgtaggaccctccaagccaggttcgggatataatctcctggtgcaccgtttgttaagcccatcggaaaagcgcagtattagtgtgggagtgacccgattttccaggtgctgtttgtcacccctttctttgactaggaaagggaactccctgaccccttgcacttctggagtgaggcaatgcctcgccctgcttcggctcacacacggtgcgctgcacccactgtcctgcgcccactgtctggcactccttagtgagatgaacccagtacctcagatggaaatgcagaaatcacccgtcttctgcgtcactcacgctgggagctgtagatgggagctgttcctattcggccatcttggctgccagtcctagaatgtatttttaagcttttgaatttgttgctaatttgatgggtgaaaaaattgacttttattgtaattttaatttgcatttctcttttatatgaatgaaattacatatgtttttacataattaacaagcatttttatatctcctttgagttgtttattcaaatctttgcccatttgtttgtttttttgtttgttttcagacagggtttcactctgttgcccaggctgtagtacagtggcatgatcttggctcactgcaaccttctccttccaggctcaagtgatcctcccactttagccttccaaggagctgggactacagacacatgccactgtgcccaggcacatgccaccatgcccagctaatttttgtatttttttttcatagacatggggtttctccatattgcctaggctggtgtcgaactcttgagctcacatgatctgcctgcttctgcctcccaaagtactgggattacagacatgagtgaccatgcccagcctccctgcccatttttctataggatttctataggttgattttcctcaatttaaaaaaaaaaaatccttgatttattaagaatgtaactatttatctgcgatatatgctgtgaatgtttttcccaattttgtcagttacctttgattttgttaatgagttttctttggctatgcacattttccaacgtatcatcttattttgtttttaattgcatctaggattttagtcatagttaggaaccctttccttacagatgggttttagaggaattcactgattatttcttttggtgcatatatagatttactttttatatttatatctctgatccatttggagtttattcttgggtgtagtggaaggaatgaatctacttttaccttttttcaaatggctatccggtattccctacaccaaccatcctcaacctttttggcaccagggaccaggttcatggaagacagattttccacagaatgggggggtggggtgaaggggacggttttggcatgaaactgttccacctcagaccatcaggcatcacttagattctcataaggagcacacaacctagatccctcccatgcacagtttacagtaggtttcctgctcctgtgataatctaatgctgctgctgacctgagaggagacggagctgtcaggtgataatgctggcttgccctccgctcatctcctgctttgtgactcccagttcctaacaggctatggactggtaccagtccatggcccagggctttgggatccctccccgccctacactgtgtattaaccagagcatctttgacccaatgatttgagataccagttttatcatatactagatgtttatatgtaattggatctaattctagaaattatattttattccattgatttgatagcttattcttgtgccagtaccatactgtttaatgaaagaggtttgtagcatgtttttataccttggagtagttctaccctgcctcctttcccacctttcacagatctttatattcattaatttcctagctattcttgtgtttatttttattattttttgagacggagtctcactctgtcgcccagattgaagtgcagtggtatggtctcggtgcactgcagcctctgcctcccgggttcaagtgattttcctgccccagcctcctaagtagctgagattacagacgcccaccaccatgcccagctaattttttgtatttttagtagagacaggatttcaccatgttgatcagtctggtctcagactcctgacctcaagtgatctgcccacctcggcctcccaaagtgctgggattacagtcatgagcaactgcacccggctgtgtttattttttattttcagtttgaaataaaactaaatttgttccaagcatgcaatacatggttattaatcatagttaccgtattgtacaatagtcttcttgaacttatttctcctatcccactggaattttgtatcctttgaccaatctgtccccagcttcaccttcctccagtccctggtaaccactattctgctctctacttttatgaggagttcaggtttttttgattccacatataagttagattatgcaatatttacctttctgtggatagcttatttcacttaacataatgtcttccaagttcactcatgttgttgcaaatgacgggatatccttcttttttaaggctgaatagcattccactgtatgtatataccacattttctttatccattcatctgttgttggacacttaggttgattccatatcttgtctgttccaaataatgctgcagtgaacgtgggagtggagatatttcttcaacatacctatttcatttcctttggatttatacccagtagtgagattgcttgatcatatggtaattctgtttttaactttttgaggagcctccatattgttttccataatggctgtactaagttacattcccaccaacagtgtgcaaacgttcccagatcttttttaaaaaaagttcaaaagagagaagttaagggtgtccatcactagtagacctgtctgacaacaaatgctaatggaagtccttcagactgaaatgaaagaaccctacactgtaattcaaagccatatgaagaaagttttttgttttccccattgccttttaattggtgagtttaatccatttacattaaaaatataggttattttaagttattatcaataatgaaccacttagttgtgctattttgctgtttttctatatgcttttgttcctcagttcctcctatactgccttcttctttgattgatattttttctagtgccagttttaattccttctccaattcattttgtataattttaaaattattttcttagtggtgtccatggggtttacactaaacatcctgaatttactttgacttgatattaagattacttgaatagcatacattaactctcctcatatctagctctgtcccctcccctttgcattattattattgccacaaattacatctgtatacattgtgttcttgttaacatatatttacagttaatgccttttaaatcatattggaagcagaaagaagggttacaaaccaaaaatacaataatattggcatttatttatctgtgtacttacttttatcagagatctctatttctctgtacgccttcgagttacagtataatgttttctttcatttcaacctgaagatcttcctttagcatttcttaatagggctagtctgttagtaatgggcttctttagcttcttaaaaattttttttaatctaggaacgtcttaatttttcctttatttttgaaggagagtgttactagatatcaaatgcttagtcaacagtttttttcttctttcagcagttagatgatcccactgccttctgacctccatgttttctgatgagaaacctgctgttagtcttattgagaatctttgtatgtgataactcaattcttactcactactttgaagattttctttttatttcagcagtttctttataatgtgtctttgtgtggatctcttttaatttattctgcttcaattcactgagcttctgggatttatagagtcatatctttcagcaaatttggtgtgtttttcatttcgttatttcttctcttccttactgctcctttctccctctcttttccttctttaattctcataatgtgtaagttggtatgcttgatcatttctcccaagttccttctggactgtttatttttcttcatcctttttctttctgatactcagactgagtaaatttccctgtttccaagttcactgattctttcttctggatgctgagatctgctcttgaactcctatattgatttttttaatttcagctcttataattttattttctttcagctattgtgcttttcaactccagaattcctgcttggttaattttataacttctattttttgttaatattacctacttgttcacacattgttctcctggtttcctttcattcctgttccatgcttttctttagctctttgaacatatttaaagtctttgtctagtaaatccaatgtatgggcttccctcagaaattgtttttgtcaattttcttcctgtgcatagcttatactttcctggtttctctgtatgctttgtcatttctagttgagaagtagacattttgagtattgtaatgtggtaactctgaaaattatatttttcctccccagggaacactgctgttactttccttttgttgttgttgttgttgttgttgttgttgttgttgttgagacagagtctcactctgttgcccaggttggagtgcagggatgtgatctcagctcattgcaacttctgcctcccatattcaagtgattgtcctgcctcagccacccaagtagctgggattacaggcatacaccaccacgcccggctaatttttgtttgtatttttagtagagacaggatttcaccatgtcggccaaggtcaaactcttgacctcaagtgatctactcgcctcggcctcccaaactcctgggattataggcagtgagccaccacacccagctggtgctgatacttctcaaaggctgcagttactcgtttatttagtaactttccaaactatttttgcgaaaactatccttgtcatgtttttgcgatattttacaaaaactatccttgtcatgtgtggtcactgaggtctctatttcatattctctacagccagctggtgacctgacagcagtttacctgaatgcctggaaccaataagtaaaggagaaaaaaaataggtgttctgtttctttaaattatttcaacagaggcctccaggaaatctacttctacttgaggggattgaaacattgctggccagtcattgaaccactaggcagattcaaatatacaactctgatttttgttagacagggtccttattttctgccctagcagcaggaagctgcaccaggaacttgggcctttctcccctcactgccttctgcaggtctggaagtgatagttgctgtgcaaaatgctgaaatttaccagcttctttattcatcaagcagtcacctggatgccacaagtcttcagctagagtctagagttctgaaatcattgattctgagagttcttgctagctcaatggtttcagtggaggaattgattactagagcttcttaccctgccattgttgtgtcatcatttagccattatttctgaaaatattatttctgcatcataaattaaaaccatacttagtatccacattctgtttttcattttcagtacagtgttcaataaattaatgaggtattcaacactgtgttataaaatagagtttgtgttaggtgcttttgcccaactttagactaatttaagtgttctgatcacatttaaggtaggctaggctaagctatgacgtttagtagtagatattttcaactcatgatgggtttgtcaggatgtaaccccatcataagtcaaagagcatctgtaaagacaaagtactttagaaaaaaatacagtgataggatgacaagatcagaaaagagattaagcataggtaggtttgctgtagtgctgttgaaatctaaccttctaaaaacggtctgccaaacctgcatctgctcctccttgtaaaagaagtgaaaggtaatataatattatcaagaatataaaattaaacagacgggaactcttgtaactcagtacacaaaatttctaaaacatggccttaaaggctaagcatgtctgtatttttcctttctgtcttgacagaaaaaaatctaacctttctataggtcagactaagcaagttctattaattagcccaaacttcaataggacagattatctgagaatgttcttacttgtagggcactttaattgaaataagactaattctgactcctgattttacgggtgagaaagttgagatccaacaaaattaattaccataaagaacaaaaatctgattgccatttttgttcctttttcaatatacttagtagcccttcctcaaagaaagttttagcacaaaatgtattctcttacttggaattacttctgctgtttgtttctgtatgtaatctgaataaatataatgttaacactggaaaagttcctagaaattagctgttcttcatcttttttggatcaaagatcattttgagaattggataaaatgtgtttgctatgccctgtccatagactactgacttagatatgtaataatttctgacatagatggaaaaacccaagaccaggagatggtaattgtttgaagattcaaaagcaggtcaatgttagaagaaattagaatggtctactcatgcattacccataatagttaagttcttcatattataataatgagatagttttctttcctgtttgccttcccctcctctacactttacaatactagtatcagttttctgagttaatctgcatgttctctgctatatggagacttcttcagtgtatcctcatcatagttagaacttgatttttactcttatttacacatttagttttgccttaatgactgcattgttttccattttatgaaagtcccatttgtttaacctgtctccaatatagaagcttaaatttaaaatatatatgtatgttacattcagtactatggtaaacattctggtacataactgttctgcaagtatatgtgccagaaattcctagaaataaaattgctgggtgaaagaggaagcacaaaaaaaaatttctatgaattactgtttgccttccaaaaagattgaaccaatttgtacctaaccagcaaaacatacagttcatgtttctgtgtaacctcgccatttttaacccttcttttgtgatctttgcaagtctggtaactggaggtatcttacttttatttaatctgtatgtcattaagtattagtgcaattgagctcaatattgttaagatgtcagtttgccccagtgtgacatatatattcagtgtaatcatgatcaaaatcccagcatattttttgtagatattgacaagctaattctaaaacttatgtggaaaggcaagtgaactagaagagcccccaaaatttgaaatggaaaaagaggaacaaagttgagaattcacactacccaattttaatataaggctacataagtcaagccagtggggtcctggccaaaggataaacatataattcagtgagacagaatagagagctcagaaatagacccacacaaatattatcaactgactgttggcagaagctaaaaagaaattccacaggaaaagggtagttttttcaataaatggtactggaacaatgaacagctttatgcaaaaaaaaaaaaaaaaaaaaaaagaccctcaatacgtcaacatgtaccacacaacttgtacaaaaattaactcagaatgcatcatagaactaaaatgtataacataaaactataaaacttctagaagaaaacatttaagaaaatctccataattttgacttaggtgatgagtacttaaaattgacaccaaaaacacaactcattaaaacttttttgagaaattggactttattatcaaaagtttaaacttttaaactttcactctaagaaaggcactgttaacaagaatgaaaagtcaggtgctgaatgggagaaaacatttggaaattccaagtccagcaagtgacttggattatccaaaatatacaaaggactctgaagaacttgccagtaagtgtgataggaagaataatgcccccacacccccatcacccaaagatgcctacatcctaatccaaaagggagtgatgatgtagaagaggaagtcagagatacgatgtgaaaaagactcaatccaatgatgttggcttggaaaatgaagaaagagaaatatgagccaaggggcatgcgtgatttctagaagctagaaaaagcatggaaatggactttcccctagaacctcaagaaaggaacacagtcctactgacaccttaattttaggccagggagacgtctgacaaatttctaacatacagaactgtaagatagtaaatttgtattgttttaagacaccatatttgtgacaatttgttacagcagtaataagaaactaatataggaagaaaacaaaaaagctaattgaaaaaaaaaaagacaaaagatctgaataggtacttctccaaagaagatatatggatggcaaacaaggatatgaaaagatacttaacatcatttatcattacagaatggaaattaaaatcacaattagatgctatgtcatagttgctagaattgttacaaacagacaataaataaataatggcaaggatctggagcagcaggcattctcatttattgccagtgggaatgcagaatggcatagccactttggaagtcagtttgatagtttcttaaatatcacttctgggtatttacctaaatgtattgaaaacttttgttcacacagaaacctatatgcaaatgtttatagcagctttatttataaattgacaaaaactaggaacaaccaagatgtctttcagtaagtggtacagtggaatactactcaaccatgaagtggagtgagttggttattcctgcaacaacatgaataaatatcacatgcattttgctgagcaaagctagaactaaaaggcagtgtatagtattattccatttacatgacataccggaaaaggcagctaataagaacagaaaacagataggtggttaccaggaggtgggggaggggtcagctgcaaaaggggtgtgatagaactgttgttctgtgtggtaatgggatggtagatggattctatccattcatttgtagaatgaactttcctggtgtaaattaaaaaatcaaccaaaatgtcaggggatcccaggatgaaatggaaactataactgatgaatctaactatattataaatgcatgacatatcttaatgaaagtggtaggggggaaaggaactgacctaagtaactttggaaaacaggtaatgttttgactggataatgtaagactaaagacaaaaacattgaactctagttggtaaatttgtttcttacaggtacagattagcagtcctaaaactactctacctctattctaggaatgaacaataagtgaacatattgtgggtgtttagagccaagtttctctctgtcagagtaagaagttacaagtaaacaacagggaaactagaatgaactctggctctggagagatgtatgagcagagattcatgtttattttaatatgtatatggataaatatatatagaactaacctcagatatgagtggatacatggcttagtgtacatgtatgtaaaggcctagaagcagtgtcaccccggtagctacagactcattcagcgtctaccctaatcttggtttctgcataccatttttcaataaaaggaagcagggcttcctggagaaatggctaatgctgcatctgggacaggtaaaatacaagatgagcctggagtatcttatggggtcagaaagtaaggaggtacttttttttttttttttaagcacggaacagtttcagcaacaaaatgggatgttatattttactcagaaaacatccttcaatccatactgatataaacaaatgaattgatgaattcttcggagaaaacagacaaatcttccttaaggaataatttttaataattatataaatactatccccttctggaggtgagcttttctctctccttgtggactggacttagtgatttgtttccaaagaggacaatatggaaaagaaaaaaggaataactttatagttaggaaatcagtcagactccaccttagtcaagtgttaagtgttaaaatcaccagtgataactcatgtggtagcacatctgtggtattagtcccataacccacaatcccagcctgatcatgagaacatattaaaactcagattgaaggaaattttacaaaatatgaaatacctgattactactcttcacaagtgtcaaagccataaaaaacaaggaaaagtctgaaaagctatcagattggagagaccaaggaaacacgacgattaaatgcaaatggaatcctagattggatcttagaatcaaaaaaagatattagtgggaaaactggtgaaatacacataaagtctgtaattcagttaataataatattgtaccagtattaatcatttaattttgacaaatgtaccttgattatggaagatgctaacgttaggagaagctcaatagaggatatctgggaactctctgtactctctttgcaactttcccgtaactttaaaattgtttcaagacaaaatgtttatttaataaaggtacattctgtcaacaaatatttatgcaaatgaatgagcatctcttcgttgatcatccttttattaattgcctattataatctttgtccattttttaggttaagtgcactattacatgttattgctatctgtggcttgttttgggctctttataaattatatcaatacctgaaaaagcttgtttatattatttacacactatttttgagactttgtgttctaaaaggaaggcttattttaaaagttggttgttgtcttctctgctttagatgctgggagcttttgcacatgctgtctcaatccatgttaggtatgtgatgtttacccactttgcagataagaaaactgaaactcgggggttaacccatttatgccggcggctgcaaaatttttttttgtgaaaaatcagaccttggcgatgaccttgagcagcaggatataaataactcccacaagcttagcgttccaataatggaacattgggcataaatgttaataacttgccaaaaatgaaatttagcagggacaggatttaaatgcagttcttgctttagtctcctttctttctaatatgataatttgcctttcctgcaatataataggaaaaactcagagaaattattttagatgatttagaattaaatgacatagatttacaaaatgtaatataaaagaccatatcttcttttctgcttgtaagtgtgccaacttgattaaagaaatgataaaagtaaagtattggcacatgctacaacatgggtgaaacttcaaaaaatgataaatgaaataagtcacaataacccatgtgttatatagatttcatttatatgaaatgtccagagtaggcaattctaaggaacagaaagtacattattgattgccaagggctggatacagggaggcttggagaatgatggctaaggagagtggtgtttcttttgggggtgaaaactgttctaaaattgattgtggtgacagttgcacaactctgtgaatatactaaaagtcactgaataaacactttaggccaggcgtggtggctcaagcctgtaatcccagcactttgggaggccaaggtgggcggattgcttgagtccagcagtttgagaccagactggccacgatggcgaaaccctgtctctgctaaaaatacaaaaattagctgggcatggtgacacacacctgtaatcccagctacttgggaggctgaggcatgagaatcgcttgaacctaggaggcggaggttgcagtgagccgagatcatgccactgcactgcagcctgggcgtcagagtgagacttgtgaaaaaaaagaaaaaattaaaaaaacacactttaaatggggacttatatggtatgtggattatatctcaataagttgttaaaaaataattaaattgcatcagaagacaaaaagatgtacatatgactatatttactgcagcactgcttgtaatgacaaaatacttgaaacagttaatttgactcttgtgtgatatgtaacctaaggatgaaaacaacctttaaaactgtaaactgctttctgtagtgacactgtggatagtaaaaaagctgacttattctaagattacaagatttgtgttttgtgataagataataagtaattttgttggtatagcaaaactgggattttgggttctggagaaagaagaaacaatgaaagatatctgagtttcagtcaatatcctgaagcgctaaatttctactggaaatatcactataatcttatgttgactttgccttcaaaacaagtgcatatatcctagctccatccactgaataggcctagaaataagaaccacttcagcaataatgaaatgtgactacaaaagtatttattttccacttaaatgaacaagggctcctgggagaaatgtctgattcaagatctatggcaggaaatagataagtctggaataccttgttataccaaatagcaaaaaagatgtcgaaaactactaggtttgggtcaaaaagattcaggataagctgaatccaacttgaagagacttccaaaggccaaagagggggatgcagatgatatcatcttgtatgtagaaaagtctctgttgatattagagagtatcagtactaatatcaaacatgtttaaatccatgtgttcatgatcttactaaagaaaaactcccttgaaagatattagggaaaaaaatccaacatttatatccaatttgactataccagttgtaacttgaggtaagcaagtaattgagtagaggaatgttttctctatggacatatctaacaaataaatgaaggaggaaggaatgagaattagagtattaccatttttgtaatctttaatgaaataatgatcattggcaatgtagagacaaccagccattatatggctcctaaaaaaggtgtacaacatgccgggcgcattgactcacccctgtaatcccagcactttgggaggccgaggcaggtggatcatgaggtcagaagatagagaccatcctggcaaacacggtgaaaccccatctctactaaaactacaaaaaaattagccgggtgtggtggcgggcgcctgtagtcccagctactcgggaagctgaggcaggagaatggcgtgaacccggtaggccgagcttgaagtgagccgagatcacgccactgcactccagcctgagcaacagagcgagactccatctcaaaaaaaaaaagaagtgtacaaggtaagttatgaagtaatcttgccataaaacaaaaaggcaagcctgaagtctctgtcttactaataaaatacaggaaatacagtgccaaaggaacgtgtttaaatttacagaacaagacaggttgttcaatatatacaaatttaaaattgccctaaaagagaagacaccataagctaagttagagacaacatgaacatgcatagaacagttctataaaaaaacacaacaaactaataactgtggtttctaagggttagaatttgaggctgatgggcagaaaggaaagggtaattgctttttaatacacatttctctctgcattttgcattttgtgctgtattacttttttaaaaaacatgaatttttaagtcacaggaaaagcaccaagatattaaaagtgctacttcagtgaacatacaaatgataagtgaagtagccttattgctggtatggagaaaattgtacttgtctggatagaagatcaaaccagccataacattccctcaagacaaagcctaatccagagcaaaatcctaactctattcacttctatgaagactgagagaggtgaggaagctacagaagaaaagttggaagctagcagaggttggttcatgaggtttaaggaaagaagccatctccgtaacataaaggtgcaaggtggagcagcaagtgctggtggagaagttgcagcaggttgtccaaaagagctagctaagatgattggtgaatgtggcttcactaaacaacagattttcttttcttttctttcttttttttttttttttgagactgagtctcactgtaccgcacaggctagagtgaagtgacacaatctggttcactgcaacctctgcctcctgggttcaagtgattttcgagtctcactcagcctcccaagtgattctcatgcctcagccacctgagtagctgggattacaggcacctgccaccacgcccagctaattttttggtagagacggagtttcaccatgttggcaaggctggtctcaaactcctgacatcaagtaatccacctgccttggcctcccaaagtgctgggattatgggcatgagccaccatgcctgactcaaaacaacagattttcaatgtagatgaaacagtcttctgttgaagaaaatgccatctagaactttcctagctagagaagagaagtcaatgcctggcttgaaagcttcaaaagacaggctgattctcttagtacaggctaatccagctggtggctttaagttgaagccagtgctcacttaccacctgaaaatcctagagccattaagaattatgctaaatctatcggtgctctagaaatggaacagcaaagtctggatgacaggacatctttttacagcattgaacgttttaagcccactgttgagacctactggtaagaaaaaaagattaattttcaaaagattattgctcattgaccacacacttggtcatgcaagagctctggtggagatgtacaagaatattgttgttttcatgtctgctaacaacatccattctgcagtttgtggatcaaggagtggttttgactttcaggtcttatcatttgataaatacatttcataagactgcagctgccatagatagtgatttctctgatggatctgggcaaagtaaattgaaaaccttctggaaaggtttcaccattctggataccactaagaacatttgtgattcatggaagtaggtcagtatattaacattaatatattgactctgaaaggagttgattctaaccctcacggatgactctgaggggttcaagacttcaggatcggaaataactgcagatgtggttgaaacagcaagagacctgtgagattagaagtggagcctgaagatgtgactgaattactttaatctcatgataaaaatcaaacagatgagtttcttcttatgaataaacaaataaaatggtatcttgagatggaatctacttgtggtgaagatgccgtgaacgttgttgaaatgacaaaagatttagaaaattacataacattagttgataaagtgatggcaaggtttgagagcattgactccagttttgaaagtcgttctcctgtgggtcaaatgctatcaaacagcattgtatgttgcagaggaattttttgtgaaaagaagtcaatcagtgcagcaaatttcaatgttgttttattttaagaaattgccataagccaactaaccttcagccactaccacccttatcggtcagaagacaccaacatcgaggccagaccctctgccagcaaaaaaattacagttcactgaaggctcaggtgattgttagcatttttttagcaataaagtatgttttaattaaggtgtatacattattttttagacatagtgtgattgcacaggtaatagactatagtatcatgtaaacatgtaaatgcaacaattttttttgcagacacaagtatttgtatgacttgcttgattgcagtggtgtggaacagaaactgcattatctttaaggtgtgtcggtatttgggaagagaagttctcatttcactgaatttgtagcttggaaaatataagtcttgactggtatttaggggctaccatattcaaatagctagcttgagagtgaatgaaaaaggtcaaaagaaacactgagagatggagataaactgatcctgataacattttttttacccttcggatccactcatgcctggaagaaaacctgtcagtgttttgttttgttttctttttaagcaaatactccctctgcccacacactttatgctttaaaacaaaaggccatgttgaacttgtagaaccaaatgattgctaattacttggggcgatactagtgatatattatcttacatacacacacacaaaacacacacacacacacacacacacacacggcttgagtccagcatggcctactgattttaaaataggaaatgacagtgtaaatgccaggataaaggacaaagtgctctgacctgttgccaaacctttttttccacagctacagtgcacctatattctataatagtcagtgcaactcttttttgtgaattgtttacatgtctgacttcttgtttggattttacttggtgatttgatatgaatttttaatgtgaaagcacttagcattaggagtttgacattttgtctgacctgaatcaccaagaggatcatgtgaggtttattcagtgggaagagaactgttacagctctgacagaaatgatgggaaataagtaaacagccttttaaatcttcaccagaaatcaatagggtttaaagatgatggacgttggtgttttttgctgcttaaggacttcaaccttttacgggaaaatatcttctctacgtgtcagcagttttttccatgcacacaatgaatcgctgctgcaaatagaacattctgcatagaacattcttcatcattattataagaaagaagctgtgtaagactggccttggtaatgtagagccttttggggcatttttgtatgaaaagagaggaccatatcttacaattttgttttcatcataagtgtaatttatgtgccaaactttttcctcaactaaataataacagtttttatatactgagaacctcctttgtactgggcattgactgtgtgatgttttaaggtagattatttgaccccactttatagatgacaaaattggagcccagaggctctaagttcgtctgactagtgatagaactgatacttaaaaccctagtccatctgagtttaaagcttatccttttactactttccagctgtgtctctgaggacaggcactcaataggtgttcttgcccttggttctatttcttcggtagtggtatctcttattttctttctccttttccccctagtcagtaaaactaatataagtgatggccttcacatcatttaataagaggataagagctacatcatggtcattgaataaaagaatatgggttaagaactgcttcccagtatactctgcagatttgatttattatgaatgatttatgagatattagattgctgtatagtagttagcagtgtattcacaatcagctgcactctaatgccaagtgttgaaatattaactgaacgtatcatgtagtgtcctttgtttataacataataatcttgactttacaaaatagttaactttccagctgtttaatttgtacatatcattgtacaactgttatctttgagaaagcagcttatttattttgtgatttggaaatagtctttgtaattcaaactaagaaaatcaacttagttttgtaataataaatatcatggaacatacactgctaaataaaaattttcacataaaacctcctgatttgatgttattttacatttaaaggcacattacttaattggaatttttataaaggaaataagatagcttcttaccagtttattgtaatacatgtaatatgttagatatgtcgaatgcaattactatcagatgaacagttcttttcctactctttcatgaatctgttttagagcagtcacttaatgtttgtcgtttttcatttccttattaaaactgaaataaatgaaatgacctgagaatccttctaactctaaaattgtgtaactttttaggcttagaattttgacttgaagtcattttttccttcacatacttctaattaataaaaccttaaaaataatttttgttacagcatttctaaatgttcttcttcctagcccttaaagcagatatttttctaatatccagttgccttctttgaattggcaatactgtgttacacacctgacttgcgctcatctcaaatagaatatcttacctttgtttttcattaaaatacacacacacatatagaatatatgtggcattgttactccaggcaccttcaggtgtcagtaaaggaatgatgattaatcagccattttcttgtgtttctgggagcctgaagttttcaggtacatgaggattaattctatatttgataaaagagccagttgatcagttcgaataggtaattaactgctaagcttgtaagaaacatttcaacttgtgatgagaggatgatccttaggcaatctcagtgtggcagaagctataatcaatgtatgcatctcagataaaattatagtctcatctaccctttgctcaacatttttacactgacccagtacctctaaaaagagaatgtagtagaaatcaggaagcctctgttctagtgtgactctgcccctaattttctggtcacataaattggaaggtcacataaccttttaaggcctgagctttcttgtctgcaaaatgagggtgatagaacctattaaacagttattgtgggaattattttagttaacatatgtgaaagaatttgaattcttaaataacttctgctttgccagacaatttaggtatcttatttgctagtacaagtttttgtaacctggatttggtgtgtaaccttagatagactgtagcattttgggtatgatcagatgtaacctctttaaagaaaaaaaaaaaaaggaacagctgaatttatttacttcttgtttcaaggaagaaaatcgtagttgcctctcctatcaagtaaacatgtccatttttaaaagacagtcagctccccaacagggattataaattgaacaaatgaaagacggcttttcagaataaagtattcaatttaattcattttcttttcttgtttgactttgaacttttaatcttcttggtaaatatcaaaggaattccctagttactttgcatttacattttgcattggttactgtcatggactgcatatttgtgtgccctcaacattcatatgttgaaatctaatcccaatatgatggtatttggaggtgggacctttaagaggtaattaagacatgagagtggaaccttcatgaaagacataagtgcccttataaaaagatgccaaaaagctagcccactccttccaccatgtaaggagagaatgaaaaattggtagtctgcaacccagaagagggccctcaccagacctgactatgctggcacccttatattggacttccaatcttcagagctgtgagaaataaatttctgttgtttctaagccacctggtctatggtattctgttacagcagcctgaactaagacaattacagttgacccttgaacaacacaagtttgaactgtgcatgtcaacttctacattattttttctctgttcagtcaaggatggaaaaatacattattaatgtaatgcaaaacctatatatgtggagggccagctgatatggtgtggctgtgtccccatccaaatctcatcttgaattcccacatgttgtgggaggaacccagtgggaggtaagtgaatcatggggcaggtctttcccatgctgttctcatgatagcaaataagtctcacaacatctgatgatattataagggggagtttccttacataagctcctctcttgcctgctgccatgtgagacgtgcctttcaccttttgccatgatcgtaaggcctccccagccacttggaactgtaagtccaataaacctcattcttttgtaaattgcccagttgtggttatgtcttttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctcccccgaccccaccacagtccccagagtgtgatattccccttcctgtgtccatgtgttctcatagttcaattcccacctatgagtgagaatatgcagtgtttgtttttttgttcttgcgatagtttactgagaatgatgatttccaattccatccatgtccctacaaaggacatgaactcatcattttttatggctgcatagtattccatggtgtatatgtgccacattttcttaatccagtctatcattgttggacatttgggttggttccaagtctttgctattttgaatagtgccacaataaacatatgtgtgcatgtgtctttatagcagcatgatttatactcatttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccatttcttgtttttctcaggtttgtcaaagatcagatagttgtagatatgcagcgttatttctgagggctctgttctgttccattgatctatatctctgttttggtaccagtaccatgctgttttggttactgtagccttgtagtgtagtttgaagtcaggtagcgtgatgcctctagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggaggggtgagagagggcatccctgtcttctgccagttttcaaagggaatgctcccagtttttgcccattcagtatgatattggctgtgggtttgtcatagatagctcttactattttgagatacgtcccatcaatacctaatttattgagagtttttagcatgaagggttgttgaattttgtcaaaggctttttctacatctattgagataatcatgtggtttttgtctttggctctgtttatatgctggattacatttattgatttgcgtatattgaaccagccttgcatcccaaggatgaagcccacttgatcatggtggataagcgttttgatgtgctgctggattcggtttgccagtattttattgaggatttttgtatcaatgttcatcaaggatattggtctaaaattctctttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcacagattcaacttcttcctggtttagtcttgggagagtgtatgtgtcgaggaatttatccatttcttctagattttctagtttatttgcgtagaggtgtttgtagtattccctgatggtagtttgtatttctgtgggatcggtggtgatatcccctttatcattttttattgtgtctatttgattcttctctctttttttcttcattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcattttgttatgtacccagtagtcattcaggagcaggttgttcagtttccatgtagttgtgcagctttgagtgggattcttaatcctgagttctagtttgattgcactgtggtctgagagatagtttgttataatttctgttcttttacatttgctgaggagagctttacttccagctatgtggtcaattttggaataggtgtggtgtggtgctgaaaaaaatgtatattctgttgatttggggtggagagtagtgtagatgtctattaggtctgcttggtgcagagctgagttcaattcctggatatccttgttgactttctgtcttgttgatctgtctaatgttgacagtggggtgttaaagtctcccattattaatgtgtgggagtctaagtctctttgtaggtcactcaggacttgctttatgaatctgggtgctcccgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatggatcttgactctttatccaatttgccagtctgtgtcttttaattggagaatttagtccatttatatttaaagttaatattgttatgtgtgaatttgatcctgtcattatgatgttagctggtgattttgctcgttagttgatgcagttgcttcctagtctcgatggtcttgacattttggcatgattttgcagcggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactcttctggcttatagggtttctgcagagagattcgctgttggtttggtgggcttccctttgtaagtaacgtgacctttctctctggctgcccttaacatttttttctgcatttcaaccttggaggatgtgacaattatgtgtcttggagttgctcttctcgaggagtatctttgtggcattctctgtatttcctgaatctgaatgttggcctgccttgctagattggggaagttctcctggataatatcctgcagagtgttttccaacttgtttccattctccccgtcactttcaggtacaccaatcagacgtagatttggtcttttcacatagtcccatatttcttggaggctttgctcctttctttttattcttttttctctaaacttcccttctcgcttgatttcattcatttcatcttccatcactgataccctttcttccagttgatcgcatcggctcctgaggcttctgcattcttcacgtagttctcgagccttggttttcagctccatcagctcctttaagtacttctctttattggttattctagttatacattcatctaaatttttttcaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagaggtgctctgcgttttagagtttccagtttttctgctctgttttttccccatctttgtggttttatctacttttggtctttgatgatggtgatgtacagatgggttttcggtgtggatgtcctttctgtttgttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcatatctccagctgcgtgctgggagaaccactgctctcttcaaagctgtcagacagggacatttaagtttgcagaggttactgctgtctttttgtttgtctgtgccctgcccccagaggtggagcctacagaggcaggcaggcctcccttgagctgtggtgggctccacccagctcgagcttcccggctgctttgtttacctaagcaagcctgggcaatggcgggcgcccctcccccggcctcgctgccgccttgcagtttgatctcagactgctgtgctagcaatcagtgagattccgtgggcgtaggaccctccgagccaggtgtgggatataatctcgtggtgcgccgttttttaagccggtctgaaaagcgcaatattcgggtgggagtgacccgattttccaggtgcgttcgtcacccctttctttgactcggaaagggaactccctgaccccttgcacttcccaggtgaggcaatgcctcgccctgcttaggctcgcgcacggtgcgtgcacccactggcctgcgcccactgtctggcactccctagtgagatgcacccggtacctcagatggaaatgcagaaatcacccgtcttctgcgtcgctcacactgggagctgtagaccggagctgttcctattcggccatcttcgtggttatgtctttatcagcaatgtgaaaatggaccagtatagtaaatgggtaccagcagagtggggcactgctgaaaagagacccgaaaatatggaagcaactttgcaactgggtaacaggcagagactgaaacagttttgagggctcagaagaagataggaaaatgtggaagagtttggaactccctagagacttgttgaatggctttgaccaaaatgctgataatgatatggacagtgaaatccaggctgaggtggtctcagatggagatgaggaacttgttgggaactggagcaaaggtgactcttgttatgttttagcaaagagactgccagcattttgaccctgccctagagatttgtggaatttgaattcgagagagatgatttaggctatctggcagaataaatttctaaacagcaaagcattcaagaggtgacttgggtgctgttaaaggcattcagttttaaaagggaaacagagcataaaagtttggaaaatttgcagcctgacaatgtgttagaaaagaatatcccattttctgagaagaaattcaagctggctgcagaagtaaggaggagccgaatgttaaccactaagacaatggggaaaatgtctccaggtcatgtcagagaactttgcagcagctgctctcatcaagcccagaggtttaggagaaaaaaaaaatggtttcatgggcagggcccagggtccctctgctctgtgcagtctagggacttggtgccctgtgtcccagtcactccagctgtgattaaaagggcccaaggtacagcccgggctgttgcttcagagggtggaagccccaagccttggcgacttccacatagtgttgagcctgcgggtgcacagaagtcaagaattgaagtttgagtacctctgcctagacctcaaaagatgtatggaaacatctggatgcccaggtaaaattttgctgcaggggcgaggccctcatggagaacctctgctagggcagtgcagaagggaaatgtggggtcagagctccctcacagagtcccttctggaacattgcctagtggagctgtgagaagagggccaccatcctccataccctagaatggtagaaccaccaacagcttgcaccgtgcatctggaaaatctgcagacattcaatgccagcccatgaaagcagccaggagggagtctgtaccctgcaaagccacagaggtggagctgcccgagaccatgggaacccacttcttgcatcatcatggcctggatgtgagacgtgaagtcaaaggagatcattttggagctctaagattttacttcctcactggatttcagatttgcatggggcgtttagcccgtttgttttgtccagtttcccccatttggaacggctgtatttatcaatgcctgtacccccattgtgtctaggaaataactaacttgcttttgattttacaggctcataggcagaagggtcttgtctcctcttggatgagactttggactgtgggcttttgagttaatgttgaaatgagttaagactttgggggactgttgggaaggcatgattggatttgaaatgtaaggacatgagatttgggaggggccaggagtggaatgatatggtttggctgtgtccccacccaaatctcatcttgaattcccatgtgttgtgggagggacctggtgggaggtaactgaatcattgggcagatctttcccatgctgttctcatgatagcgaataagtctcatgagatctgatggtattataaggggagtttccttacacaagttcctctcttgcctgctaccatgtgaggcttgcctttcacctttcaccatgattgtgaggcctcctcagccacatggaactgtaagtccagtaaacttctttcttttgtaaatcgcccagtcttgggtatgtctttatcaatagcatgaaaacagactaatacaccagcttttcatatatgcaggttccacagggccaactgcaggactggaatatgcacggattttggtatatgtgagggatcctggaaccaatccccagaatacactgagggacaactgtactataggtttttatgtttaaatattttattttgatgaagtgatctttaatggttcattctagtaacccaaggatatgctttaaatttattgaagtcaataggaaaatgtgatttaatacttaagaaattgcagtaaaacaaaggaaaaaaatttcctttctgagaattcttatttgcctttgatatctaattcttatggttaccatttggcatttagtgaacccctaataatatattgaatgatacttcaagttatgttacagatctaagaatacttggccaaactgatctatgactacaaaaagaaattctgttgcagtgactcatacaacaaaaatgttcccagtttgtgagtgacgctctgtgttatatttacttccctaatatatagtcacctttcataatagtgtcagcataatatactaagacaaagaggatctactgaaacttctcttgcaaccattaggacaaacccggtataagactatgcctccagttacctgggtgaccttaccctgttaaagtcttatttataaaatgagggctgacactggattattgctaaggttctatctatctggagaaattatcaaccaggagagcttaatggtatttgtcacctattcttatttttcctaagagatctttttcatatgatagtgacatgatcattctgatgaagtccttccagcttctaataaaatctaggaaacacagttgttattcaccccatagtaatgaagaaacctgtcctgtgcactacaagaagcttcttatgttctgagaagaattgttattcacctttgatctctagtccttaaactctgtagtcggcatttaatggatgtccactaatatttagtttggtttgtgttgcatattatggaaagcactcatctatatttaatgtctatgccactgcctgtgaatttgtgggaagacaagtgtattgtaaagtcaaattcctgccactccaattttctaccagcatctaagtcctcacagctgtgctttagtgccccaaatttgttattaagcccataatcccagctacttgggaggctaaggccggagaattgcttgaacccaggaggtagaggttccagtgagccagggtcacaccgttgcactccagactggacaatagcagtggaactcagtctcccccaaaaaaaaaaaaaatagacatttttatacatatcacggacaggttttatatatgatcttgtttcttgtggactgtaagctacttgaggttaaaagctctactttatttatttatgtccctccactgtttactactacttagcacatatacgacaatcagttacatttactaagttgatgattataaggaatcacacacgatataatagctgagttgttaatgaaaaaaaaatcagtttctttgtaatgattcctctctaccagaaaaacaatcaagaacccgttgtatgtggtagcttatgtaagagggaagcttctggaaaagcacctgccaattgtcactgttatattttcagagacaaaagacaaatatagtcacaatcactggtataattttcatgacctctaaacagttctgtattttttaatgactacagaaatttattggttattttcagtttagttttatgcagtctggcaaagtaatcagattaagtatgtatgtatcacacactttttcacttatagcagtaatcctttatctgcatcagtctaatttagtgctttgggcaatagagtaatgcagactaaatcaaagctggatatgagccaagatgatgagttggaaagatccctggctttgtaattagatagacctggattcccattaattgaggtaatgaatgtaaaatactgaacacagtgcctggctcctggtaagttgccccataaatggtagctaatgttattttactttaaagagtgcatagtttttaaaataatcattaggtaggaagagctgtggtaaaggagtgaagtttgtttccttgaaagtacagtttaccagcatgcagtatatcttgttatttgttagctctgtggaaacatgcctacctaaaaaggagactcaggttctgaaacagaccaagaatgaaagcaccaactaactcttttgtgaggccttgtgcttttttattcaatggaagataacagtcatcagattggggtagggtctaatggtggcagccaactagtgtgtgttttaattgtgtgtgttgcatgatgagaggtttaatgccttaggcaagtcactagatgagctcaactctaagagtacattttctttagtaaaaataaggccaatactatttgtgttgcaaagttatgaagattgatgattatgtcagtaaaatgcccagtgcctggcattttgaaaatgctcctataaattgaaccttaatttttctcattattatcattgttatttttatataatgatctgtgtatttaaggtgggtttgtcctttgaggatcctcttcgcaatattttcctgttgcttagaaacacatcctttaaataacaatagaagctctctatgcatctgaaagtagaaatgctcttaactttttactattcccacctaagcttgtcttctaacattacttctgatctttcagaagtacgttctcttcgtgtaaaggaattatggaagagtttgctgtctggctaatcttgctatatggtagtatctgcagttttcccaagaggaatgcgttcattttgtgctatctaattgccagtcttaatgtattcatattggcaagttttcagtattctgtccctacttttttccttttccctgttggctgtggtttgactttgttcccccaaagtttgtgtgtttgaaacttcatcccaatgcaatagtgttaggaggtgggatctaataagaggtgattgggttgaataaagtaagtccaatccctggtgcctctctcttggtccctctgtgtttgcttgctattccaacatgttataacatagcacagaggcccttgtcagatgctggtaccatattcttggacttgccagcctccagaactgtgagccaaataaatttcttttctttataacttaactagtctgtgatattctgttatagcaacagaaaacggactaagagacttgtgatgatttgatttaattttactttttcctgatagttttaagattttattctaaatacactctcactgaagagttcgtaatgccatcttatattattttactctatatttttgtctttactctctatcctttgatgtacttgttgtgacaactttaatcatgtttagactggtttgtggagaagagaggatcacaacaggtacagaaataggctatagactttatatggctgttgtcagtcttttctattttattatcttggagttgaacttatgtaggacattactggctacggtaaagaaatcaaataaaaagaaaggacagttctttcaatcttgtattagatttatagcctaccaaaggaactccattgttgatgctgataaacaaatgaatggaaattcagaatggttatagtagtccagtgagctttggaaggttgtaagctttctgggccttagttttcttcagtacaaaatggacatattaactgagctttctatttccgtggattgtataaagatcagatgaaatatagttcacccttgaacaacacaggagttaggggaactgacacccccccgacacacccacacagtcaaaaatctgagcgtaactttagactccccaaaaacttacctgctaataacctactgttgactgaaagccttaccagtaaaatgaacaattaacacacattttagtgttgtatgtatttgtgctatgtatgcccttaaaataaaggaaggtaggggaaaaatcatgaagagaaaatatatttactattcatttagaggaagtgggtcatcacaaaggtctttattctcatcatcttcatgtcaaggatgctggaggaggggaaggggctggtcttagtgtctcagaggtgacagaggcagaaggagtaagccgagaaggtggaaggggaggaagaagtggcaggcacatttgatgtaacttttattgacaaatatctgcatataagtggacccgcacagttcaaacctgcattattgaaaggtcaactgtaatgtgaaacacatataaaaataatgtgtctatcatcaaagcattatatacttcatgattttaaagtgttagtgaccaagtaatcctttaaggaaagagactgtgttgccatatcatacttattaacttattgttgtctgtcttccaaaaaggatttgaagcaaaagtcactaatgaagtcattgaattgaatatgttattggtgatagaagtgaagtgagaggaaatccgaggagaaatgctttgtaagaatgttgaattcatttgctacataggcagtaaatatttaggtagcacatcttcatagaaggaataaaatgtgcaaattggattgttgttggcaaagactgatttttaaaacaactgtaatacacagtagatctaaagagatactgcctaccaaagggtaagagaaaaagattaggataataaattacaaattagcttgactttgagaatttgggggaaatgttgaaacttacagagaaagaataaatttagggaaataataatgtaaccaggatagggcctgaattttttatatctgtatgtaaagaaggagctggttcttattaacttttctgaagatctgatatgtactttaaagcctactttatcaacaacaacaacaaaactctgtgaagaaggggtggagggatgtttctaagatcttagagaaaattgtaagtatatggtagaactttaagaaaatcatctttagtacaagaaggattataatggttttggttgaagttattcagtgttgattgtgaccatgtaactaaagtttgtgattcttgaatttgtgttttttatacttatgttttacaaaaagattttatttcttcttcaaggaggttgtaagaattttccctcgattttctaaatctaatgcagaaattgttccaggctatgagtaagtagtggagggaagaaatttgagtcatgttacctccatttttagtgtctctctttagcttgtcccttcctttagtcaaggtatctgttagatttataaaaatttagaataccatatccctataatttttcatctaataatctcattgagaaaacacaggagaagttggaaagcaaatagtggtcactgagtgcttcttatgtatcaaattctagatgttaatatgtaatttaatcttcagaaagggctgttagaccataagctccttggagcacagctttgggtcttcatctatgtaatctctctaattaactgtacgtttaataagtgtatacagttagatacacagtgaatgagtaaacaagtctgtaaattattgtcctcattttagagaaaatgaaatgggtgtctaagaaattaagtctatcaatagtcccatagctactaagcggcaaaaccttaacctgtatgtagtctttttattattattattattattattattattattattattattattatactttaagttctgggatacatgtgcagaacatgtaggtttattacataggtatacatgtgccatggtggtttgctgcacccatcaaccagtcatctacattaggtatttcttctaatgctatccctccccttgccccacactccccaacaggccccagtgtgtgatgttcccctccctgtgtccatgtgttctcatttttcacctcccacttatgagtgagaacatgtggtgtttggttttctgtttctgtgttagtttgctgagaatgatggtttccagcttcatccatgtccctgcaaaggatatgaactcatccttttttatggctgaatagtattccatggtgtatatgtgccacatttgctttatccagtctatcattgatgggcatttgggttggttccaagtctctgctattgtgaatagtgctgcaataaacatacgtatgcatgtgtccttatactagaatgatttataatcctttgggtatatacccagtaataggattgctgggtcaaatggtatttctgattctagatccttgaggaattgccacactgtcttccacaatggttgaattaaattacactctcactaacattataaaagcgtttctattttttcacatcctctccagcatctgttgtttcatgactttgtaatgatggccattctaactggcatgagatggtatctcattgtggttttgatttgaatttctctaatgaccagcgatgatgagctgtttttcatatatttgttggccacataaatttcttcttttgagaagtgtctgttcatatcctttgcccattttttgatagcgttgttcatttttttcttgtaaatttgtttaagttctttgtagattctggatattagccctttgtcagatggatagattgcaaaaattttctcccattctgtaggttgcctgttcactctgatgatagtttcttttgctgtgcagaagctctttagtttaattaaatcccatttgtcaattttggcttttgttgcaattgcttttggtgttttagtcatgaagttatcacccatgcctgtgtcctgaatggtattgcctaggttttcttctagggtttttatgcttttaggtcttatgtttaaatctttaatccatcttgagttaatttttgtataaggtgtaaggaaggggtccagtttcagttttctgcaaccccgtttcttaaatagggaattctttccccattgcttgtttttggcaggtttgttaaaaatcagatggttgtagatgtgttatttctgagggctctgttctgttccatttggtctatatatctgttttggtaccagtaccatcctgttttggttacagtagccttgcagtatagtttgaagtcaggtagcatgatgcctccagctttgttctttttgcttaggattgtcatggctatacgggctcttttttggttccatatgaaatttaaagtagttgtttcctaattctgtgaagaaagtcaatggtagtttgatgggaataacattgaatctataaattactttgggcagtatggtcattttcacaatattggttcttcctatccatgagcatgggatgtttttccatttttttgtgttgtctcttatttccttgagcagtggtttgtagttctccttgaagaggtccttcacatcccttgtaagttgtattcctaggtattttattctctttggagcaattgtgaatgggagtttgctcatgatttggctgatattggtgtataggaatgctcgtgattttcgcacgttgattttatatcctgagactttgttgacgttgctttttggcttaaggagattttgggctgagatgttggggttttctaaatatacaatcatgtcatctgcaaacaaagataatttaacttcctctcttcctatttgaataccccttatttctttctcttgcctggttgccctggccagaacttccaacactgtgttgagtaggagtggtgagagagggcatccttttcttgtgccagttttcaaagggaatgcttccagtttttgcccattcagtatgatattggctgtgggtttgtcataaatagctcttactattttgagatatgttccgtcagttcctaatttattgagtgtttttagcatgaaggggtgttgaattttatcaaaggctttttctgcgtctattgagataatcatgtggtttttgtcattggttctgtttatgtgatggattacgtttactgatttgcatatgttgaaccagccttgcttcccatggatgaagctgacttgatcgtggtagataagctttttaatgttttgctggattcagtttgccagtattctattgaggatttttcgcatcgatgttcatcagggttattggcctgaaattttatttttttgttgtgtctctgccaggttttggtatcaggatgatgctggcctcataaaatgagttagggagcagtccctctttttctattgtttggaatcgtttcagaaggaatggtaccagctcctttttgtacctctggtagaatttggctgtgaatttgtctggtcctgggctttttttggttgataggctattactgcctcaatttcagaacttgttactggtctattcagggatttgacttattcctggtttagtcttgggaagttgtatgtgtccaggaatttatccatttcttctagattttctagtttatttgcatacaggtgtttatagtattatctgatggttgattgtatttctgtgggatcagtggtgatatcccctttatcattttttattgtgtctatttgattcttctttcttttcttcattaatctggctagcagtctatctattttgtcaatcttttccaaaaaccagctcctggattcattgatttcttttgaagtgttttttgtgtctctatctccttcagttctgctctgatcttagttatttcttgtcttctgctagcttttgaatttgtttgctcttgcttctctagttcttttaattgtgatgttagggtatcaattttagatctttctaggtttctcctgtgggcatttagtgctataaatttccctctaaacactgcgttagctgtgtcccagagattctgggacgttgcgtctttgttctcactggtttcaaagaacttacttatttctgccttaatttcgttatttacccagtagtcattcaggagcaggttgttcagtttccatgtagttgtgcagttttgagtgagtttcttaatcctgagttttaatttgattgcactgtgttcagagagaccatttgttatgatttctgttcttttgcatttgctgaggagtgttttacttccaattatgtgatcaattttagaataagtgtgatgtgatgctgagaagaatgtatattctgttgatttggggtggagagttctgtagctatctattaggtctgcatggtccagagctgagttcaagtcctgaatatccttgctaattttctgtctcgatctgtctaatattgacagtggagtgttaaagtctcccattattattgtgtgggagtctaagtctctttttaggcctttcagaacttgctttatgaatctgggtgctcctgtattgggtgcatatatatttaagatagttagctctccttgttgcattgatgcctttattattatgtgatgcacttctttgtctttgttgatctttgttgatttaaagtctgttttatcaagggcgaagattgcaacccctgctctttttttgctttccatttgcttggtaaagcttctcccatccctttattttgagcctatgtgtgtctttgcatgtgagatgggtctcctgaatacagcacactgatgggtcttgactctatccagttttccgtctgtgacttttaatttgggcatttaacccatttacatttaaggttaatattgttatgtgtgaatatgatcctgtcattatgatgctagctggttattttgcccattagttgatgcagtttcttcaatgtcagtggtctttacattttgatttgtttttgcagtggctagtactggttgttcctttccatatttagtgtttccttcaggagttcttgtaaggcaggcctagtggtgacagaatccctcaatatttgcttgtctgtaaagaattttatttctcctttacttatgaagcttagtttggctggatatgaaattctggcttgaaaattcttttcttgaagaatgttgaatgttggcccccactctcttctggcttgtagggtttctgcagagatccactgttagcctgatgggcttccctttgtgggtaacccaacctttctctctgtctgcccttaacattttttccttcatttcaaccttggagaatctgatgattatgtgtcttggggttgctcttctcaaggagtatctttgtggttttctctgtattttctgaacttgaacgttggcctgtcttgctaggttggggaagttctcctggataatatcctgaagtgtgttttccaacttggttccattcttcccgtcactttccagtaccccaagcaaatgtaggtttggtcttttcacatagtcccatatttcttggaggctttgttcattctttttcattctgttttctctaatcttgtctttacactttatttgattaagttgatcttcagtctctgatatcctttcttccgcttgattgatttggctattgatacttgtgtatgcttcacaaacttctcgtgctgtttttttcagctccatcaggtcatttatgttcttctctaatctagttattctagttagcaattcctctaaccttttattgaagttcttagcttccttgcattgggttagaacatgcttcttgagctcagaggagtttgttattacgcactttctgaagcctccttctgtcaattcttcaaactaattctctgtccaatttagttcctttgctggcaaggagttgtgatcctttggaagagaagaggcattcaggtttttggcattttcagcctttttgtgctgtttttttcctcatcttcgtggatttgtctacctttggtcttcgatgttggtgaccttcggatggagtttttgcttcgttgtccttttttttttatgttgatgctattgctttctgtttgttagttttccttctaacagtcagacccctctgctgcaggtctgctggagtttgctgggggcccacaccagaccctgtttgcctgggtatcaccagcagaggctacacaacagcaaagattgctgcctgtttgttcctctggaagcttcatcccagaggggtaccggccagatgcgagccggagctctcctgcatgaggtgtctgtcgacccctgctgggaggtgtctctcagtctggaggctcaggggtcagggacccacttgaggagacagtctgtcccttatcagagctctagcgctgtgctgagagatctgctgctctcttccaagccggcaggcgggcacatttaagtctgctgaagctgcacccacagccaccccttcccccaggtgctctgtcccagggagatgggaactttatctataagcccctgactggggctgctgcccttcttttagagatgccctgctcagagaggaggaatctggagaggcagtctggctacagcgactttgcctagctgcagtggattccacccagttcaaaattcctggcagctttgtttacactgtaaggggaaaactgcctactcaagccttggtaatggtggattcccctccccccacaaagctcaagcatcccaggtcgacttcagactgctgtgctggcagcgagattttcaagccaggggatcttagcttgctaggctccgtgggggtgagatctgctaagctacactacttggctctctcacttcagccccctttccaggggagtgaatgattctgtctcactggcgttccaggtgccagtggggtatgaaaaaaaaaaccctgcagctagctaggtgtctgctcaaatggccacccagttttgtgcttgaaacgcagggccctggtggtgtaggcacccgagagaatctcctggtctgtgggttgcaaagactggaaaatcgtagtatctgggctggagtgcaccgttcctcaaggcacagttcctcagggcttcccttggctaggcgacggaggtccccaaccccttgcacttcctgggtgaggtggtgccccacccacccttcttcggctcgcccgctgtgggctgtacccactgtctaaccagtcccaatgagatgagccaggtacctcagccggaaatgcagaaatcacctgcattctgtgttggcctcgctgggagctttttgtttgtttgtttgttgtgttcttaatgagttggagttttgctgtttttgcccaggctgaagtgcaatggcacaatctcggctcactgaaacctccacctcctgggttcaagtgattctgctgcctcagcctttcgagtagctggggttacaggcatgcaccaccaggcccggctaattttgtattttcagtagagacaggatttctccatgttggtcaggctggtctcgaacacccaacctcaggtgatccgcccgcctcagcttcccaaagtgctgggattacaggggtgagccaccgcgcctggcctgtcctctttaattatcttacatatgtcagttatgaacttgatttttcagcaccctgcaattcattcactcagaaagagaacataaatgcaatagtcaaaatagttttcatgtagagggtgaaatataagactatccagaatgttgcctttttacttctgcttcattgccacattacatcaatggttgagtaacagttatacctctgaactattttccacagaacagaaatgacctgttaggagcattatctttgcttttgaataatgatagtggtcaagagcttgaactaagtagttagacaaacttagtctcagtcatgctactaactggctctttttctttaggcaaatttcttttgtctaaagaacctctctaagcttcacttttgccataaaatgggaataataatacttaccttataggtctaatgtgaggatagagataatatgcttagctcaataactcgcatatagaagatgcttgttaagagttagttaaaattggatgtttctgttgatgatgttgtcattgctattacaaatattattatcaactttgaatatagtgatttaatttttccattggtcccctacaccaaggaaaagtcattgggaaataatcacagggagtgtatttatataaatgatggcctttattacatattgtacgttgataaaatttgcttcttagcatgttgtgagtacctttaaattaaaacttttggagaggataaaacaattttctttatttaaaaaattttccggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaattttcctgggactggcatggtggctcacacctgtaatccccaacactttgggaggctgtggcaggaggatcacttaagcccagagttcaagaccagcccagggaacatagcaaaaacctgtctttacaaaaatatatatacatatatttttaaaagattagctgagtgggtatggtggcacacaccctgtagtactggctacttaagaggctgaaataagagaatcacttgagcccaggagtttgaagttccagtgaactgtgatcacaccactgtactccagcctgggtgacagagtgagaacttgtctcaaaaagaaaaaaaaaaatttattctatcttatatctttgacttgcaaaagcctatatttttagaatcagtttttttagacattagtctgatacagaaaccaaggttctctgcagcagaccattctgaggttgtggggatattgttggaaagaaatatgattaggatttattatacattcttacctttatttgttttttgtcagagaagcagtcacccctgattgttgctttaggccatcaattgatgtgcactgcaaggggtaaattgttctacacattagtaagctgggtaagcaaattgttgtgcaaacctaatttgtttcctagagaaagtgactgacatacaattttgaaaatggaaatattcataaattgggtgaccatggtggaatagatccattgtgaaataaccactacgtttaagaatcctgtactcattggtgagactgacaaaaaacagtactgtgactgaggtaaacacaaggttacagcagcccttaagaggagtactttcctcaggcttggggaaggtaggacagacaggagagaggaatcagaagtcttcacaatattgatatctattctgggccttgaagatgaagtgggagttggctaggtagatggaaggtaggaggggaagggggtaaatttttccaggttgtgagagcaacatgtttgaggaactataagataggggaatagaatgagaatactgggtgttagagaagaatgagatttttctagatgtaacttttttgcactatatagcccaccagttagagggtctgttttgtgaagaaactagtcagttcagaggaggaaaatgatggaagtagtattcattaaactaaatattttattctgttgacttggtcaatcaagtcagacttggagcctgataatccatttgggcatcgatttgtctttattgttaactttgtaacttggaaaaattttttcaaaatcttcacatggttctcaatactggttttacaatataatcacacgcggaagttttgtaaaaataacactgtggatttgctgtaaaatgtcccaatggaaattttttttaatgtttgggggtggggaaatagatgatgtaagatttgcaaaatattgctaatcactgacacttggtaatatatttccattatgtttgtatatgtttgagcatttacataactaaaagtttaaaaagtaaaattagaattttttctgaacagccatcaaaagatactcatacttgggccccatcctaaaccaattaggtcaaaatttcttggggtttaggacccacgtatcttttgtttgtttgttgttgttgttgttgttgttttggagttcaacatgtttatggtgtgtagccatggttgaaagcttttattttataagatagacaaagcaggaattattattctcattttacaggagaaaaacagaagggctatgtggtttgttaaaaggccacacagacagtaaagaacacagcctttacatggtcagcctcacattctagtactcattttattacactgctcttcttctctgttgcctggtatcaaaggaattagtttgttgctagttagtatcacatgatatgttcagaactatactatattgaagatcttagtccctacgactctgttctagagcatccctagttcctgttcttcctcagactggcagtgagtattgagtgcaagcaacaaagtttgttaaattgctcttatttgtgagtggatgcttatagttcagcctgccattttttttttcttggcctgtgagtaagaaagcaagcagtgtaagtgcctctaagaaggaaaagatgctgatacttttctcatgccctctgtgctagggcagtaaatctacatgcaaattaaagattttggtgacaaatgagaacacccatcatgactctagtctcttcttaactttcctgggtgttgttaattcataacatagtttgaattcacttactattattgatttctatatttattagaatgaaaagggaaatcttgccttacaagggaaatatggttatcagacgctttctttgtcatggaataaaaagaccttctaggatataaactgtgagaatgacagttaaattgatatggtgaaggttaatgcgtgcttgctgcattgatgttggaggtcccaatcatttaccactatgctcctataatacatgccgtacatcttcattaggaaggcacagagcaatcagtttcaggtttctggatgagcctgtggccaggccataattaaccttttgaacttggaattgtagcagaatgttctattggcttaggttatcaattatggttagagtcgattgatattcaaagaaggcttattggtgatagatattataatttactcatctgcctgttgtgtgcttgacaaatagaaatgtcataacaaataattttgttttttgcttttggaaagagattatttgccaaacagttctataagcaacagctgttgttcaggttttttcttgaggtgggggagggtcttaattttcagtattgtttttcagtttcctatgtatgaagcagtgcaactaataaggggacttttagagttacatatgtcaaattttactagaaaaaaactcacacatagcatatcaacatactttaaaaataagtctaaaaaattaaagttcaagtgaaatcatgtattttatttatttatttattttgagacgaggtctcactctgtcacccaggctggagtgcagtggtacaaacacagctcactgcagcctcaaactcctcggttcaagccgtcctcctaccttaccctcccaaacagctgggaccacagccgtgcatcaccacgccctgatgatttttttatattttgtaaagatggagactccgtatgatgtccagctggtctcaaactcctgaactcaagtgatccacccacctctgcttccaaaaatgctggaattacatgcatgagccaccacccccagatgttaaaatttttgtgtcttctttttctatacagtatttcactcaaataaaatagtatcagaaaaatggctgactgaattttgcttttttggaaaaacttactagaatgtttgttaatcaggtaaaactgaaaatattaattgccagtccaaatgaagggaagtttgccttttttgttgttgttgttctggcaaactttattaaaaaacaaaaacaatataccaatggacagaattttctctgccacttgaggagcccctatcccaaaccaaaactactgaagctgatcacacaggtatacacatcactggtaactctataagaaataaaaggaaaaatgaatatgtctggttaccacaagcccatgtgataatgcatggctgtgtgacacagaaaacggtatacaggtcaaaaatgccttggaaaaatacaaatttttaaaatatggaatatgtagaccttaatccactcggccacatttttatattaacacatcaatgtattatatttgcggttaagtaggaaatttgccttttttatgaatttcaaattatctattatagtttaaagataactgctcaaactaagcagctgtttgtttttaagctatagttgtttattctgttaacttaccctattagttttagaaataatgttttattaaaatcaaatatgccttagaagttatttctagaaaaaagttgcactgaggttttatttattgaagttttaattgtaatttgactatgcatattgttttgaaatgacagtcgtccctcagtatctgtgtaggattggttccaagacaccccacagataccaaaatccatggatgctttggtcacttatatagaatggtgtagtatttacatttaactagtgcacatcctctcacatactttaaatcatctctaaattatttataataactaatacaatgtaaatgctacgtaaatacttgttatactatattgtttagggaatcatgacaaagagaaagtccatatatgttcagtacggttgcaaccatccatttttccccatattttcaatctgcgattggttgaatctatagaaggtccaactgtatagtgagaaattgagaacatgaatatccaacactaaggcattggttgagtatattgtgtacatcactttgaagaaatattataggtattaacatgatgataggatagagttttaataacttgggaaactgttaccttaaaagttaaaaagcaggttagaaaattgcatatttaggggtgagatgagggttattgagaaagactggaaggaagtatactaaaatgtaaacagtggtcacttagaagtggtagtattatgtcttttttcttatttatatattttatcatataaaatttttttttctgatatgtttatcagtatcatcatagcatagtgtgtaaggcctgactgcctggttcagattccaactctgttacttcctggctctgtggctctgtgacattggacaaatatttatactcttaggcttcggtttcctcatttgtagaatgggtacaagaacctatcttataggattgatatgaagattaattatatattaataataatatatttggagtttaagtaaacacataatcacataatgctgtgagtgctgtaaccttgtccgctctcttctgagcatagcccttctagtgttgtagcatagtgcacagcctgttggtttactgctcaccgttcactagccctttagccgtcatatctatcttccttctctgtgtctccatctgtatgtctcatgagctttataggggaggcaaaaacttttccctctactccttctacattttccaactgtggccctgtacattatactaccaaaagacagattaccaagggaaaagcatacaaattttacttaataacttttacatgtatacaggagccttgacaagaaaaatgaagatcaaaaagaacagggccaaaaggttatatactaggttagatatagagtattaaattgtagaaacgtgatgagacagggaagttcattttggaaaagtcactaggaagataaaggttagtttaacagagtctctttatagatttttctctacctggactcccctctctggtaataagaatgtcttttttttttttaattttttttttattatactttaagttttagggtacatgtgcacattgtgcaggttagttacatatgtatacatgtgccatgctggtgcactgcacccactaactcgtcatctagcattaggtatatctcccaatgctatccctcccctctccccccaccccaccacagtccccagagtgtgatattccccttcctttgtccatgtgttttcttcctactggtacagggagagtttctttcacttgagagtttgatctgctttcaggaagaaaaagaaaggtcagagtattcttcttgtatctgctgttttttcagtgccgttaactcaaaatattctttatgccaaagtagcatattttggagtagcatattctgctactcatctttcttactcagtcatttctaagatataaccattcagcttctccccagacttctctcccttttgctaagtgaatgtcattcttacctcagtcacaaaatgaaagatgtggaagtcatctggatgctttatcttcctatgttcttttgaaaacctttgcttttttcttttcccttctgccacaattcagacctttatttcccatctacctcttaatgggttcccctaattctagtcttggctttccccttcccagacatcctagacagagctgttagtgcagtctctctgaagtgtcagtctttcagtgagccccatttctttcaaagtgaaacccagacctccaagacctagcccaaaacaggggttctgagctatattcattccacctctcactggctttgctgaattatttgtaactctttgatgtgctccttcactacttttgggccctcctacatgctcttccttttctctggaatgctctctaactttctgtgatttcttctctgcattaggtattcctccaaattggcttaacacatagaacaaagcaatcaaagaatttatcatactttatggtaattgtctatttccttgtctctggtcccctttaggttatgagccacttatacttagggatcatgccttatttatctctgtgcctctagtgcccagaaaaatggcagacacccaggaaacactgaatgaaaaagtaaacttgatggaaaaatagcaaattacaggtgatgggtaatgtttttataaaataatatgtatggctagttattcttctgttcttattatacatagcaaagtcatcttgtcctcaccatcacaactatcattattctcctaataacttgtttttttatttattgttcttacttctgttcatgattgtgagccatggtggatacatggagtcagaagagttagttaatgcttggtgagcagggataacagttgtcctcaatataactttgcttgtgggcatagagttaatacttgacaaagccaagaagggcctggatttttcctactttgtttcttgcactatctgtaaaatttttttcagtgtaaaattttacactatctgtaaaatattgtttaattccttgaaaattttatatcttcaataaatgtttgtaggataaaaatggcatattgtgtccaaacaaacaaaaaaaaggtaaatacttgaaagtaagattataccatggaaacaaaggatattatgcagcaagcaggtcattgtcaccacagacagacaatactatttggctatatgaactctttaaaaggaggtttatagactgtcaccagactcatgaaaaaggaaacactgattgacggatctggtaaaggaacagcagaacaagaggtgattttgtcttaacttctcttaaagagttcttataaccaaatagtattgtctgcttgtggtaacaatgacctgcttgcagcataatatcctttgtttccatggtataatcttactttccttttaagtatctgccttttttgttgggacacaatctgccatttttatcctgtaaacatttattaagatatataatttgtgaggaattaaacaaagctctataaaaaaattttagagatagtgcaagaaacaaagtaggaaaaatccagggccttcttggctttgtcaagtattagctctatgcccacaagcaaagttatataagttgccagagtcttggcttcccctttaaaacttggggataaaaatccctacttcagaatcatgtctggcatagagtagatacttaataaaagctggttttctttctttcttcctgcttccccatatagcatgtgtacagcataattgtaatcagggaacccacccaaactgcaggttgcaaatctatctgaagatgtatcactaaacaatctcctgctgaaatagtcactgtcacatcatctgcccttcatgtgatcacacatcttttccctgcctactaaactaccaatggttaatttgtttagatttgagcattcttggcaattattacccgtgctactacaacttacaaatagagaaaaattatattactcttgggatgggaatgcagtcattgtgtgtgaacagccattcatccattaactcattcatttactgacaaaaattttagtacctcctatgttccagacatggaacagacatgctccagacaaataccattaactcttataatgtaatagatattttaatcttagctgtcgtattattatccaatatcattatataccaagccaagctcttgaaataaattatttaatttatacagtggttcctccaaggtaggtgctataattaaccctcattttacagataaggaaattgagtcctagagaagttaagtgatatcctgaagttcacatagctaataaaaaaaggagctaggattcagacctaggcactttgagtctagaatgtgtgattttaacttctgtgccaggaggtctcaaagtgagtttcagggacttattagagatccccaagaccctttcagggagtcagtgagatcaaaactacttttaaaataatgctagaataatatttacctttttcactctcatgaatgtacagtgaagttttctagaagctctatgtcattatatcacaacagattgaatgcagaagcagatatgaaagaaacttataaaatgtaaaacagcaccactctaatttaaaaaggctttgtttcagaaaatacagctttttcacaaaaatgtattatttatattaacatgccatacatttattattttaaaataaattaatattttttaattctcagttttaatttctaatatggtaaatatcaattgatagaacttacataaataaaagcttcctgggttcttcaggaatttttttaaattaccaaagcgtccatgtacaaaaagtttgagaactgctactctacagtgttagaaccttcctcatatttcagaacctcatatttcagaacctttcttttggcatacattttgtattttttaagttaacctcccaatttcagacagtccagccattctgttaagaaaagccttccttacaagttgtcagaattgttagcagtaatacttgagacctttgtatattctttgaccctgtttacctgctccaggagcttacagtacataccagaatatcatgattctggtgtacttgagtcacttttaaagttaatttttatgaaatacatagaatgattttataattaaagcagattgggtataaatgtttatatttcagtatatcactggtatgacaactggtatatcactacctccaaaagtttatccagccacaaagagggaatattctgttttctttcttagataatgaaaaggctgaatgttttaatacagtttattgaataatatatttgccagcattttagaagcattatagagtatggcacactagatggtttctaacagaactgtttatttcatttaacaaacagttgttaatcatatgccagaccctttgcttaagtactagggacacagactaaatgtggtcttggttcttaaaaatcttatgagtggccaagtatggtagctcaagcctgtaatcctatcgctttgggaagccaaggcaggaggatcacttgaagccaggagtttgaaaccagccatggcaatttagtgaaaccctgtctctacaaaaaatttaaaaaatggttggacatggtggtgtgcgcctataggcccaactgcttgggaggatgattgcagcccgggagttcaagaatgcagttagctgtgattatgccactgcactccaacctcggtgaccgagcaagaccctgtctctaaaacaaaaaaaaacaaaaactttatgttaggggagataaaaaaagaaaacaaatgaaagagatttttgccaagctactactaaacttcttaaaaatagcatcttttttgttcttgatgaatgatgattatcattgattctacgtgaataaaaggtagcctatttgatatgagtatagtatattagcaaattctactcccattatgaaatggaaattattgagatctaatacaatgataaagtatttcataaaacaatgactattctatttctaatctctctcaagataaaagataatattgtctatgtatatagtggacacagagactgttcactctaagataaagttaattgccatgagtttgtacatgtgatcatcaaaaagaacagtatcctaaatttcccagaaagttgtgaaacatgtaggtatagattttaaataactagactacatatccaaatattacagtggatgtatacccctttttatgccgaatgaactgatcgcagtttaaatttttgcagctaggaatgctttgtaggtctgccttacttatatacttagtgcacaatctaacgggattccaacaagtatcacattactggtatttcacaggaaaggggaagtgggactcccgtgtggtaaatatcgttagcttagaattcatagatgacagtttgtccagaaacaaagttaaaaatctaaaacttgctagcaaaatttttactactaaaagttttattctaatgaagtatgaacttggtattacctaaaacttaataacatcttttgagatgcacagtgtcatgctaacctagaacggtatctgagtcctagcccagccatttagattatgtggagtttctagggcccagtaaaaatggacatgaataaagaggtacattttaatgaaattgtgactttgttttgaatttataaatgttgtatagaataatgatgagttttactaacttcttgtagagagaattaaagacaggtaaatttaagatttcttggcttggtattacttcctgttagaggaggagggagttgtagttagaaaagtatacaatgtattgctaatttttggaaaataaaaaatgtatttttataacaccagctattactgaaataaaactcaatgaaatattcctgactggtaaagatactgtgattttttttttttctggggaaggggcaagttgcccctgccctcccatcttctacaaagagggactcagaatctctggggtgatttgaaaactttatgtttatcaaaatgatgatggatggtggaaggacggggagaagtattcaaagaatgggaattaaaatattaataacactggtgtaatggccagagtcctgagcactgtcttactagcctgttgatttctttttttaaaattcgtttttctcattttaatgttttaaaacattttctaattgacacataataattgtgcatatttatggggcacatagagatgttgtgatacatataatgtgtagtgatcagatcaggattattagcatatccatcatctcaaacatttatcatttcttggtaatatacaatatcttctatttaaaattgtataatatattattgttaactatagccattctactatagttagaatttattcctcctatctagctgtaattttgcgtgtgtgtgtttttaaacaaatctctccttatcttcctattctccctagcctttcccagactttaatattctctattctactttttacttctatgagaccaactctttcttagcctccacatgtgagtgagaacatgcagtgtttcactttctgtttgggcttattccacttaacataatgcctgcagttgcatccatgattctgtgaatgataggatttccttctgttttatggatgaatagtgttcccttgtgtatgtgtaccacattttctttatccatttatccacgaatggacatataggctgattccatatcttggctattatgaatagtgctgcaacaaacatggcagcgggggtggtggtgcagatgtccctttgatatactgatatctttcctttggataaagtaccagtaataggactgtcaaatcataaggtagttctatttgtagtattttgaggaacctccgtattttctccatagtggctatactgtcacattcccaccaacagtatataaacagtattttgtccacattcccaccagcattttttttgctctttttgataatagccatcctaatgggatgaaatgatgatatttcattgtggttttgatttgcatttccctgatgattagtgattaaatatgtttgttggccatttctatgtcttcttttgagaaatgtctgttcagattatttgctcattttctttttttattattattatttttggaggatggagtcttgctctgtcgcccaggctggagtgcaatggtttggcttactgcagcctccgcctcccaggttcaagcgattctcttgcctcagcctcccgagtagctaggattacagatgcacgccatgacgtccagctaatttttgtatttttagtagagatggggtttcaccatgttgaccatgctagtctcgaactcctgaccttgttgatccacccgcctcagcctcccagagtgctgggattacagacgtgagccactgcacctggcctctttgcccattttctaattggattatatgtggggttttgttgttgttgttgttgttgttgttgttgttgttgttttgctgttgtgacgttagagttccttgtatattctagatattaatcccttgccaattaatagtttgccagtattttctcccatcctgtaggttgttcactctgatgattgtttcctttgctgtgcagaaggtatttaatttgatataatcccatttatttacttttgtttctgttgcctgtgattttgaggtcttatgcataaaatattttccagaccaatgtcctgaagtgttttcttctggtagttttattgttttaggtcttacatttaggtctttgatctattttgagttgattgtcatataaagtgagagttggaggtctagtttcgtacttcagcattaatttggattaatttgggagttctctattcagttttattggtccatctttctgtttgtatgccagtaccataccgtttagcttactacagctttgtattacattttgaagtctagtagtctaatgcctgcagctttattctttttactcgatgtcattttggctatatttggggtctttgtgcttctatacgacttttaggatttttttttctatttctgtgaagaatgtcattggcattttcataaagagtgcactgactataaattgctttgggtactattgtcagttttacaatattaagtcttctgatccatgagcataggatgtttttttctttgtatgtatcctcttcagtttctttcatttgtgttttgtagttttccttgtagaggattttcaactccttggttaaatttatttcttggtatttttgtagctagtattgtaaatttgcattgtaaatattataaatagtagctacaaaaaatggattgccttcttgatttctttttcagctatttcattgtgtatagaaatgctactgatttttgtatgttgagggtgtatcctgcaactttactgaattcattgatcagttctaaatgttttttggtagagtctttaggtttatctgtatataggatcatgtcatctgcaaacagggacaatttggctttctcctttccaatttatatgccctttatttctctctcttgtctaattgctctggatacgacttcagtgctatgttgaataagagtgagagtggaaacccttgtcttgttccagtttataaaggaaaagctttgagattttcttcactcagtataatgttagctgtgagtttgacatatatggcctttattgtgttaaggtagtttccttctataccagatttattgagaatttttatcatgaagggatgctgaatttttttatccttcattctattgatgtgacatatctcatttgttgatttacatatgttgaactatccttgcatacctgtgataaatcccacttgattatggtgtattatctttttcatgtgctatttgattcagtttgctagcatttgttggtttttgcatctgtgtccatgagggatattggcctgtagctttgattttttgttgtcctgattttgatatcggggttatactgaccttataaaatgagttgggaaaaatttccttcacatcatttttttaatagcttgagaagacttggtattcattcttccttaaagatttggtagaattaagcagtgaagccatctgctcctggacttttctttgttgggacttcagtactattttgaataacagtggtgaaagtgaacatccttgtcatggctcagatcttagaggaaagtcttttgatttttccccattccagatgatactagctgtgggtctgtcatatatggcttttattatgttgaggtatgttctccttggtaaggctttttaggtattcaaagggacttggagcacaagcccagtaatgctgtggtttttgcagatgcttaaaaagaggtgccacctggctgggcatggtggcttacacctgtaatcccagcactgtgggaggccaagacaggaggatcacctgaggtcaggagttcgagaccagcctgaccaacatggagaaaccccgtctctactaaaaatacaaaattagccgggcatggtgacacatgcctgtaatcccagctactcgggaggctgagacgggaattgcttgaacccaggaggtggaggttgcggtgagccgagatcgagccattgcactctggcctgggcaacaagagcgaaacttagtctcaaaaaaaaaaaaaaaaaaaaatgagagagaggtaccaccttgatggtcttggataagatcccaaagaattttctgtttatcagacagagtggctcctgttcttttcccttactttcttccaaacaaatggagtctctctctctacatgctgagccacctggaactgggagtgtggtgattcaaggccctcttggtcaccaccactggaactgctctgggtcagacttgaagccagcacagcattgtgccttgcccaaggcccttcttttcagggcagagagtttccctgcacatgtccagagatgctgtctgggagccaggaattggagtaaaaaaccttagcagtttacctgctattctattctactgtggctaagctggcactcaagtcatgatacaaagtccttccctctctttgcctgtctccaagtttagaaattctttcttctccttggtctagactgtgaagctgtcaattgtatttttcatttcactcattgacttctttagctgtagtctgttctttttatgctctctgtctcttaattgcatttctcattcaaattgggaattgttttcttgattttcttgaattgtctagctgtattctcttgtatctcactgagttttcttaggaatattgctgtgaattatttttctggcatttcatatatttccttgtgattggagtctgttactggtgaattattgtattcctttagacatgttatgtttccttactttttcatgtttggtgtgtccctaggttgatttctatacatctggtttcaaaattgcctcttccaattttattaagtcggtttgacagacaatgatttacttgtatgaattagtttttcattgatagacaaagatttattcatatgaatgggtttgttatggtttggtggctttggttttatgtggatgcagcagtgaattctgtgtagcttctttagctgtaatccacgctagtcgtgtatgcaagtgtctcaatggcctagaatgagagactttatggtggcggtggtccagctttgctgagggtgggctcacaaggctgtttcttatgttaggagcatatgtgtgccacagtgggtctgccaacttggagctggtgttggggctatgggttgttactctgaccaggagcatgtgtacgcagttgctcagctgtcctgggggtgtgcttgccaggggtggcccttggggctatttctcaggcttgggacatgggtgcataactgctccaccagtctgagggcatgtgtgccaggggcagcctgtggggctgctattcaggcctggaacgcaagtgcgaggctgctctgccagacagggttgtatcttccaagagcgcctgcggagctgtttctcaggacctgttgcaggcacagggccgtcgcgcaggtcaggaacttatctgcagagcttggggtgctacagggctgcttctcaggttctgagttggctgattcgctgttctgctggcccagtagcatgttggctgttcagaggcttgagatctcccactcagggcagaacatgcagcagtttgttaggctgaagggcgggttcacaccgggtgagactgccagactgttgttctgggtagaagtgaggacagtgggaggtggttttcctactgcgcaggaccagagtcactgccactcctgggaccaggctccatgcaactaggtttgtggtgttcagccaccggtgtgggcttgctgaaatgaagatgggagctgcagtgctggataagtgcaatagttactcacccccaccacacccccacccctgccaagaagggcacactccagaggtgcctctgatctcaagatggcactgtgctacagcagcgtggggtgagtagagggtgggagagttgtattccttactcagggcagtgcagctgcatgaatttccagcaatactttaaactgggctcagggattgagaggactgttgcattctcctgtagtaaggactgccattgtttttggtggcattgggggctggtggggttcttctgcttactttttccctgcaataggacctccctcatggctctacgcagatccagtccacacagggacaatagagtgcggaggtcactggtgcctcaatgctgccctcctggacttccagtcaccacaggtctgtctgcactcccctgctgtactctagtgctctcctttcatcactccagtcaaatcatatctgtttatttgttgccttgttttttttcttttggagtcaacgagcatcaggtgtctctagtcagctatcttgctgacatcttgcctgtgtatttcaaggaagtttgaaagtgtgctttgggtgtgacttcaagatggctgactacaggtgccctacactcgcctcctccacaaataagagaccaaaatagtaaagtataaatacacattgaatagagcttctaggaaaaaacactggaatttagcacagaagtgacagggaacctctgaggcacagcaggaggaagtgaagcagccagcctggccaggattggctcagagccaggaggagcaccacactgcaaataaaaggcaagcaagagatccctaacagtccatgttcccactgcagactcctgcagtcctagccattggagtgccccttggcctttggaggccctgagagtagtataggaagctacttgtagtccacgcagtggcattgttctagagagggagtttgtactgtttctcacacccctccctgcaaacagctgcagcatagtgccattttgggagcccagccactgccagattacattctgccctggagcccagcagcctttgtatccccacatacctggagccctactggcatcctcccatgtccactcagagggcttcagtgctgtgatgctgactggacccagtggtgcagccaggttcccaaaactctagctaatgcagtcctctgcaccatatgaaacaggcagtgcagcacaccaggagtaggagagtggccctgggacaaagggagccaaagcatgcactccccagagcctgagaactgcctccctggtgttgctgccatatacagtaaccctgacccttccactggtagggttgctgacatacctgcatgtgccttcagaggccctggagattgacccaccagagctagcacccatgtgcaccaccaaggtacctgaatacaggcacatgccacctgctggtacccacacatgtcatccagggacccaaggacgtacctgccctgctcaccatcactgcttcctatgtgtaccatccagggattggcctcacttgtacaccagatgccagcacccacacacagctaccaagacccagctcacccaaactgccaatgccaatgctggcacacatgtatgtcatttggggggtcaagggtttaagttaggtggttgcccttccactgctactgccactgctcatgtcatagacattgcctagagggttgataaactgcccaccccactgccactgccacttctaaacacaccacctggaggcccaaggactggcctgtcagtacctgcccaccattggcacccacgtgcattccctgggggctcaaggactggcgaacatggcctgctactgcatggttgcctaaggaccaacccacctggtgtccccatcttaagcaaagcctcaccacagcctccgctaacaactgtggcctaaaccatggaggaacttacaggcaccactgtaaggaacagccaaaggaattggctactgcacccacgcagggagcacattactgcacctccccagaatcaaaagccaaagcactctacttaaccaacactacagaaactatttccctgtggaaggtagtctatataattaaaagaagcaacttaccaagatgcagagatatcaacataaggacatgagaaacatgaaaaagcagggaaacatggcaattccaaaggagcacattaattctctaaagtaacagatccccaaaaaaagaaaatctgtaaaatgccttaaaaagagttcaaaataatgataagatacaagaaaacacaggtaaacaataacaagaaatcaggaaaacaattcatgatctcaatgagaaatttatcaaaaagatagatggcacaacatcgtgaaaccaaagaattcagtgaatgaaatttaaaaaaatgcagtcaagagcttcagcaatacactagatcaagcagaagaaagaatatctgaacttgaagacaggttgcttgaaattatacaggcagagaaagaaaagataaaagaataaaaattaatgaagaaacccagtataccatatgagatgccataaagtaaccagataccctaattttgttaatttttagaaggggaagagatggaaaagtcatagaaaacctatttaacgaaatactagctgaaaactaatcttgcaaaatatatagtcttgcaaaagatacagacttccagatacaggaaactcaaagatcccctaatatattcaacccaaaaggtcttctccagatcacatcatagtcaaactgtcaaaagtcaaaaatgtaaagataattacaaaaaacaacaaaagtgttcagttaacatataagggaatgtttatatgggacagtatctactgttatgaaaacacatgaaagtataaaactcactggtagagcagatacacgcaaaaaagaagggagtcaaacatcatcacaacaaaaaaaaaccaccaaatcataaatgtaaacaacaaaagaggaagaccagaacaaacgatatacaaaacaatcagaaactaataaagtggcaggaggaagtcatcacctgtcagttacaaccttgaatgtaaactgtttaaattcctccaattaaaagatatagattggctgaatggacataaaaagtaggacccaactatatgctgcctacaagtaactcactttgcctgtagacacgtagattgaaagtaaagggatgggctgggggcggtggctcacgcctgtaatcccaacactttgggaggccgaggcgggcagatcacctgaggtcaggagttcaaaaccagcctggtcaacatggcaaaaccccatctctattgaaaaaatacaaaaattagccaggcgtggtggcagatgcctataatcccacctactcgggaggctgaggcatgagaatcacttgaacccagtaggtggaggttgcagtgagctgagatcacaccaatgtgctccagcgtgggtgacagagtgagactatgtatcaaaaaaaaaaaaaaaaaaaaagaaagtgaagggatggaaaaagatattccacacacacagtaaccaaaagctgccagaaggaactgtatatcaaacaaagggtaaaaaaaaaaaaaagagagacaaagaaggtcattataaaatgataaagagatgagtgcaacaaaaggatataatagttgtaaatatatatgcactcaacagtggagcactgagatatatacagcaaataccattaaggctaaagagaatgatgaagtccccagctattattgtattggtgtttaacgctgtgctttcagcattcaacagatcatttaggcaaaaaatccacaaagaaacattggacttgatctgcactgtagaccaaatggacctaacagacatttacagaacatttagcccaatacctgcaaagtatatgttctttttatcagcacttggaacactctcccaggattgccacatgttaagacacacaaaaacaatctcagtaaattttttttttttttttgagatggagtcttgctctgtcgcccaggctagagtgcaatggcacaatctcggctcagtgcaacctctgcctcctgggttcaagcaattctgcctcagcctccagagtagctagggttacaggcgcgcaccaccacacctggctattttttgtatttttagtagagatggagtttcaccatgttggccaggctggtctcaaactcctgacctcgtgatccgcccgccttggcctcccaaagtgctgggattgcaggtgtgagccactacgcccagccgtaaatttttaaaaattgaaattatgccacatattatatctgaccacaatgggataaaactagaaattagtaatgagaagaactttgcaaactgtacaaatacatgcagtgtaaacattatgctcctgaataaccactgggtcagtggataaataaagaaggaaatttttaaaaactcttgagacgagtgaaaatggaaacaaaacataccaaaacctatgtgatactatagcagcagtctgagaaggaattttatagcaataacctcctacatcaaaaaagtagaaagatttcaaataaacaaccaaatgatgcacatcaaggaactagaaaaataagaacaaaccaaaccccaaattagttgaaggacagaaataattcagatcagagcagaattaaacataatagaaactaaaataaaaatacaaaatatcaatgaaataaaaagttggttttctgaaaatataaataaaattgataagctgctagctaaactaaccagggaccaaagagagaaaacccaaataaataaatccagaaacaaaagaggagacattacactgatagcacagaaataccaaggatcatttgagaccattatgaacaaaaatacgctaacaaaattggaaagcctagacaaaattggataaatttctgtacacatacaacttaccaaaattgacccaagaaaaagtagaaaacctgaacagaccaataacaagtaacaagactgaatcagtaataaaaagtctcccaaaaaagaagagcccaggactgcatggctttagtactgaattttaccaaacttataaagatgatctaatatctcacaccaatgcttttcagactatttcagaaaattgaaatggagagaattctttctaagacattctataaggtcggcaataccttgataccaaaaccagacaagaacacaagaaaacataaaaactataggccaatatttctgatgaacatagatgcaaaaaccctcaacaaaatacttgcaaaccaaatagcacatcagaagataatagaccataatcaagcaggatttatcccagggatgcaaggatggttcatcatatgtaaataaatgaacgtgatacatcacatcaacagaatgaagggcaaaagccatatgaacctctcaatagatgcagaaaaacatttgataaaattcaacatgccttcatgataaaaattctcaataaatttgttacagaaggaatatatctcaacataagaaaagctatgtatgacaaacccacagctaacaaactgaactgggaaaagttgaatgtcttttctctaataactggaacaagacaaagaagagacgacctgcagaatgggagaaaatatttgcaaactattcatctgacaagttacttatatccagaatatgcaaggaatgtaaacaacaggaaaaaaaatagttttattaaaacatgggcaaaggatttgaatagacatttctcaaagaagacatacaaatagccaaaaagtatatgaaaaaaatcttcactattactaatcatccatgaaatgcaaatcaaaaccacaatgaagtgtcttctcatcgcagttagaatggttattatcaaaaagacaataaataacaaatgctgaaaaagatgaggtgaaaagggaactgtcatacactctggggatgttaattagtacaaccattgtagaaaaatagtatagaggtttcttgataaacaaaaatagaactaccatgtgattcagcaatctcattactgggaatttatctaaaggaaagaatatcaggccgggcacggtggctcacgcctgtaatcccagcactttgggaggccgaggcgggcagatcatgagcaggagattgagaccatcctggctagcacggtgaaaccccgtctctactaaaaatacaaaaaattagccagttgtggtggcgggcacctgtagtcccagctacttgggaggctgaggcaggagaatggtgggaacctgggaggcagagcttgcagtgagccgagatcacaccactgcactccagcctgggtgacagagtgagactccgtctcaaaaaaaaagaatatcagtatatcaaagagacatctgtacattcatgtttactgcggcactattagcaatagccaagatatggaatcaacctaagtatccatcaatgaatgaatggataaagaaaatgttgtatatatacacaatggaatgccattcagctatgaaaaaaagcgtgaaatcatgtcatcgaagcatccattcattccattagatgaaactggaggtcattatattaagtcaaacaagcaggcacagaaagacagttatctcatgttctttctcatatgagagagctaaaaaaaatgatctcatggagatctaaagtagaatgatggctaccagaggctgcaaagggaagggatgggatgaaccctcagaggggttaatgggtacaaacttagttatataaaggcataagttctagtgtttgatagtacagtaaggtgactataactaccaacaatgtgtcatatatttcaagatagctacaagagaggatttgaaatattcccatcacaaagaagtgacaagtgtttgaggtgctggatatcctaaacatcttgattttatcattacacattttattcatgtatcaaaatatcatgtgtacctcataaatatatacaatgattatttattaataaaaaaataaaatagtcaagacccccccccaaaaaaaatttggacatgaattgcaataatgaaaactctgccctctacacttacataaatggcaactaatatatttgcctatttattctttcaatagatattaatgagtgcttataaagaataccagtataaataaattagttctggccctgcccttaatgagcatataatacagttgaagagattaagttcctactttagttgtgaactcctcaaggataggcactctatcctgtctctctccccaacccccatcaccattctctattacagagcctgcctggtgtcttaaaggtttttaaaatccttaacctcaacgttgaaagggaaagacggaagaatgggtagagagacatgaagcaacaagtctagctgtcattgtttctgaaaattaatcaaaatgaaaatacagttgtatcagttcatgaaattacagtgtagatcagtaggaaacaatttatagcaattcttttaccacacatttgttgcaaaaatgcaatctgtttctactacctgactcgggtgatatttcagatagctaagttataattaattaaagctgtgtggacttttagcttagaaaacggcttcctcttccttctgctcaccccgtgacccaacccatccctgtattgccaccactcgcttcaatctggcactgtagtcaagcccagagcaacttctgtgggtcaggggaggtgacaggcattctgtgcctagctgtttggctaggcattgcagcttcagaactcttctctccatttctaaatcatgtctaatgggactgttaaccagtggccaccaaagctaccatttccaatgagcaattctgcgaaattatgtcacagaaataaattagtatgaaatttatagagaattttctcttcatgacaatctaagaaatcacagtcacaccttaccatgcatagttatcatactgactttgtcctagactgacccaggtccagttccaccctctgggcttgtagagtttctctgttacgatgtgcagaatgcttagaacaggataggcccccagaagtgagtcctgttgttatctttcacaatcatatgaatagtattagatggagccagaaaacaataaaaattctacaaaaataatgaaactaatttgtgcaacgtgagaaaagaaaatggacattttgcaaatctatttggtgtcagggctctactttttaaaaggaaaatcaatcatggtctgtggtgtacatgttaagggaaggacttaaattcacagtaataggtattctggttacagcatggaagaactatatcattgttgaagtaaaactcaccgaggcttcagcatacaactaaattgtactttgcataagaacattaaaacaattcttggaacactctcctcccccatcactaaccacccaccgaaatacaagaaattatagtaagaaatatcactctcttggaataagcacaggagaagaaattgcaaacagattattagaaaatgtcattcatcattttcattttctttggaaatttagcttttctccctgaatataatgttttcttttttctcacatttttaaaatatgctcaatcagaatactttaaaaagacttttttttttttttttttttttgagacggagtttcgctcttcttgctcaggctggagtgcaatggcatgatctcggctcactacaacctcctcctctggggttcaggcgattctcctgcctcagcctcccaagtagctgggactacaggcatgcgccaccatgcctggctaattttgtatttttagtagagacggggtttctgcatgttggccagactggcctcaaaatcccgacctcaggtgatcggccccacacccaaccaaaaaaatacttttttatatatatgtagaaacaccgttttatttgtaaaatatgtcaggtgctttttattaagaagtattttgagaatacagatacatcatcaaattgactgttatctttgtataattgtattacaagttatgttgtgaagatgaaaagctagtttcccttctagctacttttggtgaatagaaattaggagtgttacagcattttatttataataaaactatagtatacatgtttatgattatttaaagaaatttgttatgtttcacatgttcagagacttttgtctttggaattcctttgctaactctagcaataataagggcatgaacttttcagttacacagaattgggttcacatatggttctgtcacttagtagcctttgggcgaatttttcaaactcagatcctcagctttcttgtctacaaatttacaatagtaatatttaactcacaaggctgttataaggattagaggagattacctgtagtaagctctcaaaatattagttctttttccatataaaatataaaattctccttaaaaatattaagattatgtcataaaggtttctaagcattgcaagtggttcctatttatatctgctactattgctttccagatccagaaatagcttgcaaataatgggattcctgtagatggaataatgttaatttacctagctcactgctactgtattgtacagcttgggaaaatgtgctgtttttgcagtctgttcattcagatggcttatgaattaaaagcagaggcccatcatgttctaagatccagtagttcattattgcaaaataaaatatccatttattaggcaaggattgtctacagtgcaagtgtaaagagacccactcataagaataagtgttgccttcaaatttgtactgaagtatgctgaaaaacatgtatactatagctgtgataatgagcagtacagtagaaagaggtgatttatgatacctgtttctgacagctatagtgcagagattcccagggtagctgatcatggcattagcatgctgacagctcagcatttagaacattatggtaatttatcctgcctatgctgtcacctgcactgtcagagtttctttttaatgatggtataactattttgtttgtttgtactgcattcttttcatttggctaatgctttctcattagattgaacctagtaaatgagagtaattaagtgcttcctatagctcagatgcaatgattaagttgcagagctgctactgattatgttttgtcatttatctctattaatctgagaataatccagatgataaacacatgtaattttttgctaatgttcaatagatgaaatttatagtttctcaatggagccaagcagtaaatgtatatttatatataaataatagattcttacatgtgaacttgctttaaataaacatgtaagttacaactaaagtttttataaagggaaagacacttttaattgtcctactaaatttattctatcctgaaatagccttctttactcttccaagccctaccccccacccaagggaaggaaggagggaaggaaggaaagaaaggagagaaaagaaggaaggaggtaagggaaggaacaaaggaaggaaggctggcttaaattattattatggagcaagttgtttttctgactttagttgtttttttttttttaattgtctgcagggacaagactaaaatttgttttgataatagtttatttgggctgagcagggtagctcatgcatgtaatccaaacactttgggaggccgagatgggaggatcactcaagcccaggagttcaagaccagtctagggacatagggggaccccatctctacaaaaaatttaaaaattagccaggtatggtggtgcatgcctgtcgtcccagctattcaggaggctgaggcaggagaatccttttagccttagagtttgaggctacagtgaaccctgatcacaccactgcactctagcctgggcaacagagcaagaccctatctcaagaaaaaaaaaagacttcatttgaagtcctttcattcactctgtactgacagtttttcaactcttttcgtttactctgattttctaagctatagtaatttattattccagaagaaaatgtgtttcaactaaactgttaaataattcttgagattagtcagaatgtttgtcttttttttttgagacggagtttcgctcttgttgcccaggctggagtgcagtggcgcgatctcagctcactgcaacctccgccttctggtttcaagtgattcttctgcctcagcctcccgagtagctgggactacaggggcccgccatcacgcttggctaatttttgtatttttagtagagacagggtttcacctttttggccaggctggtctcgaactcctgaccttttgatccacccacctcagcctcccaaagtgctgggattacaggcttgagccaccgcgcccggctgaatgtttgtcttttaataaattaagctaacatgttaaaataatgtggagttatgttttttgaaaaataatacatttacacatattatttgcttatatctgacataatttgctgtaaggagatacacagttttcagaactctgatgtgactattatagttaatagttaattagctttttaaagtttctataaaaaatgccaaataacttgatacattttgtttgcaattagtgacaagacagtatttgccaacttcatgcatttcaagtatcattatgtaaagattgtttcctaattctttatgtgtaaagatttattcctaattctttataatttatttataaaattatagtttcaataatctttcatatatactaagagaaaataaaagattgtttttaggaaattacatttttgcagaattttcataaatgcttgaaaagatcatagaattgctaaacccatgtgggcataggctacccggaattttcagctcatatttagatggtaggaaaattgacagaaacttagttactgtatttctttgtgcttaaatgtatgaccaggagtctggtgaatgtgatttcccaaacattggagtaggaacactagcagttcttattttgaaaaagaacattgtacttgagctttcaggttgtggctgtgcattgtaatgcatcaggagctgcttttacattttatttaagagaaaggtcttttaagtatctatacatgtactgcctttatttgcacatttggatcatttaatgaattttgttctatgaacaaatggtaccatctaagataaatacttgaaacattgatgttaaccctacctcagttaattttcatgaaatattattttttgaaaatgaatacttattgcataagtcctaaagtcctaaatggaatatgctgtttttaatggttattcatatattctttggattcctttctaaaataagccattgttaaaagatggatatacattacccagtgggctcttcttcccctttaggtgtagaaatgccttccatgaagactaactgggaattgagatgatcataaatattgggattttattaagtttgctagtagtttgttcacattgtttttccagcaattttagaagatacaatatttagcctaataaggattatcatctttcagagggatcaaatatctatcctgtacttatggctagattgaagaaatttttcattgaaataatcagattatatatgaagtgatgatttgttaatggttggcatagtcaaagaatctgtttttgaagttgtgggaaatgtctctgacaggcattatcagttaagtaagggactaaaagtagaaagccctaagttctaacccaaacatttttccctaatagttattttgtcaaataaatattgctcttgcacactgaggtattagggtgagtaatagtgagcattaggccagtgtaatactcttttgaatattaaattataaaataagcccaggtcgaggcaggtggattgctttgagctcaggagttcaagaccagcctgggcaacatggcaaaaccctatctctacaaaaaatacaaaaattgactgggcgttggtggctcacgcctgtagtcccggctacaggggaggctgaggctggagaaccatttgaccctgggaagcagaggttatagtgagctgagattgtgccactgcactccagccagggtgacggggtgagatcctgtctcaaataaaataaaaataaattaaattcccaaaacagaaaagtaagtaagtaaagagaaaagtttaaggctgggcatggtggctcacgcctgtaatcccagcactttgggaggctgagatgggtggataacttgagatgaggagttcaagaccagcctggccaacatggtgaaatctgtctctactaaaaataaaaaaaaaataataataattagccaggcatggtggttcacacctgtaatcccagctacccgggaggctgaggtaggagaatcagttgaacccgggaggtgcaggttgcagtgagctgagatcaagccactgcactccagcctgggcaacagagtgagactccatctcaaaaaaaaaaaaaaaaaagaataattttaaaaagttatgatttcttatcattgtttactgacttttttaaaaagcaaaaattggataatgctttaggatggaatattcactaatctagaaaatatttcttccgtattttaaaaggtggagacaatggttttaattaactggagcactttggtacctgaacctatgggaatattttcagtatggaatatttatttgctatttctgtattcctgcgtagtcaattcctaaatacgctttcttaagatagcagttttaaaaattataattactctccaccctgaccccttgccccacaacaaacaaaaatcactttgagttgttaatgttgaaatcacaagttacaagtcttcctttgtccttggttaaaaaataattataaaaatagagtaaagagaaaattctttttctctttactggtcagttctatagaagtaatttaaaataccgtatattgaattctttgatcatttctcctgggtggattgggaaagaagtcctagctgaggcaattgcttctgggctctctttctgtgtgcctggtaaatgaaacacaaggaacctcaccaaactacatgactaatggcaacctccagtgccgcctgcaatcaaagattaatttgctttatcaagtttaaagaatactgggtgataaatcatgtcaaaaagaaataatcagtcaaaggctgatgttcttttctacatgtgaggacaggtgctatgaggcatgcacttgtcatatacagttaattttcttttcatgcatttatgttcatcttaattactatttagttgatgcttgaatcaaataatttctctcattaagatcaaccagcatcccaactgcaaggctgcagtattatagattcaaaataacatttttttccttttaatttgtataagggtattttcacatgagtattaatcacaaatttttttattcaaacatgagaatgccaagtgggaagcgaaattattttctccatttcaagatacccaagaatatcaactggatgttcatgtttataatatatgtctgtgtgtgtgttatatctacgtattttatataaaattttcattttactcggattttctcacctttttttttcttttcttttcttttcttgaaagagagaaagctagagtctctaattctgtctcctgggttcataatgcaggactcactttaggtaagattatattataaagaggtcatctttcaggacttttagcagcaaacacatttgagcaggatcaaaaatgaatcttgtgtcttttcagacaccgtgctatcaggactctttaaaagcaagactcagattattgtcttaggagagtctcttatttctaattatagtcttatgaactggagcctctttaaatgtttttggtatatgtagatatgtattacttcctagcttaggtcttttctagctcactctgcctttggtggctaattagagatttagaaattaattttccgcttgatgtacacaattaaataaaaattcatcatagacttgaaacttggaactgtgaagctgtatcgtttgagtggttgtaggaaatcttatccctagagtaactcttcattttctttttcttcatggtttctctcagtttttgtctagatcttgacctttttcactccagtaaattgtcagtagtgcaggaagacttgtggctggcttttgtttaccttttattctgcttctgattcctgagaattattttaaaatatttataaagttctatttttgacatcagtagcatcctaaagagagaatatcttatattggctgggttttaagacttctttttaaactggataggaatttaacttgcctatacttaatatatatttttccacatgaaagtatttattgtgttctatttcatttccaaaatgagatgatgggacaagttgatgaggtctcttacaatttgaaagttttgtaactccagacatacctattttgatagtaactgagtcaccagtgctcattagcagtttgcataatagacatctattctagggaattgctgtagtatagactgcatggtggggtaaatagatttagatttgaagactgaacacttccatccagggtctaactccagcatttgtataaacttggacaatacttttgctacagggttgtcattgaaagtattgcctcattatatttcttagtggtccctgtatgaagccatataagagaaacttcttaatttagcactaggaaatgcttctgttgacttgagatgtgtgtgtgtgtgtgtgtgtgtgtgtgtgtgtgtgtctgtgtgtgtgtgtgtgtgtctgtgtgtgtgtgtattcccctaattgataaactataaaataatctttctcttttcactttggccatctggaaatttgccaccaatttatggttcaactgtataattgcatgtaacatttataatctgctttcatgaatttttatccttgtattcctcccactctgattcaattttatattataactggtccttgtgtctcattttattttatctctacttttttaatgtccgggatttcctatatgtcaccccaaatactgagtcactgtgtaaataagtaaatatatatctactctatatctataagtagtgtgatatatgagatatatatatatatatatatacacacacactgaatcactttgtaaataagtagaattgccctgactccatcactaagtattcaaaagtcagttatttcttttagagctttagtattctcacttgtaaaataaagaatgaactagattgcccttgagaactttttagacccaaattctaggattaaaaacaacataggacttccagtttccatttggagcctagaaagctggaaagagcatcactttcacctctgaaacaacaataaagctgggaaaactgcaagcttatgacttttcttgaatctgccagagaactgaagtggaaagacaaccaaatagccagaaatgtaagcagagatagatgcttgctaggaaaaaaggaacatgagcacttgcttacataaggttgactcatgaatgccataagaataactgggctagatagttaataagttggtagaggctgagtgtgggctggcaagagaaagtgaagccccagatggccttagatatatggagattttataccctcttgcaggctcttttatcacagtcccaccaggcagtttctcctacccttccctactgcaaaaaaaaaaaaaaaaagtcctgagaaagcatccttcatagtgcaggcttagagaacgaaagcaacagtgaaagggacacaaaactccacctgaatgcttcttcctatttccccaactggaaatattttgatttttgacaaatatgccatggttatataggatgttaaccttagggaaaactaaatggatggtatataggaattctttgtactatatttgcaacttttctgtatatctaaaattatgccaggccaggtgcaatggttcacactagtaatcccaacacttcggaaggctgaggcactcaggaggatcacttgaggccaggaattcaagactatcccggacaacataatgagtcgtcatctctgcaaaaaatggaaaaattggctgagaaatggtggcatgcacctgtagtgccagctacttgagagactgaaacaggagaatcactcgagcccaagagttcacagctacgatgagctgtgatcatgccacttgcacttcagcctgggcaacatactgagaccctgtctctttaaaacaaaaaaagaaaaaagaaaaataataaattttaaatttaaaaaaattgtaaataacaatttacaagtaaaattatttcaaatgcaaagtttaaaaaaataggcagcaactgtagccccacccgcttttcgggtagcattcctttgaagtagagatagttccctcatttggcagattagaattcttttcttattaaaataattttatatagttagaaaatcctgaaagtcttctccatccatctcttccctactctaccccattgttggcatgagcatcttttctttcagtgcttaaccttgttatggtttttatcccattatatgagacttatctacatacttatctttctttcagaatcctcagtgcttggcccatggtaggcattcagtggtatttattgtaataaacctggtcttctttaattgtcacttgtcttgatgaatggcaccattctagtataaaccagaaacctaggaatcatttttatttcatttcttccttactctctaccaagttctactatatattttttgcctcataaatatgtcaccaatctatctgtttctgtctcctctatagcccaactccaagcgaccgtctcttttacttgggatattacattatactcctaacttgaatcctgactcttttctcaccttcccccactttcagcctactattgtgcattgtacaattgtagccagggtagtcttcaaaaatataaacctgattttgcctttctgcctgtttaaataactttctattgtttttaggataaaacccaactttacataggtatgtggcccttactggcctagcctcaattttcccctttaacttacatgtaaaccccactcgtctagccagcccactggtcttctttaagaccctcagcagcataaactctcttataactccaggactttacatacatcacttcttcagtcaggaacattctcttctgtttctcccaaccttcccctttcaccgttatttcctgcttacccctcagctctctgcttaaatttcatctcctcatggaagccctccctgatctcccaggctaggttatgttatctttttctatactttcacagcaccctctacttttccattatagcaactcgcacagtttgtaataatgtttgtgtgattattaaattaatatctgtctctttcactagaactgtaacttccatgaggatagggatcatgtttgattttgtccattccagcatctggcacagtactcaacacatattggaatatttatcaagctcacattaatcaaattcagttcaatgtttattaaaggaataaaagaataagctatactgtgctaagtgatggagctggaactacaactgagtacatatacccaacactagattagccacctcttctgttagcagagtttgggctataaagagcagatatcatgtcatactccagtttataaaacctcaccccaagtccttttgatgctcagtctttttctgtttgagaacaggtcctgccaaacttaagaatccctgagtacagggatgggagtgggctgagagatttgtacaaggcacaatggagcattttgcagtaatggaaacttttattgtggtggtagttacacatccatatgcatttgtcaaaactcataaacctctatgcttttgagaaggttgaattaaaaaattcctattttgaggtagacatctgctttgtatccaaggacctcttcatcctactcttacattactgtgaagggtagatccatgtgtcatgaagacatgaaaagctattccaagtccagaatattccacactacctgtgtcttactcccaccctttaatctaatcaagttttatgaaaattgaatgaattaatgaaaagcagaaactatctttggctgtttgatcatatcaggacagctctgaggccattctgttcccatgataggctgtacttactcatctctacctgattcttcctcacaacattcatttaagaaacatttgcagaatccctaaaaatgtttcttttttcctttccctactctttactaaaaataaatgtgtcagagaggacctttcactataacatgatttcctaaatccaggccaagataagatctctttctcagtggaaacaaagtatactcagacttacaagttcaattgagttagtatttaaagttggtttattaaggatgggaagttaaaaatgtaaagataggctgggcgcagtgcctcacacctgtaatcccagcactttgggaggccgaggtgggcggatcacaaggtcaggagatcaagaccatcctggctagcatggtgaaaccccatctctactaaaaaaaaaaaaaaaatacaaaaaattagccaggcgtggtggtgggcacctgtagcgccagcttctggggaggcggagggaggagaatggcgtgaacctgggaggtggagtttgcagtgagccgagatcgcaccactacactccagcctgggatggagtgtagactgagatggagcgagactccatctcaaaaaaaaaaaaaaaaaaaaaagtgaagatatatactttgatcaagcaaaaagcctaaactggagaattggttaaattaattaagaggaggctgaaatcacagtgcttatttgacaggagtgtctattctgacttttgctactgccaacattcaactaagtcactcaatttttttatgattgcatccttattcaagagttcattttaaacattatggttgatgacctaacgctgaataatacctgtagcacagaatacctggcatatccatcttgggttttatatactttcattttttggttaactctttgttttcttttatacctatttagtatgtcatataaaatgcgtaatttgcatgccttcaaagtaaaatcaagactaagaaattcaaacttattggtgaaataccagcagatacagattgcttgaaatatacaaggtcctatcattagtttcaaatctttttcatatgctgtattggaaatagaggtgttaaatttctacctgttacgggcatgagtttacttttggtttttaatgataatagagcttccatttttttgtcttctgtgctctatatttttagtagaatgtttgtggagcccctctctcaagatgataggtgattcttaaaagtaagactggtctctttttcatagaattttctgccaaaatgtagtttcaaatatttaaacagtaattgaagaaaaaaatattgttagagtacaactatacagctctagatccctaactggatgttcagtaaataaatgctcttgttagacagtgaggccttggaacccaggctattattgctgttggtgatacagtctgaaccaagtgttctgccctatcctttatagataagattttatacccatcacaaatattaattattgcaaatttgctttttcagttataattcaagtttgggatatattcaagcatggtcttctcatcttagtaaattgccagtagtaagatggctagttgtgaatgctatctgtccaaaacatgactttttttccttagaagaagaagcctgtctctgtatttgttagcattcaataaggaatgaagtatagactgtctcaaaggcctaccatgtaccagtatgctggatactttatttactttggtcattataacaactacataaagcaagtatcataccagttttagggatgaggaaatgaaacctcagaataaatgactgtcaataatagctaatgaattatagaccagtgtttcagaccttgagctcttaagtacagaggcacatgaaaattgaattataggcatttacattatttttctaggcataagtaataaagacctggtttcttaaaagattaataaacagtttgttttttatttttaaaatctattttatccattgcagtattttgtacctaaaattaatgattgtcacaaatcacctgctcttatctggtaagctagtgggataaacagctccatgatcactcactgttgtgtagcacagctagtccagatttgatacctccacaaaataatccactgtgggaaaacagagttccaaatggaagtttttgttcctaaaggatgacagaacaaaggaattttccacttaataattcttgtatgtgttgctatgaaacactattgaataacatcatggaatcagaatacttgaactggaagagatcatataatatatagtctagtagtttttctgtttgctccgtggttggggcagggaggggaggaggaggagcttggcaagttatcttctccttccgtgaaacagagcactttaaagtgcttactttctttatcacttactttctcatattggccttccaggtaagcccttatttaaagaaatggttccacatctttaaaaaaatttttttcaccatttcctgattttacagatggcagtttaaggcctagagatacgaattacctttccaaggtcattccacttgctggagtaggtctctcagtgttgtagtttattcatttcttcggtaaacatctattgaatatctgctgtatcccagtccctatgcttagagctcacagatgagtggaagagacagatggatgaacaaataattgacagcacagaatgacaatggaaatgtatgaagttccatatgaaagaggtcaagagaagcatcctaagagaaattatatttgaacgagatcttaaagatggagatgattttgccaggttgaaaaggagaggataattattctcagctgagggaacagtagacagaaagccatgcgagtattacagagcatgacatgattagtccctgtcagagggactgggggtgtaaaatactgggaagataaaacagcaattaggggaagggttattactatagttgggaagggccagaacaggaaagatcctccacagcaagctaaggaaggaaggttttaccctgtaagaaataggctgccgtctgggcgtggtggctcatacctgtaatttcaacacttcgggaggccaaagcaggtgaatcacttgagcgcaggtgtttgagaccagcctgggcaacatgatgaaaccctgtctctaccaaaaatacaaaaaattagctaggaatggtggtgtgcactactcccagttactcaggaggccgaggtgaggtaagaggatcgcttgagcccaggaggtggaggttacagtgaaccaaaatcatgccgctgcccttacagcctgggtgacagagcaagaccctatctcaaaaaaaaagaaagaaagaaaaagaaataaggtaagaaatagggtgccattgaatatttttaactaggtaagagatgtgattgatcatttatttatttcaaaaaaagaattattctggtggcagtggcctagtcctagagggaaaaaaatacaaactgcaggttgcccttcagccatcttgcctctttcacttattgatggctgcgaatggtgcccccattgccttccccaatggcaataagtgttcattatgtcttgttttgttaaaggtgttttgtcctttatggtctctgcctgccacaacagcatagatcagatttggaggaccttttaaaactgagtgtttgactatctgtgaaatccctttttgtgttttcttcacttgaaatgacattatgacttactgtgagacaggataatttgtagtttcttttgtcatgatcttctttggatgtcatagaccatggagcgctctgcattggttcagaggaactgagaatgggaaggacacaagatttttatattactatttctcttgagtattctcgcttgtgatggattttggctccaggcataaagatatatggagaagcagcctgttgggagagaattttatatttcgcttggctattttgtgactaaatacagtgttaaattatttgtgtgatgcttgcatgatattaaattgaaagagctattgttttatcaaaaagtgctttagcatatactatgaaggctagatattaaataccagggcttctgtatataaagaaaagtcaagccagatttcttatcttaaattactttagtaagtaagcttagcagtggttcctaagaaacctaaagctctctttctcatcaaaagccccaaacagttggtctttgggggccatttttcttgacattatgctccagactcaatcagaattctgggtaagctagtatcttagcattctctgtctccaaaccttagatcacctgtgctttaaaataaaatctgtattacactttctcctaagcaagattgtctttttttttaaatgaaatacagaagagaagcagaaacttttctttagtataaattcttagaaacaatgcatattctaaaggccataggagtagacttgcccttacttcgttccaaggttcctctgctccctggtcctccatacttttatcaacagctgttttggagatttctgaatgttttgatactagcaaaaataatgaaatatttttatcagcgcaatagagaaagattgcataacaagcgagaaccaattacacaacttcaagaaggctcaaaccaaaagttgctcataacagtaatgaaattgttaattgaaataggcccaaagtatatgtcatgtctcgtctcctggaagccgcataatgggatccatatttcattcccaaaaaatagtgtttctatgaagtcgtgtagtggattaactcttctttaaaaactaatccccccaaaagtaagggaaaacatattactttaattaataatgtgggtttttagatactcaaaggataacatcttagaggaaactccatattgtgtgtaataggccccaggaagaagaaaaaacatttgttaatcacctgtaataggcaatctcaaacattttacataaattttttctattccttgcaacaatcccataaaattctacttctaacattggtaaggaaacacagccaaggaggaatgccttcttttccttcttttttaccttaagccttgggcattggggtgaggtgaccaaataatatcctctaaggtaacaaataaggataaagacctaatttatcttctatgcgtataagagttgaaggaagacatggatgataagcagtgtgcccaaaaatctcggagcatattgaaaagtggataaggctttctttgtagaaagggcagaacaagaaaatgtaattatcaagaggaggaatgctgtttattgtgtgacttctacgtgccagtattctgctaggtgtttcacacatgtaatcattttaagcttcacaacaatcatgtagggtaaatgcacttttcttcatttcacagaggagaccttaggggtcaacatagttaagtaactttttcaaagtcatacagttggtaattgttgggacagaaattaaactcaggttctgcaggtaatatcctctaagaccaaaaaaaaacggtatgtaatgtgttgtatatttttctgggagagggtaaatatctttgatcatattcacaaagaagttcttaaccccccaaaatagaacaacttctatattatgccatcttaagataagcagtacagagcagggaacttggagctatgtgagctcagtctttatatcccccttaacttctacccaggtaatagtagcaagttaaaccagaaaatacatacatatatccttcataatcctttagggctaagaagtctactttttattttgttggagaagaggtatagtgtgctaggtgaatgtacagttgctagagttgaattgcttaaatttaaattctaactctaccacttattctcttacatcaaattgtactatcacagtttcctcatttataaaagtagaatagtaatagtactatcttatggtatatgtgagcgttaaattagtaaatatgtgtaaattacttagtgcagacagcagtttccaaaggacatttgatgatatttaaagatatttttggttgtcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtggttgtttgtttttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgagattacaggcatgagccaccgcacctggccataatcatcttttctaagcagctaaagaaaggtaaaatttttaatctcaggtgggggggtcagccccccgcccggccagccgccccgtccgggacgtgaggggtgcctctgcccggccgcccttactgggaagtgaggagcccctctgcccggccaccaccccgtctgggaggtgtgcccaacagctcattgagaacgggccatgatgacaatggcggttttgtggaatagaaaggcgggaaaggtgggcaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcaggacacaaacactgcggaaggccgcaggttcctctgcctaggaaaaccagagacctttgttcacttgtttgtctgctgaccttccctccactattgtcccatgaccctgccaaatccccctctgtgagaaacacccaagaattatcaataaaaaaataaatttaaaaaaaaaatttttaatctcagatattaaatgactttaattaatagaacctcaatattatatggaaaaccccatttaaagtacgaatttttgatagtataaatgaatatgaaaccacatttgatgctatcagatacttgtaaatagtgtatagtttaatcctgtctagtattgaggtacttgtctatatatctgtattgatatatatatatatagagagagagagagagaacatttcatgatcatatatataaagtaattggttaagagtatgggctttgacattattctgacttgggtttaagtcccagccctgtcacgtacagatatgtgactcaatagacacataacttctctgggtctcaatttcttttgtggtaaattgtgatgttaatgtgattggtgtgatattaatgtgatttcttcagtggtaaaattgtgatattaatgtctacctgcttcatagacttaccatgttgattaaatgagataaagtatataaagtgcttagcatagtgcttgcccataatgagcactcagtaaacgatagctgttcatattatcgtcatcatccctgtccctgaaacttcagtacaagtgatgtggtaaaaactagaatagtcaaccaagaggctgattgctggtaaagtaaacctaaccataggttctgtagctaccacgtacaagctatctaactttacctactgtcttcacccattctataaaatcacctcaacttccctggccactgtacaaaggcccctttcctcatttgatatctaccaacatccactgttagcatccctaacctcttttggagataccatggatcttttttactgttccattttttactgagctctgagctatgctcatttttcatgtgtccactgaagtccacatagttatatatattttctccccaaaatcccatatcacacaaataaaaatatctaaacaggagaactgtttcctatcttgggttctctcaacacatgactgttaattttattcttttcacttaccgtatttcacttactgtatcagcctccttctaaattatatcataatctcccttaagtccctagattagtttgttcagaggcaaaacaaaagtgaaagattttgtgagaaatgcatagtttcattacacatctggtaaagacacgctatgattgctttcttacagtgtccagaagctaatttatggtactttctttgtttattgtacttgagcaatatagagtatactctgcagacatggtttacactttgaattagtttgcatctatctatattaatgtgttttgtaagccaggccttaatatctctttattgtgctcttttgaaaataattctcttaaatctatggaacgtgtcttacttgtgaagaaagacacatttttccacctttctaagattaaaatagtgagagaaacctcaaagaagaggaaatcctattttaaaataacagcgatctcctctgtagactcttggtttgcaggttgttagtcttcatcctctgtgtcaatttaatgtatcacgtaagtactagtgaacagatgtgggggtagggggaggcaagcagagtgttgaagcaggaaccagcagcattggcaaactggcaaatgcttctgttttgctaaacacctgcttttcttgtattcagattgtctgaaccatctgtttttatattctgtttacctactgtcagccattttggagttgttaaaatctttgaaagtagttgggaatttttcacagtaagctgggaatctataccactctttaaaaactttgtgtttttagggtattcccatttaatcctccagagaataattactttttaatttaggtgcaatgtgttaaatattatataattaaaatgtttttctcccttcccaattacttattcttagaaatcaaagtttaaattgtctaaataggtacttggccatagtgtgataacactaataacagattcgtaatgatagaatgtaaatattaatttatatgtcccctctcattaaaaaaagaaagaaaaaagcattacacaatttgatgaaaggtactaattttttataagcttacctactagatgatatgcaagtgatattctcaataaaaatatatagtatttataaatacctttttgcaccagatactatgctaggcattttgtccacattatcacaactcttctctacagccttgcaaggtagatattattgtcctcattttatagatgaagaaaatgattctttaagaagttgaggaaattgttcatgctcacatttgtgactggagatttgaactctggtttttacattgcttttcaaaaattctgtcatacccaagagatgattctgtgatccaaagtttctgcataaggagtcagaggtggtgcattttgtttagttagaagtgaacacacttcatttggtttgttaaattcctagctcttttctaattgtctgcagacgttttgttccttttgtcattgaggaacactgttggaacttggtccgctgcttttgtgttttgcaaggtttttcaaaaatgcttttactttaaaaagaaaatgaactagttgaggtctctgtaaaaaattccagcagagaatttgctttttccttaaagtttatatctgtctactggggcctctagtaacctttcaagataatagtcagaatagaatggctatgttaacatttttttgacctttgtcactacccagaaatgtgatctgtgcaaaatagaccttaaagatgctataagtggaggttcagttcaaatgatttaaaggcatggtgttaatagatataatccatatttatatttcacttttctagagcaaagctcacataaagaccaccgaaatcaatattatgaaagagtcaggcctctttggcctaggaatttaaacacttgaaaggcaagatcaggtttttggttttttagttaggatattggcaggacttgaaaatttctgaaatatttaaattcaagagtcgccttaaatatatgttaatttcagggaaaataagaagcaattccactttctctggtcaataataaaatttacagaacttctcccaagcaatggcacaaattaaaaatataaataggcttaataagttcatgaattaaagattctcaacaagttattatgaaaagatataaatatctgggctacatttctaaccctgtgaggttaatggtcattggtggaaggtagttcattgaagccttaatgagagacagttatgaactaggtgagccattgagctgatggatggcattcttatataattaacctagcagtggtaatcgcctccttcaagttcctagcctttctcgaaccaaggaaaaagagccaaaattgttgccattttgccaccttgacatttcttttcaattgccaaacctaactacctttcttcagtaatacaactaaaccagagagggctggtttttctgcattcagaactgtggatttagggtcattttggtatatatttaattgaactcttgggagcagatgaactcccccaaggaactgggtatatgagggcggagggcagtttcaattcaagaatgtgaagaatagaaatttctaactgaaaataaataattagaaagtgagaaaccagagtaagatgtccatgaaactcagaatatcgaggagaaagaacacatggtaacagaggcaataaagggccccagaagctgggcacagtagctcactcacgcctgtaatcccagcactttgggagtccgaggcaggaggatcacttgaggtcaggagttcgagaccagcctggccaacatggtgaaacttcatctctactaaaaaaaaaaaagtaaaaaattagccaggcatggtggcacatgcctgcaatcccagctactcgggaggctgaggtagagaatcgcttgaacccgggaggcggaggttgcagtgagctgagatcgctattgcactccagtctgggcgacagaacgggactctatctcaaaaaaaaaaaaaagggccccaaaaagatacaagctttacccctctgactctgaactatcatgcacaatgtagtcagacaaatcttaaacgtcactcttgtcctagggttcttcccacttagaaatctccctgttgctcatgacatcaagccagtactctggcttttaaggttctccataatctagctccatctactgtccagtttttggtttccacagctcccttctgtcatgctgactcccatttttaacttggatcatactgttctcttcctccttctgcccacactcatacaaactcatacctggatcatatttgctgttaaaacttaataatggcaatgctcgcactcatttattgtttattatacaccagtcactatgatgataaaccttctatgtgcattatatcttaataagtctcaaaataatcttatgacgaaggtgtcattaacctcatttctatagtagagtaactcaactaagagtacataggtaggaagtggcattcacaagatttgaccttaggtccttctaactctaaatccattaaatgatgaagtgtaattcctgatcttgctcctaaagcattttatgctctgtgtccttattttcttagcaaggtttgagattcttgaggaaaggggcagtgtctatacatatcttgtatctgtcatacaactaggacagtgctagattatcacctattttctcattgattgattggatatcgattagagtgagatggtcagactttatggtgacagaaggagagaaattttattctgatcctagtcatatttctgaagtaggtgttgttaattagagcagcatcttattaagaaacagtgggttggaaccagccagtgtttagttttcaagaattgtacattagaaaaagatttatacagagtctgtaagaatgttatttttggctagattagtggcactcttttttttgtttcatttattatacaaatacttatcattacaaatctgtttattatatgctaaacagtgggacacactattgcctagggaaagatattcctgccatcacagactggtggagaacacaaagttaataggtaatcattgttcaatgtaatgaggcccatgactgatatgcagaatactgggaacatattggaagataactgatgaaatcttggggaagacaggggaagactgacacccagggggtgcttgggtttcttttagtgtcattcacttctgcatataacatacacagggaagtaagataggaccaagagttgcatattagtgcaaaaagagaacagaagtgttcagcttcatgttttccacttttccattcaagattgcaaacaggctgagtgcagtggctcatgcctgtaatcttcaggcggatcacctgaggtcgggagttcaagaccagcctgaccaacttggagaaaccccatctctactaaaaatacaaaattagccaggcatggtggcacatacctgtaatcccagctactcgggagggtgaggcaggagaatctcttgaaccaaggaggcggaggttgcagtgagccaagatcacgccactgcactccagcctgggcaacaagagcaaaactccatctcaaaaaaataaataaataaataaataaaaattgcaaacaagaccaagaaatctaaataacagttcactttagttttttttttttttttttttaaccaaattaagggggttgaggacaaagtgaatattccatcttttctaagaagataattagtaaaacaaatgaatttaacctactcctcttagttggcaccaagaactacctgctatttccactgtctgataggtgccaagattattttatgtgcaagtcaaggtgtttttttctgagacggagtcttgctttgtcacccaggctggagtgcggtggcacgatctcggctcactgcaagctccgcctcccgagtccacaccattctcctgcgtcagcctcctgagtagctgagattacaggcatgcgccaccatgcccagctaattttttttgtatttttagcagagacggggtttccccatgttggccaagctggtcttgaactcctgacctcaaatgatctgcccaccttggcctcccaaaatgctgggattacaggtgtgagctactatgcccagccaagattattttatgtatattgaatgaaatagcatttaatatagtgtttactttggatttactagaacaaatgtcagtgaatacatatttttccctagcagctaagaaacagcattgtcaaacagtgaaaacaggaagttggggaaaccatttaactgtataacctcaagaaatctaaccactatttgattttgccatctaaagtattgtgttaggctgggctcagtggctcacgcctgtaatccctacactttgggaggccgaggcacgtggagcacctgaggtcaggcgttttgagactagcctggccaacataatgaaaccctgtctctactaaaaatacgaaaaattagccgggcatggtggcggggcacctgtaatcccagctactcgggaggctgagacaggagaatggcttgaacccgggaggcagaggttgcagtgagctgaaatcacgccactgcactccagcctgggcgacagagtgatactccatctagaaaaaaaaaaaaaaaaatatatatatatatatatatatatatgtacacacacacacacacacatatacacatatatgtatatatatggagttaatgatacctagctgtgcctattttgattgtacattcttagcgatgcaagagggagaatacaattagccttcccccagccaaaaagaggataatccaagtaattaaagatttaaaataaaattttatgaatgagatgtaggaggtagagaaagtagccatagagaaagtggatattttgtcagttatttttcttgatcactatttgagaataatatcatttaatatcaactacagtgtgggaaaaggcaatgatgatttcagcaaatgagcatttactattaaaaaagaagcaaaaataagttatgaaatatagcagagttctccacatacattgatgttatacaattatgatttatgatgataataattcccctaattccataatctgtgaaaatgaaataaacttatttccgtgaacccttcaaaaaagataactcccacaaattcctaatcaaactgattttaaaagaaaagagaaaaagtagatttgaatggagaaatcgagtgctacagaatataaaattttcattcatttgtatagtggattgtcatcttgaagtaaagatgaaatgaaacaaagttgtttgtgctttgaacattgaagcattgttcatcatgcataattaacaaagttgaaattttgtaagtatgaatcatgcacaaaagagccacagctatgatagctattacaggaaatggaggaaattaataataaaaggcaatacactacctcataaatacattctcatcataagattggagcatgaaagcattaagaaaatgccctgattaatttaacaacttaatcctgtaaattggagtatagttatttcagaattcatttgtacatagacaaagcagagacacaaaatagcttactttcattaagattttaaaagcaattcttatggatatgtgaagataatattctttcaaaagaaagattataagcggatgttccttaatgtttccgaaattacctagtttctatatctttctacaagtactatattatattcattaagaatcagaattggcacattctgggttacattccagtgatcttaccttctatataatttattttaagtaactgctaaaattatgatttttaaaagactatgtgatactaggaacataaattagaagaaaaaggtactttcttagttctcagtaattgagtaaagtttaatcctgattagaagatccttgagtaccattttgatgtgtgaaataatttatttagatgtttttaaaataaattttggagtatttttgtaaagtgcaaatacatgagtagttttctagaacggcttttatgtcatgtgaacatgtgtggatcactatattttttttcctattagctatttggtaaaagtccacaatttgccaaaatggttaataggacacaaatatagacatttcatatgatgtaccatgtaaatgtaaacctttgtagttacatgtttttgtagcaagagaattgttttaaaaggcatgtaatttattagctatcggtagcttctttattgccttgccgcactgcagtaataaataaaagaaagtgaactgattttacaaatggcacacaaggtgcacattttgtgggaaaaaaagtctttttttaaagaattggcattaaatcctttttttgtgatgacaaagaggctaagagtgcaaactgtattttctgtttatcgaaaacagtctttttttctccggggcatttttccctatgatcatcaagggatttcaaaagcaataaagtgtggaatcattgttcgacttgaacagtattaaaacttaggttttaatttcagtgaagtaataagatttgaacctgtctcacattacagcactgtaaggcatttagcaattgtattttaaaggaggtttttaaaatgcagctcacttgtaagctaactgtctgtcagtaattaatagtttttcttcagcattggctgttgtgatcagaccaagaaatatctgggtttttagtaacacattatgataattgtgaatgtttattcctaattagtctaaatgtctaataattttcagcttgcttctctggctgtttaaaagaaaacagagggtgatgtttaaagctacagtgtgtcttataaaaaatatgaatgtacatctgcatgtatatttcagtaagttttacacccggcaagattatgtcagttgactcattcattaactaagtattttattcttcagtaccatttcctagtttttgatattacatcatttatatagggattgccaaataaggtactgtatgtaaagctaaacccacactgatgatctggactcttcagtgatgaacattgaaacttgtctttacttcttaaaaagggctttaaaatatgagcatttctactaaaacaatgtggcaacatatttgctgatgaaagattgtatttaccatattgaattgccttagaaaataattgcctctacaaaaggaaacatctgtatgatagcgcatggttaaagctgccatcaatttttaacatttgagggttgagctatgaccttttatgatgactgtgaacagtaactgcatccattagccataagttttgtttctttattttagtagatggtctagactgtaaatattagagaatctaaaataaatcaacatattatcctaaggatacaaaatgtaagagctatttgtggttgggaacctttgacagatagtttggatgaagcagatgattgcctgcctagcgtatctggtctccattgctatgcctgcaggcagtttagtgctatggttgtatattgatgtcagggttagtactgagtggctagcagtgacagatgtctataattacaggcaatgcttccagtatttctgaaaagccagcctatgttgaacaattatcttatttctgccttgccaaagagcatgttccaattgctagtattagcaatggtgaatatagtgctttatctgctgccttgggacaaatgtgagaaaagcacttggttataaaacataaatgcaaaatattttttcaacattttaaattagttaagttcagtgttttcctaatttttatctccccataatgtttcttttgaaggagtcttgaaatataaaagcacatttggcatacttattggaattttgttttcccctaggccttgcgtggctccccagcgccagtatcccttgctttactgaatagatgtgtttaagcaagttggctttgaaacaagtttctcctatgtgaattgcattttctggttgacacccattacaaaattggaaatgcatttccatggaaaatctcctatgcccagtaagtttagttggaaacttttaacaagaaaaattataacataatagaaaattttgaaatgtgctaaacaccttagtactggtggctttccatttgctgagaattgcaattctcaagttttgttgtaaccttttttttttttcttaagcctttgaccatttattgtccatttctgtctctcaattttcatggtcacttccttccttgctccctcttggcccacttttctgactcattagaaatgttttcatgcttgttggtgccagttctcacctgccctttttatctggtcatttgcattcatgagctatgggctgtcataccacactttccagcaggtgcggctgcctaacacatgatactctctaaccttcctaaagattaaggtgttgggggttaaaacattatccatgttgtaagttatgaatcctgtattttcaggtaatgtagaatgagaaatatctaggaaatatcacttgagaatgcagtttatcttcaaccttaatctaacctgcaatgggtttctgctttgcatttaaccactttgctgaattattcattacattttctcatttagtcttctcaacaatgttctgtttaatatacatgaatatcattttgcagaaatatgaaacaatttcagaattaaaagcttgtttagtggcaggcccttggtttcaaccagatcatcttactctgaacccagtttgcttttcgctgtatcacattggctatgtatgtatttaggcatgagtccaggaatgatcagtttcagagtgtgttgactgataatgccaatatcataagtttcatctccatactagctgttttacttcccaaggaaaagactcatttctttaactgaagattggatgtctagtcctggctcgccatcagtcacaaaagaactaagctagatccttgatattttatgtcctacaataggagaagcaacctagaaccaatagtctagtgtcagagatcagtaatattatatttatttctgaaaggtagcccctttctgttcccactgtgagagaatgccccttgggagcccatcacctaaaaactcttaataattttaaactaatgatagtgttctggacccccgtgtctgtgtacattaatttagtaaagaaaatttgggccgggcacagtggctcacgcctataatcccagcactttgggaggctgaggcaggtggatcacgaggtcaggagatcaagaccatcctggctaacacggtgaatcctcgtctctactaaaaaaatacaaaaacttagctgggcgtggtggcagtcgcctgtggtcccagctactcgggaggctgaggcgggagaatgatgtgaacccgggaggcagagcttgcggtgagccaggatcatgccactccagcctgggcgacagagtgagactccatctcaaaaaaaaaaaaaaaaaaaaaaaagaaaaaagaagaaaatttggacaattggatggacctattgatctgaatggggaaaactttgataacttattggacacagtgatcatctacttactcagtgagttgaaaacttaccttggagataggaagcaggaacttgtattgactcaaaaaatgaggatgaaagctttgaatctggcaatataggtgatgcagataagttcttgagataaaataacaccaaataccacagatcattctgtttttctcctgactttttttctatcacttttcttactactttatttctttgcaagactcaaagactagacccattatttaatattagaagttatgttacctttcattaagaccctctcccctctaactactactaaagctactcacatacccacttagaacatatatctgttttctagtatctagtccagataaagcacaaagaaaagagacattccaataaaaataataggtaatacttatgaaaattttactgtataccaggactgttataggtccttcacataaattaaccattttaatctcaaaaattccacagattaggtactactctcatcctttttatatttgaggaaactaaggtttaaagggtaagcaacttgctcaaaattacttagtaagtggcagaatctcactagtcttgggcttcagaatctattcctaaccacttcactagattacctcctattttgtgatattatactttgtaaccctagttaaaagatgtacttttgccaatcagaaggttactttgcctgcttaagtcattagcctcagttgccacacttctataatgaaagtgcttcatgggaaacagtactaagagattctttttggttttttttttgagatgaagtctcactcttgtcgcccaggctagaatgcaatggagcagtctcagctcactgcaacctctgcctcctgggttcaagtgattctcctgcctcagcctcccaagttgctgagattacaggcgcgtgccaccacgccctgctaattttttgtatttttagtagaagtagaagcagggtttcaccttgttggccaggctagtctggaactcaggtgatccacccatctcggcctcctaaagtgctgggattacaggcgtgagccaccgcgcccggctgagattcttaaaaatcattctgtcaaatattatttatgatttattcttttttagggctagcttttagtaactggtttctggaattatctcactgaagcaatcccattgtcattcatataaccacatccagaatttgaacaggacttcaccatgtctctgctcatgggctccagaataaaatcaaagtcccaagaatatcataagtaacaaccacaaagattgtcagccactttctccttttatttgagattggggaggccttttgctcttatttctggtgccaggtggcaggtccctaaactttgtgctttttaggttgtacgcctgaggagtgatgtacccagagttccagagaaggcttggaaaatagttaaggtgagttgggttgctggttatgatggtggaccagcaatctttatgcttgtctcactacagcctcagattctaattagtaaaacaggcatatgcatacaatgattaagtgtaggcatgcattgtcttcattccctttttatgcattatataattctacaatgttcatattttatagccaaaggtttagtagtccactaataagcagtattagctgcaaagcctatatttaatgtggttgcatagtacaaaagcatcctagatttcttgatgctaacattgctgagtaaccaattataatcagttattaatacttaagaaagttttatttggctacattgaatagcatctgttattgaacagtgtctagagcacatgtatcccttgtgtcagaatgtgtttctggctgacacctttaggaggtacgggggattaaacaaaatattttacttcccagttccccacctctgctatcaccctctcacaaacttcatccagcatcagcttctttgccctaaaatttaatcgtcatcttataaacttgctattgcaaagaattataaatattcctttaactgtctgaaatgctctttcaaaccatggtcccaaaatcctctactaaaattaagccttcttcccaagcatctggtgccatagccatagttagcttctttttgaatgggcttggggagataatatatttacccagggctttaccatggctttatccatagaagactagtttaacagaagcttggccccagacatggagtgagttggcagccaacaggagcaaagctgtgtcaggacaaatgtacactctccattttctctggttggctttcagctggttgcaccacaggagtctttctgtggactgcatatcctgtgaccagtaactggtgcactcaacccaggtccctcttggctagggaaggcctgtcgggaggcattaggttcatgctggtggagatccttagtcagtggctccctgaaggaaagtaaggcaaacagccagcttctgttgaacaggtggtagttagaccctagatctgcttgggggtgggaggaaaagaatctctccaaaattaccagccttgctggttttcacattatacctgtactctttctaataaattattgtttagaaactgactcagaaatatctctgacagcatctggagctttctgacttttccaccttccttagcagtctggatttgggcccaagttagaaatggaaaccccactggggtgcaagcaaaagaggaagcatgttcttagccatgcatcagtggaggcccctactgggagaggggattatcacaaggcagcaggcagccctgcaccccagcctgctgagttcatgctttgtgccacaggatgtggagcgaaggaaatgtgaggccaaagtggtcactccaagttttcttatacaatagcttattcaagcagactgggaatgcctcttaagagatttgttaggtacatgtgcccttagcaagatggccaccacagatggtgggttcagatattctaattgaaataaatgtttaacattcagatgtattttatacttccataaccagtttttctttatcagatgctgttccttattcaactgaatgaggcaagcaggattattcaccttttaccacttgatttccaacataaattatggttttaaaatcaaattctggcaaaagatttttctgtctaatttcaggcttatatttagtgatgttatttgaaacgatatggaaaaattagtcacccaggattaatgtggatctattcagtgtcactaagtttgtgtatttaatatacagcaatgatgtttgtaccattaattctcttgttatggtgataagttaattgtgattatcatattttatcctgcttcaaatgttaatgaaagagctaagtacctttagttccaaatggtttagatccaagtcattaaatgctctattctttcttacacctctcctcctccctcctctactaatgcctttcacattgatgaggtctttcttatagaaagcactgaattgacctcaaaggcacttgaagcctaaaacaaaaatatgaaaattgatttcttattcatagtaagtgatttcatactgtgttcctaaattctcttcctaaggaacactaatgctttcattatattggatcctttccagtgacaggttttgttttaccaatttagaaccagttaaaaaccttcattaataagtcattccaatagattgaaacaatacttgaaaattcacagtaatatttgggggatcttttgtggtatcacttttgtattacctgatatgtttttgagaataaattggttcagagaaggtttgtcatccaatggcaaaatactttgttgttgacttctactgcactgttaattttctgcattgagcctgcttaaacaatgcactaaagctctttgagaagttatagcatcttaaacacttatagaaggcctaagggtattaacttactataattttctgaagattcattatccaaaatcttaattcattataaaaactcttttgaaaacctatagaaccagtgttttctcttattttcttatttgcacagaatgagagattcgttgttctttttaatttgtttcatgtggtgcttttgagtacatttcataaaggactgttattgaatttctgtgactgtcattatatatccatacaatctttaggaactaatattctgggtttcccagttctgtaatctactccaaatttaaagattgacataattagtttcctcagagttataaccagaatgttagagacagtgctccagatacctaagactaaggattaggattggtaaaagaaattttaaaaattatttcggcacatgctttttttattctttattaaatgtacaactcaaaattatgttgctatttgtagtttatgtccgcatctgtttttcttacctagttccctttttaaaaccatatgtaacatcttttaagctacttgcaaattctacaggcaatatttgtcatttgatgagttgagaatttggagaatgtattggctcattgaagcattatgtactatccaaatgctcttttcttaaatttataagaacctttgcagtaaaataaatacggctaagaaaacaaatatattaaaacagttttttaagagcatgccttctcaaatctgtaataatgataattccttacatttctaatcactttccatatttcaggagcaagagagatgggtaactggttaaaatgggtaatttttctagtttctaagacaatacacattgagaagtagaaagaatttgattttgtatcatgaaattttgaagcagttcctttatgcctttaacaaatgcaatttctgagtgttactagaaggtgttaattgaacatatttgtaaagatttaagagttatggatacagattataagattttgtttatttgttttaaccgtctttatgctgtgtgaaaatcttcaaagcaccttctgattttttctgttatttttcatgtgaagagccttctcttcaaaaggtgttacctgaccacttcagcacctactgtgcagaagggtcaatgaaaggttgtacagggaaacagcatttgttgagtaactattaaatgtcaagctctgagttcgggatcatcatttaatctaatcaaaagcccataaagtaggtttttttgtttttttgttttttttgagatggagtctcgctctgtcacccaggctggagtgcaatggcacaatcttggctcactgcaacctccgccttctaggttcaaacaattctcctgtctcagcctcccaagtagctgggattacaggtacacgccacgacgctcggctaattttttgtattttagtttggggtttcaccgtgttgcccaggctggtctcgaactcctgagctcaagcaatcctcccacctcggcctcccaaagtgctgggattataggcatgagccaccgcgcccagcctaaagtaggtattattattattattactattttatgggtaagaaaccaagattcagagaccttaagaaacacctagttagtggcagatatagaattcaaatgcagtatctttgggaccaaagtctgtgctttttctacttgctaagtttatcacgacagtgttctaagacaatataccactggagatgtaaagagaaatagacatttcccctgcattccaggagtacatgctgaaaatagtggaggaaacgtattcgtgtggaaattaatactacaaaaatatcatattctattatatgttttgagaagtgcccgtaacaggctggcaaggtttcaaattaagactcttcttactgaatttatagggagagcttcttccagaaatattatttaagcattaaaaccacaccttttaaaatgacaacattttaccagtgttcatcccagatgggtaggatttggggtatattatttcacagggggaagaatacatgccttttatgcgttttcctttgttaaagaatcatatatgaaatgggattgaccaaaatgtacattttaaccatatattctttttattcatttaagaaacattattgagtagtaggcacgtgagattttaaaaaaacagagcatcatttctgctctcagggagcttacagtctattatgcaggcatattatgaaatgcagaagaaggaaagaagggaggagggctcagacaggcaaaaccttggttacagaatgtgcatctctgactatataaaactcataaccaaaggcataaccatatattcagtgtcattgtattggccatccttctctgaaggatgaccacacagataggtttagtctcttatttcttagattttgactcatttttcattgtgatgagattatcttaatacattctgaaataagagacaaggaatctgtggactgaaagtgagttttttttttttccttttcttgcattcctatgtaactcctatatacttccttaaaatagatactgcaatatggtttcttcttggtgtcataaaaattatttcggttgaaataatacaagttgtagaaagtgttaaaaactctaaatactgtgttagaagatttttctgtagaagactttcattgacctgtgcttgatgataaacgattttgtaggtatttcctaactgaacaaattacttctcactcccaaattatccatgtttaaaagggataattaaatttcaaatgtttggagacattttcatgttttctgcatgttatctgaatgataaggtaccttgaaaaatgagaaacagtcttttaaaagaaacactgtaatcatacattgattttaaatgaccctgtcacacatgaaaacaaatcagattgttgctcttaatgagcttttcaatttactattcagtagatcagataagtggatttaagaggtaatgatcctgtttagtactcaagcttgactgtcagatcctagtagtggagagaaatccccaaggacaaaagcattgacacagttctagatgggataatgggaatcaaagctaatggatgataaaaggaatggtgcaagttacaaggataattgtggattaaagcactgccatgtgtcaatgttgactgtttttctagtatattattgggtcagatctgatgctttgagaaactgttttgacagcagaacacaacagacctgcctgcctagcttcctcctcttttgaatgccagggacacggtaggaaaacttccttgtaggacccattgaattagaaagcacattttttaatgttaaaatgtttgaaatgtttaaaatcacattttaaaatgcataataaaatgattaaaacaaaaattatgtctgagttttgccataaaaaaggcatttataatgtcttgaaaatgtaaaatttgattttacgaaagtccactgtagttatttatcgaaaacaagaaaattaaccagtaaagatgtaaatacaataagaagaaaataagtaatttgagataatgccatggacacatcctttccaaaaccaggatgtcatggaatttattattaatttcatttatctatataaatgatcctgtgtaccatcaaagaatttgtgctttgagttgtggtaaagctagtttaaacatactcattcatattttcatctttgttaaacaaacgtgccttttaaattccagtcagagttaagggcacacagtctctggccctggaactgagcaagtgggtaaagcagggcacacagtagggtgtctgatccctactgttagttgattttataaaactgggcttattttaaggatctcttgacaggggtgccactaaaataaaattaaagacaattgctataatcagttactaaatattcaagctgttctctctagctacttttctttttctgttgtaatttacgattctatgtattttgtctgtagaatccaatatgtgcttaatgggaaaagtcgtttctctctctttgtgtaaaaactattcacattataatatagtcctagtagatccagaccgtgtccttccactgcacattaaagccacgtagtattcacttgacacatattgccctaggtgcaatagtagggacacaaagaataaggcatagtgtcacccctcaagaagcactcagtgtcatgagggagattcacatccaaacagttacagtgtgaaaagcgccatgacagaggaatggactggacgttgtgggaacataaaggagagttcaactcactgtgcctaggaagccttcagaggagatgacttttgaatgagtatgaggggaaaaagaggaagaagactgattgaggcaaaatgaccagcacatgaacacataaaaatctgaaattgcatgagatgtctcagtgatccatcagcattttattgtggcttgaggttgagggaaatgtggaagttgaggtaggctgaggccaagttgtgaaatgctttgtgtgccattaatcatgtcgatgctaggttttccaagggacccaatttgtatacttctatatacgagagaggtttggcatcatggtgagcttagggaaactttctgttctacatatcattcttcattagagccctctttgtgcttaaaggtttgtgattattgaggattgttggtaactgacttctttagattctctctcctccttagctccctctttcccccaaacatcttacaagcaacaatggtcactttaatcttgttagagatgaaggcctactctcatgggcaaagtcacagatatataatcactgaaatgcttttctgtagggctcagaagttagtaggtaaggcagcaggaatttgaatctcagtcttcctttctctctctctgtttctctctctctctctctctttcttccccagcttctgctctccaccgttcagcccttcctgccttctgtcaccctctacacctaacccttcctcctctccctctttttctctccctctgattcactccatcagcctgaggagaaggcttccagacacaggactcaggttgaaagcctggaacacaacctgctggttcaaatggtatttaaaatccagaaaagaaatttctacaatggcagctttcctcccctctatgaccctatacctctgggtgatttgtgttgcccctgtgataccttcatgacctatggtggtgtatcaagctcgtgttcagatataaaaaacaaaagacagagggaatagaagctatgttgctgtacataagaaataggcagattaggagaaagtgagagaacacaatcacagaggatcaaatcacagaagagaaatcccatacagctggtgactggcagggataacctggaatcacaccagagcatcagggagtatggaggtgtcaacccacctctcagctttgccaggctagtaaggggtataagtggcattttcccacttgaagtgggatatgtgtttataagcttaatgtggcttggattgagactgaaatgttgcaccccaaactctgcaaccaacactccctaattggaagcttagtggattcccaggccctgatgttttcaacagggaatccctgagcttgggatttcagtgtcaacatgaaaagtaagacgtacctgtatatttggggaagcttaattaggtaatatttgaggagaatttctataagttaacttcctttgatttttttaaatccttatttttataactgccttaatcctgaaatggttaatattttgctgaaatctagaataggtggaaaatttttaagtgttggaaccttttgttgaagtactctactttccagccctttgcatacctactcccgtcttccagaaaggggtggtctaccactttgagaaaaaaaaaaaatgtgtgtggtgtggtgggagtaaaatggatatatgagtgtgtttgtgtgtaagcgtttatatatttcaaaataggagcgatctggaggaaaaagttagcaaattttaaaattataagattctttttaaaaaattcctttgctctcccacccactccctacttcagtgtggataccacagtgcattaaatcttatgtttgttcaattcgaatagtcttttgaaaatatatgttaatagtaaaacttttaacaatgaaatgttttaatgcaggtatatgctcgtatgtcagaagtcttaggaataacagatgacaaccacgttctagagacgttcatgacaaaaatgtgagttcttgttttggtctttaatttttcttttgttgttgttttaaatgtaatagatctttttattgtatttaaacctttttatatattaatttttaaataaaagacttaaaattatgctttgttagaatgttagcattgttcttaattgaaacttaatttcacatattgaaaagtcaccatccaaaggacattgtaatttgtcaagtttccatacaacggcagcgtgcagcatcagatgatgattttaaaagatttacagaccttgactcttcagatcaattgggcagcatttttttttatttaaaaagaaaagcacgcgatttgaaagaccacgtgaagagattattgcaaattgaaatcattgagagaggtctgatagggcattcattagttctaagagaaacctatggctggcagagacatattcatggaaactgtccttatattggacttataacattagcagaataaactagtttctagtcataactttgtacacgtagccaaacttgtatgcctccacctggcaccccgctttatctgtgtaacagacaaacaacactgtcttgattgcagacagcaaagttagataaacagtcgtgatcataagaagtgagttttggagccacagattgatggttcattatttggcagtaacagtgagcctctatttggctttctttgtaactcctgcttctcctccctaatatgttttgggtacaaacttgatgttttccagtgaaacacttagacaactttttaatttacaaaactaaatatgtagaattatacaccatttggagagcaatattcattgcagattgcatataattttgaatatgctattgaaagaatagacaatgtttttgagcctgtttttcactttcaaaatatttgtgatttaggtcatcaaacttacataaatttatgtgtattctctggttctccttagacaagcaaatatcttacttataattaaagactttttttcatatttagtgttacaaaccttaaatactggggaagatatgagcctgtaatttcaaggactcttcagttcctaaatgacctttctgttggatatccttttcactgtatatctgacattatgtgtaaacaacctagcagatgcatttaattaaccaggtattctccttgtttataatttttgcaattttttaaaaaaataaaaagacctttcatttagccttatctgtaaatgcatgtttttgaaaggttttaattagctgtatactatgaagcatttagtcggaatcactgttgaatttatatggacatatagattcctaagtagttacagttatatttatactcacccaggctaataaatggttatataagaaagtccacatgtattttagttcatgcttttttgtaattgtcagaaattcgtgtcctaaaagaaagtatgtaacttaattttaaggaggtcgaaatgttctaaaaatattaccttataaaaactgcattcctgtgagtaaatatatctctaatattcttcagttgaaaagaacatcattttcattagttgaaaggcacaatggagtaatacaaagaaaataagttttttgaccatttctttgattattgcccccaccaaatcaacatctaatctaatctaaaataagattccccattatacattaaatgtttagatttctctgtctagcagatttttaaaattctaaaaccaagaatcttcttactaaagtctagttgacagtattgtcatatttctaacaactagagagaatcatgtagattttcttttctacattagctatcaaatatataggacttgtgaaagataagtgttggattaatcactaagattagctgatcttttaatatgaggacaaattctgaaaatggtggcattgaatggaaacctttaatgtaggttcattccaggaatatgtttatgttagttaagtttaaaattgtattccttggtaaaccataaaagatttccaaagtattagacacccacttttgtgctggaatttaatatgcaactttttattggaaaataatcgtccttgtctggcaaaatccaccatgcaatatttctgttagtaggtataatgcaataaagccagggagggctatttatcactacaaattttgaggatttcaggattctttttattattttaatatatttctttgatattaaatcagaaaaatgataaattacacctgtctaggctgtttttcctttttactggaaagtgatgtacaacccaattccaatggtcatttggctttttaagatatgtattttttcttattaaaaaaaaaactcaacccatatttttttctaataataatgctgaaatactctttatttctaacatatgaagtggtttataagtacttcctagtattgcaaactctggccttttcacaatgaattactttgaaagcatattatctgcaaagaagcctcagttattttatagcatatatctattgtttagatttaccctatttttttaggttgaaattgatatttagtataaaattaatttgatttgtattcttttagtataatttgcataatgcctaatttatttgtatctgctatttaagatctttttctatcctattaagcctattatatattctttaattcaaatattatagccttttattttacatgctgtttattgcttttgagtacttctcaaagtgaattaaaaaatcatattttcagaaaacttactagataaaagtttaaaagctataatattttaagccaggggataggaatgatttcaacatgggtacactgatttatattttttagcaattatttcaggtttgcatatttagaaatatatattagttcaatttgatttcagtgctcagttatttgaattataaatcattatgtcccttctagctgatcagtcatgaaatatctttgaattcatttacataatggaatatgtgagtggtgtatctgttttagtgcagttactggttacctaatgcatgttttgtttttccaatggatttctttattataatgtgtttttcagtcttgattttaaagcaatacattatttctatattaggaataagatgacattcttcagcaatagaaacacgcaagatcaaaaccatcacctataggcccttgttattggaaatctgtttatatattaatattcaaaatatttttatttaaaatattagaagtaaatgaaaagcatgtttctcactatgaagttttttaatgttctttatttatagtacatgtcttcagatactttctgttttattttttctattttatctgcttcagatgaaccttactcagtgtttatggtgctcaaagccagtctctgaactttggtggtcttttatctgaccacttgttagaaattgaaatcacacaagacccccatttttaggaagtattaaaaagcctttggttgccttaaagcagtagtctcagactttagtgagcatcggaatgtgagtgctttttaaaacacaaattgttaggccccactccccagagtttctctttcaggaggtgttaggcctaggcctgagaattgcagttttcacaagcctcatgttaagttggtggctccaggaccatactttgagaacttctgtctttaggtagttagaaaatagagctgcattgtatgtcctgagcagaaaagtctggtacttccctcacagacactttttcataggacttcataaaactcactagacttacagttttagagatagtctagttcctaaataatgatgtggggacgtaagtccccagattgtaactggatgactgttgcattttaccccagaattgctgtttgccaaatttgaaacttttcaaattggtaagattattgttattttaaaatccagtgacctttttgacagaaagttaatgttttcccatcagattcattacatgggtatttataataaatttagcaaatacatttgagtaactgtttaacatactctttatattttcaagaccaaattccaagaatttctgaagtagcttttttgaacaggcacagagctgaaatgactctgtacagagccagcccgctgtgttcaagttcagtacttggggatctttcccttctttgaaatgtttcctggtcagaaattttagtttctgtctaaatgggaaaaggagagattgttcaaatgattgaatcaaggaagctcctgggaaaactggagagagaataagggtcatacagagcaatcaagtaaacttacttattttaaatgctgaaaacggagaagagtatcacattttatccaaaattctgtttgttcggtaatcattatttcaagtttttattcttttgaaagataattgatcagtatttctactgcaatttattctttactcaaatttgtagcagttaacatgctccacttgggtttcagaaaggaaatttcattctctatcaggccctctgttggtggttggcctttattacataatcatcaaacatgagaaaactaaaaatatctagagtgtgtgtgtgtgtgtgtgtgtgtgtgtgtgtgtgtgtgtgtattttgaggtcctttttttaaatatactttaagttctgggatacatgtgcagaacgtggaggtttgttacataggtacacgcgtgccatggtggtttgctgcacccatcaacccatcatctacatcaggtatttctcctaatgctatccctcccctagcccttcacccccctacaggccctggtgtgtgatattcccctccctgtgtccatgtgttgtcattgttcacctcccacttatgagtgagaacatgtggtgtttggttttctgtcccgtgttagtttgctgagaatgatggtttcctgcttcatccatgtccctgcaaagaacatgaactcatccttttttatggctgcatagtattccatggtgtatatgtggcacattttctttatccagtctatcattgatgggcatttgggttggttccaagtcttcaccattgtgaatagtgctgcagtaaacatacgtgtgcatgtgtctttacagtagaatgatttatcatcctttgggtatatacccagtaatgggatttgctgggtcaaatggtatttctggttctagatccttgaggaattgccacagtggttgaactaacttatgctcccaccaacagtgtaaaagcgttcctgtttctccacatcctctccagcatctgttgtttcctgtctttttaatgatcaccgatcatcagagtgaacaggcagcctacagaatgggagaaaatttttttaatctctccatctgacaaggctaatatccagaatctacaaggaacttaaacaaatttacaagaaaaaaacaaccccatcaaaaagtgggcgaaggataggaacagacacttctcaaaagaagacatttatctagccaacaaacatatgaaaaaaagctcatcatcactggtcattagagaaatgcaaatcagaaccacaatgagataccaatatctagctttttaaaatcagactctataagagagttccacattcgtttttgagtttatccaaacttttttttttttttaccttatggatactgttaaccgcaacagttctcaagattaatgacttctccatgttattgcaaggctagctacataatttgcagggcccacctcaaaaagaagaatgtggagttacttggtcaaaaaatgttaagaatttcaagacctcaacagcaaagcattaaaccatgaagaggctcttctaggcacagggtccactatgcaagtatacagcccgcatgcctgtggagctggctctggtttggtttgatataaagaaataattccttccatttggcctcagactgactctctaagattatccccttaagttcctgtacacctgaatttggtgaatgtaagtcccatccatatgcatgataaatctatttatctactagtttatttcagtcattttcgtttctacaagccaaagaatctattttctatcaaagtcacttgatgaccatgaaaattttattttttacccctacctttcccagctccatttgtctttcttttgcttgcttgttttaagtacaataattagaacttcatccttatctagagttaacatttagtaagactaaaatagtgatttttaaatttaattccatactcatcttgaatcttattgacctctttcaattcagcaaatatttattaagcatttgctaagtacacggcaaaagaacaaataaaacacagaccctgccctcgtggattttaaattctaacagaattgacactgattgcaaacttccttttctatatttctccaaagagcttaaagtcagttgttttattaatatagtttctatttcttctgtttaaatttaactcagataaattacatacgaattttctgaaaatctacacattaaaaataatgtgggtatgtgacattgtgatatggctgatttgagggagccccttttattcgaggtcatttagacataagcttatagataaaccattaagtatgcagcttttaaacttaccaagtaatgtgcaaaccagacatcctcacatctgtttctgaccttcccaccatttgggtgtgaatcctgaatgtggtaggtgtcaggaaagagtagaggatgagagatgaagcaaagggcaagaatgaaacaagggtgatggatgaaattaaaattgtttatgtctgttacaggaactatttagcaataaacagtaatatttctgcttttgtgaaacagtattaaaatgcattgctttattttactgaataccaccatctccagatggtttgtgagaatgttaaataaaactagtttcagcttacatccctcaggcatacttctattagcattttttatcagaggaaatgttgatttatttcattgttttctgtctttatcagctacagaaaagtcatcccataatttatctcctctgtttgtttgaatactagaatcaggtgtagaatcctccctattcctcttctgtagcccccttatttagaccttcaccaagttctttagatttttgtttcacaaaattacgtaccttgagtattgttttgatctgatcatttctcttcccaaaagcccacaatctcttccacctgcttcttaggtcaagcaaaagtattgacttaaatttgagtcctttgaccgtacttgacttactgagttcccatagctaacttcctgatactccattagaccacaatttgtactttatacttgggccaaggaaatttattttacctaccccttgataaccttcattatctttcactgaatcaccacatttgccactctccctcatttgacacactgtaactcaactaggtttattcaatttttcagtcttggctaaagacttagtaaagccatcatgaaatagcttaatccttagtcctttaatactaaatgttaattcccttcattttctttcaagtcgtggtttatttttcttaatgtttgtgaacaccttgttttcaatctacatatctgggtatgaatgtaatatagtttagtatttgctggtcctgtctcctattagattgtaaattattagagattaagacttgttttcccttcctttatagtttcaaaacttcatacagtgggcatttagaacttactgttgccccttctgttgagtgattatgacttaactcctgttccttgtaaataattattagtatcccttaagatgcttcatcgttgttatacctatttggattttttatgtggtttttttttttttgttatactttaagttctgggatacatgtgcagaatatggaggtttgttacataggtatacacatgccatggtggtttgctgcacccatcaatgcatcgtctacattaggtatttctcctaatgctatccctcccctacccccccaccccccgacaggcacctgacgtgtgatgttcccctccactgtgtccatgtgttgtcattgttcacctcccacttatgagtgagaacatgtggtgtttggttttctgttcctgtgttagttcgcagagaatgatggtttccagcttcatccatgtccctgcaaagaacatgaactcatccttttttatggctgcatagtattccatggtgtatatgtgcacattttctttatccggtctatcattgatgggcatttgggttggttccaagtctttgctattgtgaatagtgctgcaataaacatacgcgtgcatgtgtcttcatagtagaatgatttatcatcctttgggtttatacccagtaatgggattgctgggtcaaatggtatttctggttctagatccttgaggaattgccacactgtcttccacaatggttgaactagtttacactcccaccaacagtgtaaaggcattcctatttctccacagccttgccagcatctgttgtttcctgactttttaatgatcaccattctaactggcatgagatggtatctcattgtggttttgatttgcatttctctaatgaccagtaatgataagctttttttcatatggttgttggccacataaatgtcttcttttgagaagtgtctgttcctatccgtcgcccactttttgatggggttgtttgtttttttcttgtaaatttgtttaagttccttgtagattctggatattagcccttcatcagatggatagattgcaaacatttttctctcattctgtaggttgcctgttcactctgatgatagtttctttggctgtgcagaagctctttcatttagttagatcccatttgtcaattttggcttttgttgccattacttttgatgttttagtcatgaagtctttgcccatgcctatgtcctgaatggtattgcctaggttttcttctagggtttttatggttttaggtcttatgtttaagtctttagtccatcttgtgaataaatattgatgttattacccaaattatcagaaatggccaggtatcatatgaggataactaattagtatagtttttggcctatatagtctcccttagtacttttataatgggtagttcttcctcctattcttttctttatatttgcttaaaaggaattttgtctgtttgtgtgtgtgtatatgtgtgtctgtgtgtgtgtctagtagggttcatgagcaaaattccacttttgagataactaaacttacatttcagttactctactttgtgcatataacctaagtacagcaatttctgacatgtaatattgtcatctgtgaactttcttctttcatcaggatctaactctgtctgcaaaaagtgtctatgaacatgtatgacttttaaatatttgcccagattcagtatgattacccactctcttgtacttagtgaatatcatgtatctagtacactaatataattctaaatgaaattttttcacgtctttacacttttgtaaataggatatatcttataattgatggtatttttaagtactttttcttagtagtacatattatagtggtttttttgttttacaatcagtggtgttttagatttgattaaatggggtaaatactcagaaaaggcctggtactgtgaattgaagtcatacttggtgttactgtgtcaagcagctactgaattgtgtagtactcctgtaacctaagaaagcagttcattctcaatttagtatcctccttttcaaaagatatagattttcagaattttcagccatctatgagattcttttcttgtttttcttcatgtgtcatcctagctatcaataagactgtcttcaccctcttcgatgttttcataaccacatggctagagacagggattttctgagaatttagtttaatgggttactgccagccagactatagagtttgctcaatcctggatgtgatgctggctcgttaatgaattggtccctcctaaaataaaatgtttccctgtcccttctgggacctgattccgatttcaattgtatttcaagaagcaaatgatctctggaggagaactagcctctttaaaatcaaatggatctgatatagcctagtgaaaagaccctatgttttagagtcagacagatctggatttgaatcgtgactcttctgttgacatgttccatgtgtgacatttcctatattaatgttactctcaagacttctagtactgttgctactgttactgttaccaccattaccagatttactgctaagaggtgttttgaatagacctctgaagtctaacctagtgttgccataatttatctagtgctccacccagccaaaatggcacaactcagaagaaccctagtctcttagagaagaataagatcagagtgtaaagatcataaagatgatgggttcatttgccttttttaacattacagacccacttaagagccagaactagctttgaattggatttctataagataacataaatattcagatgaactctcatttttttctttattgaaaaatataaaaattcttaatcatttttttctttagaatgtaattaaaaggcagtgaggctggccttggtacaaagtgcacagatgccgttctgcagaaaatgtgtctttgacagatgagattcttcctgtgaatgttctgtttattgctttcataaatattctattgtcaaaacatgacttgctgtttattaacagcactgacaggaagattcctattaatggcagcattcttattacccatagaccctgtcacttttaacttcgcaattttaagagaattctatttggtaattacttaagatatttctaagtttattgatcccaccccagtttaactgagtgaagtttgagtggcaggtcttcagcccagtgactgacactaggaataatcatcaaatctgcatctttggaggcaaggaaaaacttgctacctgacagccttgatcttgttgccctgcagcctgccagaaaaacccagtgctttgtggccaggcacggtggatcacttgaggtcaggagttcaagaccagcatgaccaacgtagtgaaaccccatccctactaaaaatacaaaaaattagccgggcgtggtggcccatgattgtagtcctggctactcgggaggctgaggcaggagaatcacttgaacctgggcgggaagaggttgcagtgagctgagatcacgccactgcactccagcctgggcgacagagcgaagagtctgtctcagaaaaaaaaaaaaagaaaaacacagtgcactgagcacctgctgagagcagtgcaatagggaaaatccatggatgtagtccctgcccttagaaagtttactgtctaatacagatacatgctgaaatgtagatgtatattttaaataagcaggtatatggctaagccaaacatacatgcttcatatgcaactggaatggttgctttggaatcagaggaacttgagtataaatcatactaattgtttatcttttgaaaaattatttaattttttttagtttatttccttacctgaaaaatataagtgatgtgctacctatctcatggaattgtgaaaattagccttgcaagttgcacacgttgtgtgaattctctgcatctttctttttccgtgattgataattggcaaagacatttgcattatctgatcctcaaaacaatcctgtaaggtagcttgggcataggtttcatcctcatttcttggagagggaaactaaggctgagacaggctaggtttattacttggattcattgactggtatagtcaagcctaggtctcctgactcatgttccaatgtgttttccactctttgatacccatgcctgagtgactaacatttagaattatgcttttcagtgcccctgtgcagaggcaatagactgaggcatgtatttggagatgatgtgaaggaaaaagaaagccagtattttccttgtaacatcaatggagccatataagattattacagccttcaagaaaggcgtgagtaggtattagggaatggccgagagatgctctagctgtggtagaaaacacatgactatggtagagtaagagaagagggtatttgcatactgactagatgtgtttagaatccacatcatacctgaaattatttagtccttgtattcatgtttccgatttcttaactttatgctccttctaagttgaactgttcagatgataatgtggtacagcagaaagaacatggcctttggaaccaaactacagttcaaatctcagcactgtcaatccatggctgtataatcttgggcaagcaacttaatttctcttagctcctgtttcattatttatggactaaaaataataaataatacttaacagtgtaattgtgaagattaggtgaattaacatatggaaatgccttttacgtactaggcacttgagaaatattagttcctttaagctgtccttctatacttgatgacatgcagtctgctatatcctcctaattatattctgatcttaggtttctaccaagagagctcactatttcttagaattgaataattttctcttttttgatagcctattatgggtcttttataaaattatttcattatgaaataacattaagtaagtagaagttcgtaagttacacccaaaatataaaaagggatcagttttaattttccactatcaagactttaatagtaaaggagttcttgtcttaattataaaattcattctttctttccataactagaatatgtataagatagaaaaagtaattgcattggttaataatagattatcattcttaacagaaggaaagacgtttctataggaatgctctttagaaattatatttttttataagtagaaattgatgccactacagttcactgttactttgtgatttattacatactgatattacaaatatatttccttagattccttaacttctattacttatatccttttaaaaaaacttgtgaagatagatgctgtgaaattcatgctaaaaaaccacacggtaagtcttatttctttaattaatgaataacattttacaaatagttgaggtaaagtgttagtaacttggattactcttttgctttcattagagtgaacacttcccttttcttggcatcagtgacaatcatagtctcagcgacttcaggtgtcgaacaaccttctacacagcgctcactcgccttctgatggtagatctgggtaaggttaagaatttaaactcaattaataagggatcagcaatacacttgtgtgaataaagaagtggagtactagtgggtacaacatttaacttattagaattagcgtcttctgacagttttctacaaccttctaagatttgagtgttcacttgttagcattagagccaaaagacaaatatttgtacttaaggtggcatttttcacttcacataacacttgcactgattttttacctcacagcttactttctgcctatcctttgacacattaattttactgctatgaatctaggaataatcttaaacagagaaaaactttacacacaaagattttcgtcatagtgatgtctaaactagagaaaaagtagaaatgatgtaactgtccaacagtagggaattgtaaaattatggcacgcctacttacttgtagaatgattggcacgcaataaaaatgaagatttaaagacaaggcaatacatgaaattttatattataacattaagtgaaaaggcaaagtgttacactggtgcaaatggtatgatcatgtatgttggggatggggggacaatacttcagaaaaggcttaagtgaaattcttcaaaaatggttagtacagccattgtgaataacagtgtagaggatcctcagaaaattcaaaataaaatgactgtacaatccagcaatcctactactgggtgtataggtatccaaaggaaatgaaatgagtatatcaaatagttgcattcccatatgtttattgcatcgttattcacaatagccaggatatacggaatcaacctaagtgtccatccacagatgaatggataaagaaaatgtggtatatatacacagtgggatactattcagccataaaaaaggaaaaatgtctgccatttgccacagtgtggatgaacctggagggtactatgttaagtgaaataagccaggcacagaggacaaatactatatgatatcactcatatgtgaaatctaaaaaagttgatctcatagaactagagagtagaatggtggttactaagagctgaggactttgaggtgatgctggtcaaaagatacaaagtttcaggtagaaagaataagagatctgttgtacgtagatggtgactatagttaataacaatatattgtattcttgaaaaatgctaagagaatggatgttaagggttctcaccacaaaaatggtaactatagaggtaatgcatttgtcaattagttagatttagttactctacatcatacatatgtacctcaaatatattgcaggtttagttccagaccatcatgataaagtgatacagtaaagcaagtcacaccgtttttgttttctagtgtatataaaagttaaacttactgtactgtagtctattaagtgtgtaatgtcatgatgtagatacaatgtacatatcttaatttaaaatactttattgcggccaggtgcggtggctcacacctgtaatcccagcactttgggaggctgaggcgggtggatcacctgaggtcaggagttcgagaccagcctgaccaacatggtgaaaccctgtctctacgaaaaatacaaaattagccaggcatggtggcaaataccttgtaatcccagctacttgggaggctaaggcaggagaattgcttgaacccaggaggtagaggttgcagtgagtcgacatcgtgccactgcactccagcctgggcaacaagaacagaactccatctcaaaaaacaataaaaataaataaaatattttattgctaaaaaattctagcaaacatctgagctttcagtgtgttgtaatctttttcctggtggaaggtctggcctcgatattgatggctgctgactgatcaaagtagttgccaaaggttgaggtggctgtggcaatttcttaaaagaagacgacaatgaaatttgctgcatcaattgacttcctttcacaaaagatttttctgtagcatacaatgctgtttgttagcatttgacccacaggagaacttctttaaaaactggagtcaatcctctcaaactctgctgccactttatcaactaaggttatgtcatattctaaatcttttgttacttcaacaatgttcacagcgtctttaccacaagtagattccatctgaagacaccacttttggtcatccagaagaagcaactcctcatccattcaagttttttcatgagactggagcaattcagtcacatcttcaggctccacttctaattataggtctcttgctatttaaatcacatctgcagttacttcctgccctgaagtcttgaacccctcagagtcgtccatgagagttggaatcaacttcttccaaattcctgttaatgttgatattatgacctccccactgaataacaaatgttcttagtggtatccagaatggtgagtcctttccagaaggttttcaatttacttttctcagattcatcagaggaatcactatctgtggcagcctagagccttacaaaatctttttttctgagcagtaggcttcaacagtgggcttaaaattttcagtaaaccatgctgtaaacagatgtgctgtcatccaggctttgttgctctatttctagagcacaggcagagtagattttagcataattcttaaggaccctaggattttcaaaatggcaaatgggcactggcatcaacttcaagtcaccatcagcattagcccctaatgagagagtcagcctggtgtttgaagctttgaagccagacattgacctctcctctgtagctatgaaagtcctagatggcatcttcttccaatgaaaggctgtttcatctacattgaaaatctgtttagtgcagccactttcatcaatggtcttagctagatcttcagtataactcactgcagcttctccatcagcacttggctgcttcaccttgcactcttaggttatggaggcatcatctttccttaaacctcatgaaccaacctctgctagcttccaacttttcttctgcaacttcctcacctctcagctttcatagaatagagttagggccttgcttcacattaggctttggcttaggaaatgttatcactggtatgattttcttttttttttttttttttttttttttttgagacggagtctcgctctgtcgcccaggctggagtgcagtggtgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaacactggtatgattttctatacagaccagtgaaactttctttatatcagcaatagggttgtttcactttctcattgtgtgtttttgctggcattttaatttaatcgctttaattttcttcaataatttttcctttgcattcatcacctggctaactggtgcaggagacccagcgtttgacctattaaagcttttgacatgtctttctcactaaggttaatcatttccagcttttgatttaaagtgagagacgtgtaactcttcctttcacgtgaatacttggaggccatcacagggttattaattggcctaatatcaatattgttgtgtctcagaaaatagagaggcctgagaagatggagagatacaaaggaatggccggtttgtggagcagtcagcatacataatatttatcaattaagttggctaccctgtaagggcacaatttgtggtgccccacaacagttacaataataacatcaaagggcacagattaccataacagatataataataatgaaaaaagtttgaaatattaggaaaattatcaaaatgtggcccagaaacacgaagtaggttcatgatgttggcagaatgatgccaatagaattgttcgactcaggtttgccacaaatctttaatttgtttaaaaaaaaaaaaagtgtggtatctgtgaagcacaataaaacaaggtatgcctgtctatatacttcaaaacatgttgtatacaataaataacataaaattttatctgtaaatttaaaaaataattaaaaatgctaaatgtcgactttgggttgtagcatgtaggtaattttttctatttctgatcatttgaatttttttagtgtattacttttataatggtaaaaattaacttatttttaaaatttgttactaaaaagctaaagttagtgagaagtatttacagataggcagtaccttaggatgggtacttaagcttctttgtagtgaccatgttactctagactcccatttctcatatttgaatactgcaggttagaccagttatacatgagagggttcagtcagtggcaatatcatccttagacaataccaataatacttttttctttgtttctcttgaagtctattactacatcaacttaaatatgaatttttaaaaatgtgttcatacaaacagaagaaaaataatttttttgcccataaaaggcattgaatttttaaatggaaaggggactacacccctctatgtttcttgcttttttttcatgcttttccacagactaaatcaccagaaagacaaactgccaaaaagttgagagacatgcaactagaatgattaaagagcttagtgggattgatttctaaggaaagattaaaagaaccatgtatgtataacttggctaagtgacaactagggctggaggcaaagagaactatctataaatatttgaagagcgtaaaccaggcatgcaaaacccaatcatctgctaccttaggcaagtcggagatgtaactgagtgacagcttttcgtactgcatcctggcctattttacctcttggctgctgtgttggtgagaagaggcgcagccccagactgtgtcattgcccttgacaatcatttagaaagcacagtgtgctaaactctgagggcaagacaaagatgaatcaggcatactgggtcctggcctcaaggagcttgtcttcttgctttcccagttgtccaagcattaaagagaccttgaaacatttgtctggacttaatttatttcccaggccttaaaaatgctcttttaataacacggtcacacagagtgaaagaagtggggagaccaaaaagagaagtatctggaggagagtttttaaaactaggtccgtgtcactcacattttcagaacctggaaatggaatgggttaacatttcctttttgatatggtcatcacagatagggaacccactatgtatctgtggtaggttaaacaacaggatagcactatcggagcctgcacacagccccaactctgtattctcagtactactgtacttattactgcattgataattgatattcatgatgatgcccagaaagacattgcacactttttggaaagcaaatttgctcttatttagtattgcttaatgtaaactatgaggtatgagaaactgaaataaacacatataatttgaataattggattttattagtttacccaggattctattcctttgaaatacttaacccataacagtataaagaataaattcacatttttagttcaaagtttttttttaaatgtaaatatctgttgcattacaagcactttttagacaccttgagagaaacagaaagaggctatggtggaagtgcttggtgcatggtaggtgctcaatataagtcagttgaatctggatataaataaaatttaaaatcatagtagctaccctcatagaacttccacatgtttgaaaagaaactccttccttatttatcagtaatttttactttttaaaataatgaaatgtatgtgataagcatcaagttatgattaaaagcatcaagtatgatttgttgtgtaaactaccagagctgctttctgttgttaaaaactggagttattcttcttcccaaaattatgttgggcaccttcaaggtatggactatcttttttatatttttctagcaccagtcagggtctttacattgcagatgctcagtaaatgcttgttgaatgaatgacaaacaagtatacagtaaccaagacaccgtcattgtggctcctggaatcagctctggctgccaggttctttctggaagtagctctgatcattggcctctcccaagacaaaacaaatcaagtggctgattactttcacaagtgattagctacacttggccactcttgtgcccgattagtctcttgttgctctctgttcagagtgttattactttatagacgatgatttgttgagcgttgttgaacacagtttttattatttgaagccttgtctcacaaactaggttgactggaacatggctgtcagaatttctgtatatatggcttgatagttttctattgtgtgttcattgtcatggaaacaaggaagaaaaagatagtgctgttgtcaagagcagcatagattcatatattaaatgaaaaaaataaaaacattagataatgaggatcctcctcaaattaaaaaaaaaagacaaactttttatatcactgattttggagagtgggagtggggataagaatcacagaaaaaaaaacacctactttcttgcaaaagtgttggatgtgattcttggatggaaatacaaaacattctaattgaatcctacaaaaataaattgaaaatgtcttgtgtataagccatgcacattggagtgattagaaagggggaaagaaattgggtgtcacattaattggtatttactttgaaatgcattttggtttctactcagtgatttgcactttgtatgaatttaattagatgctatgtgccccaggttgtatttcagatgaaaatggcggcggggcagggggtggttggcaataaacagttgtaccattttatcggattgctttagctaaactagacaaaatgttcacttgcataaagaacagaattgaaagcatttcatcattagaatagtggtgtttcaaaacatgtgagagatgttggcaggtttttttggtgttcgaagaaatgatcaaaatgaatgcagaaaatcccttcacgtgcagaaaaaaatggatgaccaaccagatgtgcatgtgtgttagcccttccaagaatcacttcaagttccctaggttatttaaaattaacttggtcgatctaataaactaaaggaaagatagtattacccgagccagtaaatggagaccctccagggagctattcagtataaaatacttgaataaataaaaatcttctattttgtttcatttgaatgcaggtgaatttagttgacaaatactgaagagggtaggtgtggcaaggcactataacaacgcttttcatttggtgaagaaccaaaattattatttgcaaattaagtttttacaagccacaaatttggaagtgctcagtgtcaccaatggttgatttttccttggacatttcatgattgcatcttatgttgtactacttagatgagaagcacgtggataggatttgagtgagcaatgcattcctcgggtatttaaactctaagaaacagtcatatttttaattactagggggatactaatattaaaatgatgtttatggatgtaaagagatagttctatctttaggggtgagggtagcacagtatccatatactttggcttataagaggtaattggcatctgaagatatcactagcttaaatttaagaaatcttgaatgacgaatgacttgaataacaagggaagagtattctagaaatagctactaaagatagaaataaaaacacagaggaaggaatttttttctttattaataatagttaacatttgtttaaaaatatatagtttataaaccactttcataggcatttatcctttttgatccgcctgcccacattaaataggtattattccattgtttatctgttagaaaactgaggttcagaggccgggcgcagtggctcacgcctgtaatcccaggactttgggaggccgaggcaggcggatcacgaggtaggagatcgagaccatcctggctaacatggtgaaaccctgtctctactaaaaatacaaaaaattagccaggcgtcatggcgggtccctgtagtcccagctactcgggaggctgaggcaggagaatggcgtgaaccccggaggcggagcttgcagtgagccgaggtcgcgtcactgcactccaacctgggcaacagagcgagactccgtctcaaaaaaaaaaaaagaaaagaaaactgaggttcatagagattaaatgacctgcccaaggtcagccatgtatgtagtggccctctgaccacatattttcatccacttttactaaactattacttcatctttcaccttatcaaccagtggagaaatacaacttttttccttcatttttatttgaactatttggtccaaatgattgatttggggcttgggggcagtgaaagaaaatgagaaatgattactttctaagcgtctatgaaataaacagatagatgcatgtttattgtttgttctgtataggtatattatagtttgatggtgagtgaaagtcaaatgtagtttttaaaatttgttcttatgcctaataattggccaaagcgtatttcttctcatggataaaggaacacagaggtggatatctcaggaaggtttagcaagtgaggggcttgatcagaaatagctgatagataggaagaatacatcaatgtatcaactgtgtccatgacttggcagagattatctgaaaaatagacatggggggatgggggagtgggcagtaaggggtaaagaagcagctggaaatacttaaaatctgtaatgagataattaagactaattagctggccctgtaggcagaaagcagcccattaagtccagatccagttttaataacttacctggttttgaggctagacagtccagagcaccccagggaatgagatgtttcatggatgagacttttagggtgggattctttgaaaatgggtagctatagtctgcagtgggcagtgtattttttttccgggaactaaaataaacactctggttccctagggagaagaattaaagggcacctcagttttctcttctgttaaatggagaaaactacgtagaagagttgtcatgtggtttaaataagataaagatacataaaaaggcctagagcaattcctatcacaaagcaagttcttagaaaatattaagaaacgtttattgagtgcactattagaagaagcattgactactgctgggacctcaaaatgaggcaagtttggctctcttaatgccatctactctgccttcaatatttagggctattattttcctgtggaagtaagatctgatgacacttcccaacacatactaaaatatcctgacctgcctgaagccacaggtcatttcaaaactagctagcactcctaagcaatttagagggaaactgaaatgaaaaacaaattgtggcccaagtttcaggggccagttaagcacatttctcaaagttttactgtaatataacttagaagtggtatcttaatgaagcattgggaaatagcagatgatctgggcctagacctgcagaagtcatcagctcttctgagattgcccattgttacttggttttgaatggtttattttcttcgcccagtgcctatgtctccttgtttatctctcctcttaattttccttagtttggaccagagcttcattacacctactttcttgcaaaagtgttggatgtgattcttggatggaaatataaaacattctaattgcatcctacagaaataaattgaatatgtcttgtatataagccatgcacattgcagtgattagaaagggggaaagaaattgggtgtcacattaattggtatttactttgaaatgcattttggtttctactcagtgatttgcactttgtatgaatttaattagatgccatgtgccccaggttgtatttcagatgaaaatggggggtgggggtggttggcaataaagctgacctttactgactatattggttttctgttattattgctgtaacaaattaccacaaggtagtagcttaaacgatactaatgtattattttataatcctggaggtcagatgtccaaatgggtctcagggagctaaaatcaaggtgtcagcagggctctaaggaagaatctgttcctttgccttttgcggcttctagagaccacctgctttccttggctcatggcctccctttctccagcagcgtcaggccaaatccttcccatgctgccatctttgtggttctttgacttctgcttccctcttgcacttttaaggacccttgtgattacattggacccacctggataatccagaatacttttctgttttaaagtcagttgattagcaactttaatttccctttatcacataacctaatatacttacaggttccaagaattagaacggatatctttgagagggtaattattcgtattctacctgccatattgatttatcacaattgccaaagtgtttcacacagtacttatacagtaaatcctcagtaactgttggctaccatcatttacagttatcatatcatttctattacttgcttctccttgcccacttcccccaactccccagtaatccagctgctatttgcattcaaatttaaggaaattagaagtttcactgttttgtgtacatttcggagggggagcaaacccagatttttgttgttggtattattgttttagattcacatgccataaaattcacttttgtaaagtacgtaattcattggtatttagtatattcagaatattcataaaattgtgcagccatcaccattatctaattctataacattttcatcacccccctcaaaaaccctgtaccattaagtaattgcttctcttctcccctcccccaaaccctggaaaccactaatctgttttctgtctgtatggatttgtctattctggacattaatataaatggaatcatacaatttgtggcctctgtatctggcctcttccacttagcatgttttcaaggcacattcatgttttggcatgtattaatactttgttcctttttatggctgaataatattccgtagtttggatgtgccatattttgtttagccattcattagttgatgaacatttgagttttttctacctttggttattatgaaataatacagctgtgagcatttgcatacaactttttgtgtggacaaatatttacagttttcttgggtagatacctaggagtaaaattgttgggtcaactggcaactctaattttttaagcaactgccaaactgttttccacagtgactacaccatattaacaatggttgtagcattttacatttccacccctggaggttttaaattgtacaaaataataaatgaaatgtcctacaaacaaaatatctgccagccaacatactaaaacagttactcttatattttaatgtgatgtctctgaaggaaaaaaaatgtttagaacttacaaaatgaataactttctgtttaaacatattctcagagacacagcggaggtgattagctttgggttttacctaaaagctaaggaatttataatttttatctatacatgactgagaacttacaatgttatgttcacatttacttttcctgatggcaatgaaaatattagtctataaattggcactttaccttcaaatcatattggtttctgtacctttgtcttattaagaaaaaaactaacagcttcaattattattcataaaataatcatatatacatttggaacactaaatatatgactacatacttgaatatgaagttgtaagaaagtgagctcatgttttctccttttgcaccagaaatagtaaatgatacctgtatggtaatacagattagaaaaatctctaatagtaatgttgtaaaagttgtttgcatgatataaacaacaatatccagttctccagctttggtggcacaacatttcacgttgcaatcacaggaacagtgctgactaaaaacgtaaacatttctatagtataatgcaccaatgtcttatatttgcctactttaaacccaagtgattgtctaggaattccattttcctcaccagaaccaagctggctgatcttcactctcttctgacttcatgcagctccaaatttaggattctgtgacaataacattagtccccatctctgatgccttccaccttatcagagacctggaaaagcatgagcttgggagtaaagcagacctgattgggaatcctggctcgctgacatttaccagctggaggatgttgggcaggctatctaattcctttgagtctctctgctcacatgtaaaatgaagaaaatcgtacaacttcatgagattgttctgaacagtaatgacttgcaacagtactttgaaaacagtaagagccacataagtgttttttaagcaaataaagtaccaaatccattgcctgcgtaagcactcaaggaataacagctgttatttagtcaatccacaaacatttcttgagtgtcagaccttattcaaggcactggggatactctgtgatggaaatagaacaatttccttcccagggaacttacgtcctaataggataaacaacaaatgaataaatatgtcaatgaatggccagtatagtaagtcccataagaaaagtaaagcaggttatggggttggaaagtgatgtggcgggaggggaactgtgattaccattttagatagagtggtcagggaaggcctctctgaggaagtgacagttaagtagaattgctgttcacattactgtatttatagtatttgctccttgacttctccctgcacattttggtggcttgtctcttgtgctcctgctatccttgtttgccttaaaatttgaatggagaaagagacggaatcaggaagtttttttatctgtcgctcagaatattaagttaggagttgaaatgttaaaagtctgaatttgtctttgttctgaacaagcatccttaccttggaaaactttgttcccaaaggaagggcactgggctggcaatcttgcagttatactttttttgatcaccgtaatcacctctctaagtccatgttagactcaagacaacaatagtgctaatggctgtcatttattaagtaccagacactgagcagggggatggggcgagggggtggttacagatgttttgtcatttacttaattctcatggctaactttatgaagtaaatattatgtctcttaattacaggtgagcacactaaggctttgatgactaaagtgactttatccaaaaccagacagctaacagtggcagagccaggattcaagcatagataaacttttttttcttttttttaagagacgagatctcactatgttgcccaggttggtctcaaactcctgggcccaggggatcctcctaccccagcttccaagtaggtaggattataagcattcaccactgctcccagctaagcttagataaactttgtaatttcaaagcatccattctttctagcaccattacatgcctgcagtggtagttaccactgttctcattaataattccacatttagaaaatactttatcttagaagagtaagattacatggcttaagtataatgagcatatattttatgtatttaggatttgataatgtatatttcaattatttattgtattattctatgtcaagtgttaagaaaataaagatgttctaaaattcaccttaattgagaaattactttttatctaaacacagtatttccctaataatgccaggctctattctgtgctaatactatagtgctagtatcaccactaatatttattgagcatcttctgttttccatgtattataacatttaatcttcacagtgaccctcaatgataagtatttttatacttattttatagatgaggaaactgagactcagagtaattagtaaaatatccaaaggtaaataatatacggtaaagtcagacacctggacctgtttactgccgagccctacataattctccttcactgagaaactcaaagatacacagtctcagtgccatagaagctaatccgaagatactatcagcgtaagctagtagagctagtaatttacatgtatactttataaattttatctcatttagttcccgcagtaaccctgatcagatggtagttgtggtataatgtaagtggtattattgttgctattattagatgtatgcttaaatatctgcaattcaaggcagaccggtacaatagttaagagccaggcggccgggcgctgtggctcacatctgtaatcccagcaatttgggaggccgaggcgggcggatcacgaggtcaggagatcaagaccatcctggctaacacggtgaaaccccatctctactaaaaatacaaaaaaattagccgggcgttgtggcaggcgcctgtagtcctagcaactcaggaggctgaggcaggagaatggcgtgaacctgagaggcagagcttgcagtgagccaagatcgtgccactgcactccagcctggatgacagagcaagactccgtctcaaaacaagccaggcaaaatgctatgggaatccaaagggagaagggagataacttgattgggatttaggaaagcttagcttagacattgggaaagatattatttcacctgggccttgaaaaataacatctgtataggtctatgttatcaccagttaacagagaagagtgtatctaagaggagtcacttggtcacacagccagttgacagagaagagattataatttggtctgccttactctttactcaggatactgaccttcgtttagaacggcacaccagtaaagatttgttggccctttggcatctgtttgtaacaaagctaagtccccaattctgttgtactcctgaaacaatgtgaaattgaaggaaagagataaatcacagaagattagagtcagccagatcagccactccttaagagtcaaaagatcttgatcctgccaggacctccgttactttgtctgaaaaatgactatagatgccagtgtttttcgaacattcacaggcatctgaatcatctggagggcctattaaaacaaaattgctgggacccacccccagagtttctgattcaatagatatgggatggaacctgggcatttacatctcacaagttcacaagtgatgttgatgctcccaggtcaaggaccaaactttgaggaccttctctgagctcatttcctctctaatactctattgaaaaactctactgttagaatagaaattaggaggtctgaaccatgtcgttccacctccaactaagtattccaccttaagcaagacacttaacctttctctgcctgtttcttcagtagagtgcagctcgtagctccctgtgacttaggatgaatgagtgaattcaatctctcatttaaaagaaaccccttttgaaaaagaatactatataaattatcaattgtgcatatccatgtgtgaagtgaagattctgctttgacagaatccttgaggaaactgcagtctacctttaaagtaaaaagttaataggaaatgtctcttttccctcttctctatttaaaaaaaaagagaaaaaaaaggaagcttagtgtaagaagtgtacccatggagaatgtatttaaaatccaaatgacccataagggaccccatcctttttggcagataaaagtttccctgccatttatttgataaattaattaaaaagaacataaataaaagagaataataacttagagctatctgggcacctgagtctttgagccctttagggccttggcacccaaagagaagggggaaaaaaaaaacactgcgtctctgaggctttgaaagtggtcttccttgaggcattagagaagctctaggggccctaggagctaaaggactgagatgcctggggcatgagtctattagatccactaaagaaccaggaaaaaaaaaatggctggtaagtaattttgctatttcatttgatgcaaaagagaaggcacaacaccagaatattcagtgagcaaaagtacaaaatgtggcatggatgtgaatgcaggctgaccccttctcgggaatatttctaagcctaaatgaagcactcaatgctgaggacaatgtacaattctatgcattttaaaccgtagtgacccttttgtttctctgataggtgaagatgaggatgaatttgagaatttcatgctgcctcttacagttgcttttgaaacagtattacaaatattcaacaacaactttaaacaagaagatgtaaaggtgggtttgtttccaaatatgaggaatgacagttttgttttttctaggatatctagatccagaaaagggctttgcatatctgtgtgtactctttgcctcctcagacctgctttcccaattgcatgtctttaatttttacttttatttaagcatttttctagtttcttagacaaatggactttgaggtcagcaaatagttttggacagtcagttcatgataagatgacatagatttgtttcctctggcagttactatctttaataggatatttcttgtgggtacaccactttaaacacccctattccctcatctatcctgcactgttatgttacaacagatctatatggaggaatgcacaaacatacacatactaaaacactacatctctaaatatttttttaaacaagaatttatataaatcaagactttattaaatggctaggcatatatgtataaataggaactggtcttgaagtattgcattcttaaacggaacaaagtgattaggataactgatagctaaataaggtttttatgtgcctgtgggagccatattaggattgatttgacaagtcagttcagctgtggcaacagtcataatatctaagacaacattatgttttattagtaaaatccttaagtgtagcaagctgtctgtgacaaaacagccccgtattttaaggagggggatgggaagcacaagcactgctaaatagaaatagtatcttctgaaattataatgtatcagggaaatattaaataaattgacactgattattatttttaacagactaataaatgcactccagagaatgtagacacctttgttggtgataattgagtcatatatttcatagttatttgaagtatgttggaaatattaaccatcttttgcatagtgtctcttcaccaaaaaaaagaaaacaaaaacaaaaaaactaacagtaagaagccaaatagaaaaatgacaccctttgataattatctttatgtaattcttctaccaaaaaataatcagccaaatgctatacctcttaatttaaaagaatttttgaaattaatgtttatcagcatgctatagttatagaattttaaaaccaaaagaaggatcttacagattctgtttgtgtttatagtcttcctgaaattcttcaccagagtttccactcaggttagctgtatcttttagatgtcttccaaatattttcagtgaccaacaaaatctttgcagcttttaggttgctatttctgccctttatcaaaaaggagcagtgaagttgaaaaacatcatctttatgaaaattacatctgtctcatctgaagatttcattatattccaagaccattttgttgtaatcccatctagtttgatagaaaccatcttcctagagtcatttttaatggagttccagtgatatatccctaaaccagcaagttcttaacgaccctggaaagtgactgcttgattacactttaacggtatttgcaaataaaatcacaagtaattaaggggaaatctccaggcttttgagcaagtttgatgcatgataactgcctgattcagcttcatctagagtaatgctgtgtaggcaacagctactgagatcaatagcaacgtaatgatagtggcagaattaagtgagtaacctgagaactgtgcctcagaatgcatgcagctgccacgaaccaaggccacacagtgcactccgtgcttccgtcctaaatgttcatcaaaagacgccctgcaggaaaatggagttagatgctctttattgctgatcgtgtctcttgccacatttatcagggaaattggattagcagttggcagctgcaggtagacaagattctgcagtgattaaatatgcagcttggctgcatttgttgtgacagacctttagtaaattctactgtaagcaccatctgtctaatttgtataaagaaaacttggtgctttaagctaccgataaaaaactaaatctgttgctttatcataaacaaaacttttgcactaaatgcttttaaatgtaatttattaggttaaggctatttttctatcacgatgaataaataatacatgcaaaagtgctttcaggtacttcattttgcaagtactagagataaaaacatttctgttttgttcttcaataaagtatttagtattccaatccacaggaggtgatgctgttaaaatatctctatgaaaatgccgcaggactgccaaattcatttaatttgcacctcttaccagcattttctaactccctatttatagatagtttcaaatgcagatttcaggataaacttaaacattaaggacctgtgttgccaaattgaaatacagttgttagaggaggaaatgcagcaaaagtgttaaatttatagctttattttcttacttattcttaataaaattgaagaaaacattgaaattttgtcttgggtttttctcttcaaagtaaaggggaaaaggaaaaaatactctgacaaatcctagctttagagtactctttcaaaacgtatgtttccccctataattatgtccatggtaaaatatagtccagtactcccctgactcgtgcatcgtttttgatttggtcatgacatcatcagtttcaaggaaaatgaatgaaaacttctcagagaaagagaagcagttaaataggaacctgctatctttagtccttttgtaaaaactccacaatgttaaattatttaaaatccttgattttcagcatgcgcacattaaaagttttcgcactaagtgccaaatgttgcaaacagcactttaacagaatgattttgctttgatccctgtagcagttcctgaataatttatcacaggttattgccttaattctggagagggatagagcaataaaggcagatgaaaacactccagttgaaacaccttggggcctgctcattcctctgacacggctcttttgttggaactatttagaggttattaagatgtgtcttcagaattaagagtatgctgtaaggatgaagacagccatcttaattctaaagacaaagcacaatgacccttcaccttctttttctttgttgttattatatagtagaattatgaggataatattatagctgcccccagtagtgccactacagtaaagggtctgtgagactttccattagaaaccctgttttgggggtcagggtggaaggagcctcgtttcagctgtttcccagcccattcgtctcacacttggcacacagacaactgttcaccatgcagcagactgaagaactcagcagtttctccctaactacccaaaaaggaatccatagggttagatctccagacatatcccactccccaaaacagcctcactaaaaatacaagagcctgtcactcttcagaccaatcttgtgttgaccaactataggagagaggcaacttttaaaataaaactctttgcactattttaaatgagatggtaaactgtagctcctcctttcctcaaattcaataagatcacctcttacgctcaaattacttagtaggctggttgagctcttagttaacagctttcctttttcatatgggggctggatatgttttggctattgagaaaacactctctttagtgttgtttgtgtatccatgtagattattgcagtattatctgctgctttgagataaaagatattgtttgagcataagaaatctatttcttattcacattaacactgaatttttctgttcagttgaattcatttaaaacattattatatgcttcctctgtagtaacattttctagaatgaaacattgatataatttcatagccacattttgccactttaaaaaaaaagccaatagatttgagtcctatagaccacttctattaatttgatatcgtttaaggaatgaaaaaattgtgataaaataaaaattaatatttttgtataacgaggatagtctaaaatatttttagagccctttgtactagacacaaagaaagtaaaactcatggttcttgttgactaatttagacttaaatggtagatatctcatgtgtatgtggaagcttaaaattatttgaagcatagcctgaaacttgtaagtgtacctaataaaaatagaacaaaaagcctactttaatagaaacactgcaaagccaaggagtcagaatagaatagtttgaagaaggcttcttagaagatgtattttgttctggaggcttccaggagtgtgaaaagctgagaaagagaggaacaggcttcaggtggtgaaaaaaggctatataaaaaggcaaaatgtttaaaaacaagcagcaggttacatgagggaactacaaggaggccagctggttatagaaaaataagaactggtgagagtatgagaaaaaaaggagtaagtaatttaaaggagcagaaacaaaaattcagagttttcaagattcagaaattcagataaccatcattctgtgaactgttagacagtgcagaaactgaatattcctataaataacatccagttatattgagtcatctcttaggcagaaagaatggagaagatgagaaattctagatacttctgagagttaaactattatttgctactttgaaattaaattaattgaatcagccattaagaggagggtcaggattcactgtttgcttaataataatttgaactccttcctaaagaggttttcatttattaccaaagtgtgagaaaggagaaaatctggtagaaaaaaaagttcagagaccattttctagctgagtatttgcaatgaaacagtatctttagaagtcacagttgtatatctcaattatcgcacccccttgttttgtaattatgtttatttgtgctctttgttccgacattctagcatctgttcatgggttttctttttctcttcccaagcatcaacctaaggacagcttaattaagagtccagagtacaagtcagatctcttctattcaagagtcaagtttttgttttttttctctaaaactaaatacttatggaacatttactgtgtatcaagctctgctaggcattttcacataaatttatcacatttatttggcacagtgcctctgtgagaaatgcattattagccccttttatagatgacaaaagtaagcctgataaattgccttgccttaagttttaaagctgggattcaaattcgagtcttatgacatcaaatatagaactcttttccttacatcttcctcacttggggaatgtgactgccattctgcgtatatcatagtacatgtaggtcacttggccagttttattttgtcctgaagttattaaggatattcattaggaatttttaaatgccagtgcctttctaggatagactctaaattatgttgtggggccgcttgcatgcaagccgatgttcaagatttgctgttattaaataatgtctagaccctgtacatatctgttttgtgtaattatcaatcctcatcttttttttcagatttggcattattcagaaacaaagtatattaagactctaaatgcttagctacactactggaattatgacttagctaaatttataagaagtaaagtggagttgatcagcagatttgatggtctgtttaaagagtctgtgcttttctgtagaaagaggtctgaacgagacattttagctaatgaatcaaaatcagatatgtggtcattattgcctgattattactccatctgctctgcgctaacgtgaaaatcaattactgtgtctctttcccactgacagcgtatgttgatcgggctggcaagagatcttcgagggattgcctttgcactgaacacaaagaccagctacaccatgctgtttgactggatgtatccttattacactgtgacaataccagctctgtgcacagagggatgccaggcccctcgctttcgtttaatagtatggcacagtagggaagaggaaacaaagctaaatgaactaatgtgtaatcagctaaaaattacagcacagtggcagcagagcagataactgagcacagtatttggagacccagctcagagaagtcacttttttggtgccgttaaatattgataacttaaaaatgacttcccccaaatgattgtttatgttggagttgaagggataatctggctaacatctttagggatcaatgaatcctaccatttgacatttttgaggggagatttgaatctccatctcaattagcaaggctgggaagatcattttatctcttcaaggcctaacccatcatgccacagtttttcattatcatgaagataatgaatggacatggaaagggaaaaataaataagtcaaggtttgtcatttggtgtaaaatttgaattgacctttgccaagggttagtacagacaggaaaaaaaaaaaaaaccccccacagaaatgccttatcatgtaagagttaaaagagcatagactttggtgatagacagacccggcttaaaatcccagctcttcatttactgtgttgtgaaccttggcaagtcatttcacctgtctgagtcttggttttctcatttgaaaacagatacaattcagtatcatggtatattgtaaccattaaaataggtaaagtgtactctgtataatgtctggcacatttttggtagttgtaaatggtcgttaatattgttctaatagtgttgtatgacttatgtttgatcccagcaggaagtgatattgtatgcaagtcatctaagtgttatataatgctttcatgtcttttatgcatgaaaccatcagagcatgtgaaaaaaattatataatctgaaagctagtttactttttaatctaaactatttctcagttactttttttaaaccctccttatccaaagtttcctgtaaattaaattgcaatagaaacttcttaaaggtaactgtcaactactatgccacagttatggccaaaaatataactaataggggatctaggcatgttttagggagaactctacatattataaaaatttttaaacattaatttgatactgacatatctttaattattattaaaatatacttcatcagatttatgtacccagagaagggttacagataaaatttttatgtcattgagtaatcatgcacatggtttttatctacatataatatgtacagagattatgaaatttcaacatggaaagtcttaaaattctcttaacagtgacagttaaactggaattatatatgacccttttatttctgccttttttttaatttttaagatacggggtcttgtatgttgctcaggctggactcaaactcctgggctcaagcgatcctcccacctcagcctcctgactagctgggactgtggtgctacaggtgtgctccactgcacccagcttgactcttttatttctctaaacataaagagcaactctcaaaatcaaaattttcattatttgaaaaataataaaagtctactttgggcactgtaatatcgatggtgatcttgaaaccagtctacaactctaggctatctagtgattaacatttcatgtttttctcttcaacagtttcaaccaagagtcaaggtcagaaaccttcccctcagtgtcaaagaagaactatctgccgtaattgatactgcccaaaatttagagaagatactgtattgttttccatttccttatttagctcctttgggggtagcgggggaacctttctgaaatgaaacttttgtccagcagatggcagaaaatagcaaacggaaaatcttgggacttaatgttttcttgtgaactagaaacctttgtctcctccatttgaccatagatgttgaagttatcagggtcaggggcggagagaagtgtcagttatgccagaagctgtgttagattgccaaatggggtggtttggtactggcgttgcttataataattgagtttcagtagcaaatcagcttccttgggaaaaggccaagggcttttcataattgtattgacaacaaaatgaatatgataaatggtgttcattcagttgagacaagatttatagttttcctttgggcgagggatgaagagcaaatatttataataatagtaaaatttgtttaaaagttatattatttgataattcaaaaagctttattaaaatattttgaaatactttaagcagtttcaggtgataaagtacagattcttttcaaagtattcaagtaatgcaaaaatgaataagtatgataaaaaaatgccatggatatgaaagtcatttatttttcctgaaatattgatatgtcaaaccgtcagtgatgatttccacattactgctggggaaagtttatttgccttttatccacataaatgtgtgttctttaatttgttatacaatccttagcatgcagaagaaacatcctgtaagagcacatgtcatcttaaagtcaaaatgcattttatttatggcgattatttgataaaatgctattttagtggttagctatttaattcaaaaacatttctataaacactgactgcattaactgccacacaaactacattgcttttcactctgtccttccaaaactaaattgcctgaaactacacagcaaccatcttgataaatggtttccagggctggagaattgaaggaagatcattgacatacttctttgcccctatgatgggaatgcaacaataagaaaacaccttagcttgcagtgcatctgatctccttgtttaaaattttcctagatcatacttaaactgaagtatcaaaaatccagagggaagttgggaaaaaaattaagaatttgtatgacattatttcctcatatgcagtcttttaactgttaaaatctgatcattgaactcactgatttttaatcaggaagtcagtgctgttatacagtggcaaggcaagataacaagatacatagaggagcacaaactttggaataggacagtcctagattccagtcctggattcaccacttaaactgtgggtcttgagtaagctacttaatatcccagaatcacaatttcgctttccataaaacaagactaataaaacctatctcacaggtatgttgtaagaagtgtcatgattctgtgattatgtaaagggcccagtacagtggctgacataaagtaaatactctacagctgttgttagttctgttccctgatacataatgagacaaaggaatcccatttgctcacttattcagcaaagtgggctaagggctgtgctaggttcatgaggagtatagatactaccccaaacaaagtcagtttcttatttacataaattactataatcaaatatagaaagtgctaagaaccataacaaagatacaaacaggacagtgagtgcatttagctggggaatcaggaagggctctctggaaaggtgaaggtgtttccttgggtcttaaccaaataagtaggattggaccatatggaaataggaagaaatacaggttttcggttggcctaggcatcaggtttagggagtcagtagtgaagatgttttgttacatataccactcatttcatggttggaaatgtagtttgtttgggactcttgaatatcagtctaaggaatttagacccttattccataggtagtataaagaaactaatggttttgattgactaagaaaatcagaattgttttcaagaagaaagtaattggcagtatcattttgggcaaactgaaatagagaagaaagtaaagctgaaaattcactgttcagcaagctatttttttttagttttatttctgtgccagacaaaaggaatgaaagaatgaataaaatgattgctctttagaagcccactctctagttgatcacacatgactaataaacaataaaatgtcagtgcgttataacagagatgcatgcaaagggctatatgagcatgtatgggaaaaagagcagtgctttttgcaagatatagaaagcttctcaagagaagtgaaagttgagcaaagccttgaaagatggataggcatttgccagacataagaggaaaggcttccagcagcagtccccttgtgaacaaaggtccagatgtttacatattcatggagtacctttaagctctgaactggcaagctatttctattctggaaccacatccccaaacccttgtctcctaacacttttaatgaaaattcttttgccttctggtattaacaactgatgaatagatggacggacggacagacggacggatggatggatggatagatattgtaaagaagcaaacttgatacttttcacattttcatatttggtatcctgtaaggcagtgtcacatcattaatgcctttgatttttaatttatctgatgtggaccttagaaattcatagagaagatctcagtgaaagcaattagatctgtgcttcttctacctaagggctcccattctcttcttcctactcatatgtacatagtcctcacaaggccattggaaaattaaactcctagagtgggttctggttctcaccctgtaattgagcctggcactctcactctgcagcccttttaacctctctattgtgctttccaataatccctcattttctctgtggcagtcacctctgtcagaagcatattagaattggcaccactctcattccacacagaaaaaggagcatccccttatatctccctgccttatcccgtagtgaatactgtgtgctctgaaaaatatcctggtcctaatgccattacaggatgccttgcagaggcctatgtgtgcctctgatattcttaggttctgagatttgggttgaatccattttctcatgagccttccagatgcattcccactaatgagtttgtgctcaggaggtcccttggtggaatattttctcacctgtacccctgtggcattggttcagaatttctgtactcaaagcatccctattatatgttggtcaccctaatttgagcatgtgttccccaagattaaaagctatatcttcctggccgggcatggtggctcatgcttgtaatcccagcactttgggaggccaaggtgggtggatcatgaggtcaagagatcgagaccatcctggccaacatggtgaaaccccgtctctactaaaaatagaaatattagccgggcatggtggtgctcacctgtagtctcagctacttgggaggctgaggcaggaaaatcgcttgaacccaggaggcagaagttgcaatgagccaagattgcgccactgcaccccagcctggcaacagaacaagaccccgtcaaaaaaaaaaaaaaaaaaggctatacctttcttaactctggatccccagcccttagcatagtacatagcacatggtatctacatctatcaaaaataacagcttttctggtccatagaaacaaaacagtaagttgtctgataacagtcaaaataaagttaatcaagtggattgactttatttttgttattttcatccaactgaaaccttattctcacatatacactctcttcttatcccccttccctgccttattttcctttgtagtacttttttttttgagacagagtctcactctgtcactcaggctggagtgcagtggtgcagtcttggctcactgcaacctccgcctcccgggttcaagcaattcttgtgcctcagcctcccaagtagctgggattacaggcgagcgccactatgcctggctaatttttgtgtttttagtagagacagggtttcaccatgttgcccaggctggtctcgaacccttggcctcaagtgatccacccacctcagcctcccaaagtgctaggattataggtgtgagccaccatgcccgactttctttgaagtactttctaatgtgtatttattttgtttactagaatataaattccatgagggcagggttttttttttttttttttttttactggtgtctctggaaagtgtcaaacaatgcttgttatagaataggacttcagaaaatagttgataagaaaactgtttcagtatatacaaatgcagccttaacatggtatgtctgtctaataggagaaagtgttgctttttgcacttttaggaagcataccactcttaaagttatagatgccttattttcattgaacatcatgtgaactgttttctaaagctcccaagtgaaatacacaattaaatagttctaatcaaataagctacacttcatttttaggttgcaagtttatagcaacaagtatgtattgaaatctattttgtgtcaggccatgcattcaataagtacttagtatatgccctcaaaaagcttataataggagagatatacaagtactatgattgtgctagcaccgggttccaccaccatacacaggagacactcctaacccattagggagaggtaggaggcaagtgcatgtgatgtcagagaaggcctcctgggataattgacacctatattgaaatctgacattcaaatagaaattagcaggaagatgatagggtctctgctctttagaaatgcactatctaatggggcagacaaataacacaagcaaccaaccctaacatactgtgttgtaagagagatatggtcatgagtgctcattgaacatagatgaggaagagactgatgcctttggataaaatagagaaaacatcccatgggaggtaaaacttgagctaggtattgaaagacagggatatgttagagagaagaagtggtttataagggaatggagataagagctggcattagtggttttgcagggagttatgaaaagctaaatcatagagcagaaatgctaagagatgaagctggaggtagccaagaaccaaatcttaaaggaccttgaacaccgtgctacggagtttgaaatttattctaagagcaaggaagaaaattgtgatgacctcaccatggagatttctacccggaccacactgaaaagaaacaccattaagtgatttagttgagcattttgatctgaaacaaaagacaagtatgttggaaaacatcggaaagagacttgaggattgggaaaagaaaagagaaattaaggcagtgacatagagtttttctgctacagtttgggaccttaatcctatattcatatgtctacttggcaaggagatacccagtgtaaattaaagggccagtggagctgggtcagttttccaggttctgatggccttcagcatagatttatcagaggcatatactccttagcattaataaggatgttagagaatgtctccttgtgtgtacatgggactatctttagtgacactgatgttgagtagattaatagttactcaaagcttttcgtcaagccaacatcccagatattccttggagctacagtgagaccaaaaagagcaattcaacaatatttttttaaaaagaataatgtaattttgaaactgagagatatgtgaggtttattactagttccttctacttttacatatttattaatttcataataaaaatatttttctaagtagtatagtacccaagaaactgataataataactcaaatatatttttatcctcattcactaaatttattttcctttcctacaacattaggcataaatctttaaatgtactgcttatatgatactttaaaaatgtgtattttatttatacagtattctaagaacaaagtaatataacgtgtaggacatgttacaaataagaacaaattgccagcaaccccaaaaatgtatgtatatctgtgcgggttagggagcgcaatttataaaatgccattgtatagtatagacatagaacaaattagtataaatatagaacaaatgtggattcccttttgtgtgtgtgtatgtgtgtggcactaattttcagaaacagtatttctttagacccttaaattctttaacaggctttataaaaggtacccaacgtaccttccccttcttcagaatgctgttgaacggtggtatggagagccaacatgtacaactcccatcttgaaacttatggcagaacttatgcaaaacaggtaagcagtgtgacaggcagtgagaaaaacagtctactattagcggaaatctccaacagtcagactttcttttttggtttgtgtatttccaaggtagttagcaagagcccaggaaccaagacttaagatgattagtgaaaacagaattagagacatacgattgaggccttttgagagaaaaaagtacagtatacttggctgtctatggggactagggaaatggaaaataaattggaagactgcagccaccattatttaaaaattcaaaggtacgaaatgaagggagggcagctattttaactatttcagtgcttaaatgcaattctatagaattttaaagcaggaaagaagtttagaggtctctgagttgagatgctttatttgatggataaggaaactggttctcacagcaattcaattcatgggaacatagtttgcctcagaagctctgggaattattcctgctttcacttctaagctatacttcttcctttatgccaagatgcatgtatttggatgatttatacactcacagttttcattgagagagcaactataatacttctctgaaattgcccagttgaccttataatttgcatagactggcagaaattcaaatattctccatataaatattaacaaagatgtagctaaaagagaaaatctggcaataagctaattgggcttaaaatatgtcattgtggatatggcttagcaccaaattacatgtcacttagccatcctgtttcatgagttgccctttgtaaactatgtgtttagaagggaggtatccagacagggaagggtatgggttgcagctctaatgttatctctggtgctgagtttttcacagcaataatttaaagtttttaccctaaaacaagagatgaagaaagaccttgcaaataaagaaatgtgtgtatcattttttttaaagcttttcatttttaaaagccactctcataggtgccttaaaggaagggtggctttgtattttatattaaaaatttagtttgctttttaattatatttccatttttttaaccagaaaattaatattatgtattactgatagaacatttaatactaaagggaaaaaatcattgcattgtatattataaagtattttatgtcagccacaggcagatgattttttttttaaatttaagttctgggatacatgtgcagaacatgcaggtttgttacataggtatacatgtgccatggtggtttgctgcacctatcaacccaacccatcacctaggttttaagccccacatgcattaggtatttgtcctaatgctttccatccccttgccccccatcccccgacaggccccggtgtgtgatgttcccctacctgtgtccatgtgatctcattgttcaactaccacttatgagtgagaacatgtggtgtttggttttatgttcctgtgttagtttgctgagaatgatggcttccagcttcatccatgtccctgcaaaggacatgaactcattctttttttatggctgcatagtgttccgtggtgtatatgtgccacattttctttatccagtctatcattgatgggcatttgggttggttccaatcttcgctattgcaaatagtgctgcagtaaacatacatgtgcatgtatgtttacagtagaatgatttataatcctttggtatatacccagtaatgggattgctgggtcaaatgatatttctggttctagatccttgaggaatcaccacactgtcttccacaatggttgaactagtttacactcccaccaacagtgtaaaagcattcctgtttctccacagcctgaccagcatctgttgtttcctgactctttaatgatcgccattctaatgggcatgagatggtatctcattgtggttttgatttgcatttctctaatgactagtgatgatgagcttttttttcacatacttgttggccacataaatatcttcttttgagaagtgtctgtttatatcctgtgcccactttttgatggagttgtttgtttttttcttgtaaatttgtttaagttccttgtagattctggatattagaccattgtcagatgagtagcttgcaaaaattttctcccattctgtaggttgcctgttcactctgatgatagtttcttttgctgtgcagaagctctttagtttgattagatcccgtttgtcaatgttggcttttgttgcaattgcttttggtgttttcatcatgaagtctttgcccatgcctatgtcctgaatggtattgcctaggttttcttctaggatttttatggttttggtttttacgtttaagtcttttatccatcttgagttaatttttgcataaggtgtaaggggtccagtttcagttttcttcatatggctagccagttttcccagcaccatttattaaataggagattttttctccattggttgttattgtcaggtttgtcaaagatcagatggttgtagatgtgtggtgttatttctgaggcctctattctgttccattggtctgtatatctgttttggtaccagtatcatgctattttggttactgtagccttgtagtatagtatgaagccaggtagcatgatccctccagctttgttctttttgctaaggattgtcttggctatacgtgcccttttttggttccatatgaaatttaaagtagttttttctagttctgcgaagaaagatactggtagcttgatgggaatagcatttaatctataatctataaattactttgagcaggatggccattttcatgatactgatttcttcctatccatgaacatcaaatgtttttccatttgtttgtgtcctctcttatttccttgagtactggtttgtagttctccttaaagaggtccttcacatcccttataagttctgttcctaagtattgtattctctttgtagcaattacaaatgggagttcactcatgatttggctctctgcctgtctattgttggtatataggaatgcttgtgatttttgcacattgattttgtatcctgagactttgctgaaattgcttatcagtttaaggagtttttgggctgagacgatgaggttttctaaatatacaatcatgtcatcggcaaacagagacaatttgacttcctgtcttcctatctgaataacctttatttctttctcttgcctgattgccctggtcagaacttccagtacttcattgaataggagtagtaagagaaggcatcgttgtcttgtgctggttttcaaagggaatgcttccagtttttgcccattcagtatgatattggctgtgggtttgtcattaatagctcttattattttgagatatgttccgtcaatacctagtttattgagagtttttagcatggagggatgttgaattttatcgaaggccttttatgcgtctgttgagataatcatgtgactttgttattggttctgtttatgtgatggattatgtttattgatttgcatatgttgaaccagctttgcatcccagggataaagccaacttcatcgtagtggataagctttttaatgtgctgctggattctgtttgccagtattttattgaggattttcacgtcgatgttcatcagggatattggcctgaaattttatttttttgttgtgtctctgccaggttttggtatcaggatgatggtggcctcataaaatgagttaaggaggggtctgtctttttctattgtttggaatagcttcagaaggaatggtaccagctcctctttgtacctctggtagaatttggctgtgaatctgtctgggctttttttggttgataggctattaattactgcctcaatttcagaacttgttattggtcttttcagggatttgacttgctcctggtttagtcttgggaaggtgtatgtatccaggagtttatccatttcttctagattttctagtttatttgtgtagaggtgtttatagtattctctgatggtatttgtatttctgtgggatcagtggtgatatcccctttatcatttttattgcatctatttgattcttcttctttattagtctagctagtggtccatctattttgttaattttttcaaaaaaacagctcctggattcattgatttttcaaagggtttttcatgtatctccttcagttctgctctgatcttagttatttcttgtcttcagctagcttttgaatttgtttgcttttggttttctatttcttttaattgtgatattagggtgtctattttagagctttccagctttctcttgtgggcatttagtgctataaatttcccacctaacactgctttagctgtgtcccagagattctagtacgttgtctctttgttctcattggttttaaggaactaatttttttctgccttaattttgttatttacccagtagtcattcaggagcaggttgttcagtttccatgtagttgtgtggttttgagtgagtctcttaatcctgagttctaatttgattgcactgtggtctgagagacagtttgttatgatttctgttcatttgcatttgctgaggagtgttttacttccaattatgtggtcgattttagaatacatgctttgtgacactgagaagaatgtatattctgtcgatttggggtggagagttctgtagatgtctattaggtttacttggtccagagctgagttcaagtcctaaatctccttgctaattttctgtctcatcaatctgtctaatattgacagtgggctgttgaagtctcccactattagtgtgtgggagtctaaatctctttatatgtctctaagaacttgtttcatgaatctaggtgctcctgtattgggtgctcctgtattgggtgcatgtatatttacgttagctcttcacgttgcattgatccctttagcattatataacgcccttcgttgtcttttttgatctttgtgggtttaaagtctgttttatcagagactagattgccacccttttttttttttcctttccatttgcttggtaagtattcctccatccctttatttcgagcctgtctgtgtttttgcatgtgagatgggtctcctgaatacagcacaccgatgggtcttgactctttatccaagttgccttctgtgtcctttaattggggcattcagctcatttacatttaaggttaatattatgtttcaatttgatcatgtcatcatgatgctagctggttattttgcacattagttgatgcagtttcttcatagtgtcattggtctttgtattttggtgcgtttttgcagtggctggtttttcctttcccatatttagcacttactttaggagctcttgtaaggcagacctggtggtgacaaaatccctcagcatttgcttgtctgtaaaagattttatttcttctttgcttatgaagcttagtttggctggatatgaaattctgggttgagaattcttttctttaagaatgttgaatattggcccccactctcttctggcgtatacagtttctgcagagagatttgccattagtctgatgcacttccctttgtaggtaacctgacctctctctctggctgcccttaacattttttccttcgtttcaaccttggagaatctgacgattatgtgtctcaggttgctcttctcaaggagtgtgttagtggtgttctctgtatttcctgaatttgaatgttggcctgtcttgctaggttggggaagttcttttggataatatcctgaaatgtgttttccaacttggttccattctcctcatcactttcaggtacagcagtcaatggcaggtttggtcttttcacatagtcccatttttcttggaggctttgttctttccttttcattcttttttctccaatcttgtcttcatactttatttcattaagttgatcttcagtctctgatatcctttcttctgcttgatcgatttggctattgatacttgtgtatgcttcacaaagttctcatgctgtgtttttcagctccatcaggtcatttatgttcttctctaaacagattattctagttagcagctcctctaaccttttatcagtgttcatagcttccttgcattgggttagaacatgctcctttagcttggaggagtttgttattacccaccttctgaagcctacttctgtcaattcatcaaactcattctccgtccagttttgtgcccttgctggagaggagctgtgatcatttggaggagaagaggcattctggtttttggaattttcagtgttttttgtgctggtttttcctcatcttcgtgtatttatctaccttcaatctttgaggctgatgacctttaaatggagtttttgtatgggggtcctttatgttgatgttgatgttgttgctttctgtttgttagtttttcttctaacaggcccttctgcaggtctgctgcagtttgctggaggtccactccagatcctgtttgcctgggtatcaccagtggaggctgcagaacagcaaatgttgctgcctaatctttcctctgggaagctttgtctcagaggggcacccggccttatgaggtgtcagtcacccccctactgggaggtgcctcccggttaggctactcgggagtcagagacccacccgccttctgcattggtctcgctgggagctgcagactgtagctgttcctatttggccatcttggtccctccccagatgattctttttttttttttttttttttttttgagacagagtctcaccttgttgcccaggctggagcgcagtggccctatctcgactcattgcaacctccacctcccaggttcaagtgattctcctgcctcagcctcctgaataactgggatacaggcacatgccaccacacctggctaatttttgtgttttcaggagagacagggtttcgccatattggccaggctggtcttgaactcctgacctcaggtgatccacccatctcggcttcccaaagtgctgggattacaaacatgagccaccgcgcctggtccaaatgattcttatctagcacaattgtcctaagaattaccttgtgaaattttgttattttggaaaatgttatcttttctatatttctctagaatttaatgcaaattatgtatatgcatttctttaatcagaacttgtatgccagcaatcatgttcataataatatttctaataggtaatcattgtacttaatactaaagcatttttaaaaagcatggaaaagcaaaaatttgttttattcttggtaaacaggtctttagcaatgtcttgctttttggtagtttttgttttgctaatccttttttcaaaatgccacttcttcttaaaagccaaagcaattgtttaaaaatcaaatatgtcaggaggtcatgttagttctttaccctgttcacacttgcccaaccccagtaggaaccaggaaagtagaattgctactcataggtgaacttatgagatttgtttctctttactgaagttgtatgcagtggaaactgtaatgtgtttgaaatatgcctgaagtgtcaggtaattctttacacatatgtgcagtattttaaaagtaccagatttcctactcatcactttagaatttgttttaaaaatgtgtatcaggcactgtaggaaatctcaaatggaaatatatatcattatccaagtatttgtctaaacttagacacctggggtgttttattattatccatcatccagttggcatgaaagaaggggcaagaaatctgtgataaagaatgtcaggatattgttttgacagataaaaaatgaactctttgaattagcaaataaatgaaaataattcttcttaattgtcctactatctttagagtgaagaaattagcatacgtattttatcaacagttgtttataaaatggagtggaactttaagagacaattgtactgctgctacttcttataaatgaaaatcctaggcattttaaatctgtgtttggtttctttatcttcacatataggcaatttttttctatatttcttagatcccagcgtttgaattttgatgtatcatctcctaatggaattcttctcttcagagaagctagtaaaatggtttgcacttatggtgagtgtccttttccatatgtgcctctgcaatatagttttatctctttagaggaaagaaagatgttagttattttgttcttttgaactttcatatctttatgaatttgtgaagtcggtaatacaagtgcaaaaagccagttagctatcatattggcatcaggagaagtaagcagcatgcctttgactaaatcatgcctgaccaacttgatgaatttcttttggataaaattgcagtgtcagtagatgagggaatacactaggtagaatattgaaaagttacagcatattcaaaattgctcaaagttacatcagggagtttgctatgttgaaccaaggaatgcttaaagcagaatgtcactgaattgtgggaaaatatccttgtaaagagcagtaaatatttcattatgaagaacttttgggtactgcgcctctagaagcagagttctacaggaaagattgtcctattcaattaaagtccaaaatagtatttggttagcagtttgggccttaaaactataataaactctaataattgccaattctgacactgtcatcaatgaaattctctactctctgagacctttatgtagataaggaatggagatgggatggataaaaatcctctgtaatctaatttggcacacagtgactgaatggcaactgagctgggctctgtgcaatgcacttctccttgaggaatgtttccctgtgtcctttttttccctctctgttctttcccaaatctacagcaaactgttaagtaaatttagtctgtaaagttgcctgttattcttttttttttgagacggagtctcactctgacacccagactggacagtgcagtggcacgatctcagagctcactgcaacatccacatcccaggctcaggtgatcctcccacctcagcttcccgagtagctgtggttataggcacgccaccacgcctggctaattgttgtatttttagtagagatggggtttcaccttgttggccaggctggtcttgaactcctgacctcaagtgatccacccacctcagcctcccaaagtaatgggattacaggcatgagccactgcacccagccgtgattctaatatttgggtacccagaaacaaattgtacaaaattttgtaaaatctctttattttaattctgtatgtgtttgtgtatgtatgtaagaacaaccaatagaagccttgtcactttttttaaagtaaaagcctattttaaaaagaaaaaaatgggtgttttaagttgtttttacctcatttcagaacacattctggggatctgagctgtatacattgtaggcctccattaaaaatacttcattttaattgcacatctgatttgtagaatttgagattttttcatgtgtaaaaactagagaaagcacctgtataggacagtaaacttgtactctcttattttcatctgtaccagtaactacattgccacaacttttgtatcctgtttgaaaatagacacattaaaatcatataaagtgggctgggcacagtggtttatgcctgtaatcccagcactttgggaggccagggcgggcggatcacttgaggccaggagttcgagaccatcctggctaacatggtgaaaccccgtctctaccaaaaatacaaaaaattagccaggcgtggtggcgggcacctgtaatcccagctactcaggaggctgaggcaggaggatcgtttgaacccgggaggcagaggttgcagtgagccaatattgcaccattgcactccagcctgggcaacaagagtgaaactctgtctcaaaaaataaaataaaaataaaatcatataaagtggaaatgctttgcctcctagaggtaaaaatgaacccctttaaaaaattttctaaatacaatttgccatactttttgtatatatctaattccattctatgttttatcatataagatgtgtgtctggaccttttttcaaaaacagcatggtatattagaaaaagcacagttttcagatttgcaagatctcagtactaatcctgttaccaatacttaccgacttcatgaccttcagctaaaatactatatatacctctttgtggctagttttcttttgtataaaattaggactactaaatacctactgacttatctgcctagttgggattaagaaggctaattgagctattctggtaaaaggcctggcacaggaggtaacatggaatagttactcgctgtttatgcctctccttccaaagcctttctcttatactcaccaagccagccttctttggacaggggttcaacaacccacatcattgttttgctcagcagtgtttcctgtttggaccacactgccctgcttcctctgcctgtagccagtgattagtttttatttcctctcttatttaaaggaaataaacagcatatatgtataagaatctcttagtaatcagtagaactttaactatgcatatgttagattcctgttaccagtcacagttgtgtcattcctacccctttttctggatctttcttttcactaaatatattttttcctttagggtttatttactgttgcactagggctgttaagggaagtgagcttcctcttccagtgtcactgactttctaggacagaatgtatgtccagtaagtgacaccaaaaggattctcacagaataatgccaaatctatgggcttcaaaggttgttctgttctctgttgggttgtctgacatagaaaaaggcattgcagcaaaagttgagaaaaataactatgtgaggattatgtcggaggaggaggaagaggagacagaagagaaaggaaatgaagggataggagaagtgaagtggagtgggggaagagacaaaacgtccagagcattcttgcaaagaaaagccagtaaggagttttcttacacggaagaaagatgagattagagtaaggctctgctcctcaatttagactaatagtattggtagctttcactttgttataagcttttatagtcctatattagaccatttaccatacattaccctgttgaatcctcaaggtaggtattatatgctactcactagttaatatgaccttggttaagttgtaagcctctcttgcttcagtttcttgttagagaaaatacttcatgcctcaaagacatggttgtgagaattcagttaggtaatgtatggaaagcccttagactagttaacgactgtgattactgttgtgaagaaattgaagctcacagaggttaaaaaaaattgccaaatattacatagctagcaagtagctgaattggaatttcattcagtcatactgacagtggtcttttcatattctttactgcctcttgggagttgccaaagtaagattttaccatggatatttatgatgaagcactgttctttaaagtatggtgatttctatctcaaaacttaaaggaaatcaaagtttcaatgaaaaaaatgtccttcaactgggtcaccagtgactttgacagtgactttgatacatgcactttacatagaataatagaaaaatgtttcttaacctctactgattctcttgctggtccacatcagccatctgatttgtctgtctttaccttctgtaatgttttattacccaggcttttacctctggaaattctaatatacacattggaggaagatcatgtagttgccattcaggagtctagaagatgagggaaagagtgactgggagggcacagaagagccagcactgtttatctctttggtaagcccaggtgaaggaaagggaagccagtggaggaaagaggccagaacattctgtgatcccttctgtttccatcctcactgggttcttctctgatcacctctcctgagcagtttttggttatgatcagggcggtgcagagagggaaggaagcatttccaaatgcaactgacttgttatgtattttgtgaaatacctccgcctcactgctctgtgagactggcagaaaaataatacttttgatatgctgttttatttatctacagtctgtcatgatatactttgatgtaagtttttaattttgcttcagctctcagctcctcttgccgttacagctcagggtcagcaatgaggttagccacagtagcacaaaacaatttcctgtttgtacagcccaggtaacatttggatgaggattaaattttaccacattttctactagcccaagcctattatttctaatgagttttaaattgcttcaagaacatgtatttcaaaacttagtgctacgatccgttcagcctgagcaacttaataaaagaaatttctttcttaaatttttggttaaaatgttgcatgcagtgtaataaatgttattactttggaaacctacttctcagttttaagaactggatgatttttatgttcaatttccatttgtctaatctttccttctctttgcctctgggtcctggtatctttagtgacatctgttggttgaagagtgcacagaagggagaaataatgattgttttcataagactggccaaaatagaactgccttcattctttccttaggtacctgatttaagaacgcaatatataaagattctaaactttaaaaatggatagtacaagctatgattattcactgtcataagaatttacatcaggatccttttaagcagtgtatgctctgggtgtatgtaaggtataacttaatatgcataaattgaatttgtaaagtgttatacaagccactgttattcgtcaccacctagataataggccattggttttcacccttggttttgcagagctgtagaggcctgtgaaagtgccacagcagccctccagaaaaagggggaaagaggaccactttgccaccttgaccagaaccacccagctatgtagttacactagacttgttcgtaaaagctatcacctgttaggactttttttaaaaaagaggctgaaaatcacttgcatgtactattagaagtgttgtaagaatggaagattaagattgtatacaggcatacttctttttgttgtactttgcagatactgtgttttttataaattgaaggtttggagcaaccctgcatggagcaagtatatcagtgccagcatatgatttctttgtgtctctgagtcatattaataaatgtgtattctgactgctctgctttggccattccccatctcttcccttctcctccccactccctattctctgacacagcaatattgaaatcaggccaatgaataaccctacaatggcctacaagtattcaagtgaaagtaagagttgtacatgtctcactttaaatcaaaagctagaaatgattaagcttagcgaagaaggcatgtcaaatgctgagacaggtcaaaagctaggcctcttgcaccaaacagccaagtggtgaatgcaaaggaaaagctcttgaaagaaattaaaaattctacactagcaaacacacaaatgataaaaaagtgaaacaaccttattgctgacatggagaaggttttagtagtctgagatcaaaccagtcataatattcccttaaggcaaagcctaatccagagcaaggctctaactctcttcacttctgtgaaggctaagagaggtgaggaggctacagaagaaaagttggaagctagcagaggttggttcatgaggtttacagaaaaaggccacctccataacatcaaagtgcaaggtgaagcagcaagtgctgatggagaagctgcagcgagttatcatgaagatctagctaagattcattttgatgaaggtggctacactaaacaacatttttcacggagacaaaatgctattggaagaagatgccatctaggactttcacagctagcgaggtgtaaagtcaatgcttggcttcaaaggacagactgagtctcttgttaggggttaatgctgacggtgacttgaagttgaagccaatgctcaatttaccattttgaaaatcctagggcccttaagaattatgctaaatctactctgcatgtgctctagaagtatagcaacaaagactggatgacggcacatctgtttacagcatgctttactgaccactttaagcccactgttgaagcctactgctcagaaaaagatccctttcaaaaggttactgctcactgacagtgcacctcgtcacccaggagctctgatggagatgtacaaggagattaatgttgttttcatgtctgctaacacaacatgcattctgcagcccatggatcaaggagtaattttgactttcaagtcgtattatatcagaaatacattctgtaaggctgtagctgccatagatagtgattcctctgatggatctgggcaaagtaaattgaaagccttccagaaaggattcactattctagatgccatcaagaacatttgtgattcacaggaggaggtgaaaatcaatatttagcgggagtttggaagaagttgattccaaccctcatgggtgactttgaagagttcaagacttcaggggagaaattaactgcagatgtggttgaaacagcaagagacctataattagaagtggagactgaagatgtgactgaactgctgcagtctcatgataaaacttgaatggatgaggagttgcttcttctggatgaccaaagaaagtggtgtcttgagatggaatctacttgtggcaaaaagctttaaaatatgacataaccttagttgataaagtggcagcagagtttgagaggattgactccaatttttaaagaagttctcctgtgggtcaaatgctaacaaacagcattgtatgctacagagaaatcttttgtgaaaggaagtcaattgatgcagcagatttcattgttgtcttattttaagaaattgccacagccacctcaacctttggccactaccctgatcagtcagcagctatcaacatcaagaccagccttccaccaggaaaacgattacaactcactgaaggctcagatgattgctagcaatttttagcaataaaacatttttaattatgatatatacattattattttagaaacaaggttgttgcacacttaacagactacagtacagtgtaaacttttatatgcactgagaaaccagaaaaaaaaaagtgtgactaactttattgggatatttgctttattgtagtggtctggaactgaactcacaatatttccaaagtgtgcctatagttatgtataaatgatacttatgtataaatgattacaagaagatagctaaataattcattggtcttgaaataactagagagttaataaaatatcaccaaaaaataacagttctcgagagaatagattgtccaggaactatggatatggtcttcgatcttgtcagttggttaaggcatataataacaaagtagcagagtaaggttcacagaagtcttgtggacacagtggaatgatcaacaccttgggatcccaaaatcaggatcaggtggcttacaaagcaaggccttcaggatgatagctgaacacatgcttagatttcagtggattccttcatccatgcacctaacatttgttgagcatttacttttttgttgttttttttgtttgtttttttcagtcttgctctgtcgcccaggctggagtgcaatggcacgatcttagctcattgcaacctctgcctcctgggttcaagcaattctcctgcctcagcctcccgagtaactgggattataggtgcccgccaccatgccttgctaatttttgtatttttagtagagatggggtttcaccatgttggccaggctggtctcaaactcctgacctcaagtgatctgcccacctcggcctcccaaagtgccaggattacaggcgtgagccactgcgcctggctgagcatttgctgttaatacgtttctgatgctgtgagagataggaagataaataagatgcaaaaggaaaaaaaaaaaaaaaaaagaatccacctgggcgcagtggctcacacctgtaatcccagcactttgggaggccagggcgagtgggtcacctgaggttgggagttcaagaccagcctgaccaacatggagaaaccccatctctactaaaaatacaaaattagccgggcgtggtggtgcatgcctataaccccagctactcaggaggctgagggaggagaatcgcttgaacccggaaggcaaaggttgcagtgagccgagatcgtgccattgcactccagcctgggcaacaacagcgaaactccgtctcaaaaaaaagaaaaaaaagaatcttatagattcttcccttaaggaacttaagtccagcaggggagtcggacaaatcaagaaagaattatgatgtgttgtgctatgtgttatccttgagaagtatttagagtgccataggagcccagaagagatttctagctgaaactgggggtttagagaaggcaatatttcttgaagggaaaagaataaggctcagaagttttagaagggcatttaaagaagagaatagattttacaaagcacataaatatagaacagcctggttggttaggaaacttaaggaatttcaaaattgctgaagactaaagctaatgttaaggagctttaggcagtgagagacgcccagttagttatgtagtaacttttgggtcaaagtaaagaattacaactttaggctgggcacagtgactcatgcctgtaatcccagcactttggaaggccgaggcgtgtggatcacctgaggtcaggagttcgagaccagcctggccaacatggcgaaaccccatctctactgaaaatacaaaaaattagtcaggtgtggtggcgggcacctgtaatcccagctacctggaaggctgaggcaggagaattgcttgaacctgggaggcagaggttgcagtgagctgagatcgcacctttgcattccagcctgggcgacagagcaagactctgttaaaaaatatatatatatattacaactttatccttaaagatatacattctttaaggaaaatactggatggtatgaccatatttacatttttgagaaaccactttgatagcgttgtggtaggtgaattatttggtgtaaagctagaagagagaggaacagaattaggctttttttggttttgttttgtttttttgttgagacaagatctcactctgtcacccaggctggagtgcagtgtcatgatcataattcactgaaccctcgaagtcctgggctcaggttatcctcctgcctcaacttcctgagtagctgggactacaggcacgtaccaccatgcctggcttttttttttttttttttgtaattttaagtcgagatagggcctcactatgttgcccaggcttttctcaaaactccttacctcaagcaatcctccgcactcagcctcccaaagtccttggatcacaggcttgagccaccacgcctggccagaattgttatttaaattagcatacaatcttagtagacataaaattatgtctacctttcctatctcaacatgattccctcctatatgataatgtgattttacaaaatttatattatcacacaaagaaaagtataccagttcttgggaatttatagaatcttgtgtactgttttgtaccaaatactactctaagactatacgtaggatccttgccatcttcaatatagttttctttttgttaatattcagtctaggacaagacattccccaatacctaattctattgtttgcacatgagatcactcaagaagtggttgcatctgactgagagactagaagtaggttttgctggtagctaccagttaacaattgtgcgtctagttgaaattcctttcaacaaataagaaaaaatacataattatttcaaaataaactctgtaagctttaaatacggggaatttattttttttctttttcggttacttggtatggctccatggaaaagcaagaattataaaaatgtccctaacctttataaactcatttctatttttcttctaatgttggaaatgatctaataatggaaataatctaatgatagaggacagctaactacagctaaagatccttgatgttacattattcataatagtgaaaaatgggaaaacaaacaaaatgctacaaatagcaaaatgcttgaaataacatagaaggatatatcagttcaatggaataaattgcaaccattaaaaattatcttttaagattacctagcttatgggaaatacaaataataccatgtaaaggtagaattcaaatttcacctatgctctaggtaatgttagacttctatatatgtggcaacagttgaaagaaaacagaaacttcaaaatagtttgaaatattgaggttaaaagttaatgtttttaagatttttatatctactaatatgcttataaaataacctatacaaaatcttttattcaaaaaaggtagtgaatcatacttaaatttgtaattaaattattggacaacattactcttgagagttcagaaacaaaattacatcagtgctgaaattccatcttctatgtcagcaacttatgctgtaaagttaaggaaggtatggaaccaccataagcatacagcctggggtccacttgtactaccatgtctttttctatcatgtttttctgtacctatcactttctttctcatcttttttcatgcaaaataatttcttttcttttttttcttttctctaactataaaataatatacccatgggggggaaaaatccagcaatgttatttcaaaataaattctgtaagctttaaattttccatttttcacttggtacaggaaaagaaaacccccccattcatcacccaaagttaaccattattaacagtttagtgtatgtgcccttctatgctttttatgtgtacatatacacatattttcccaaaagtgatatcataatatacttgctagtctgtaatttgttggtttttatttatattatggtcattgttctatgttaacatatataaatctacctcatctttttaaatagctgcaaaatattccattttatagtcatactataatttattaatcgcctttagctgaacatctgcttttccattatcatacatagtgcttcagtcaataactttgtacattcagctttgtgagtttcagtcattcattcaacaaatgtgtaataagaacagcagttgctgttccaggttctttggatacctcagtgggcaaaccaaaaaagaaattaactagtaattagaaggtagactgggcgcagctgctcatgcctgtagtcctagcactttgggaggctgatgcaggattgcttgagcccaggagtttgagactaacctgggcatcactgtgagaccccgtctctataaaaaaaattagaaaagtaaaagaaggtaataagtgctattaaaaaagaaagaaagaaaatagattaggataagggggcatctaagtcccagagagtgaaacaacagaaactcttaattcactgctggtagaatgcagaatggcgcagccactttagaagacagtttggcagcttcttatgaaactaaacacagtcattgtacgatccagtaatcatgccccttggtatttatccaaaggcatcgaaaacttacggtcacacaaaaacatgcacactgatacttatagcagctttattctcaattgctaaaactgattttttcaataggtgagtggataaataaacaacagtacacccagacaatggaatgttattcagcactaaaaaaaaataaataaagctagaaaactacaaaaagatatgtaggaactgcaatcctcttactgagtgaaagaagccaatctgaaaagccttacatactgtataatcccaactacgtgacattctggaaaagggaaaactatgaagacagtaaaagctcagtggctgccagtggttaggggacagtgaaggatgaataggcagagcagaggatttggaggcattgaaactctgtgtgatactataatggtggatgcatattcattatacatttgtccaaacccataaaaggtacaccaccaacagtgaacgctgatgtaaactatgacattgactgataatgatatgtcaatataggtccagattgtaacaaatgcaccactctagtgggggatgttgatagtagggaagctgtgcatgtgtgggggcaggagatgtatggtaatcgctgtacctctctctcagctttgctgtgatccttaaactccttattgtaaaaaaaaaaaaaaaatacacacacacatcttaagtaccagggatttagggacatgttgcattattagagtggtcaaggtaggtctcattgaaaatatgacatttgagtaaagacttccagtaaatgagggagttagtcacgtggattccttgaagaccagtctaggctgaggaaacagcaagtggtagagtcttaaggcgggagtgtatctagcttgtctgaagggcagcaaggaggtcagtagctgaagcagattgaacaaaagggagagtagtaacaagaacagtatcatataaggcctgtagcccactaacatcactttgactttaactctaaataaaatagagggcctctagaacatattgagcacaggaatgacatgacctgacctaagtttttaaaaaattactcacgctgctatattaaggatagactatagaggattaaagttataagcagggaagtcagataggacaatattgcagtaattcaggcaaagtttgatactggctttgaacaaagtaatagcagtgggagtggtcagattctggatatattatgaaagtaagacaaatcaaatttcttgattcattgggcaaatggtaggacagaaaaaatgtagtcaagagatttgagcacaagcaactagaaagaagtagttgccatcaactgagatggagaaggctaagatgggtgtgggggaccaaagttcccttttggttatgttgaatttgagatgtccattaatacccaagtagagatgttgaatgccaatatggatttttgattctggagtttggaaaataggtctagggagtcctttgactcatagatgatatttaaagcgcagaactaggtaagaactaggaatgagtgtgcatgcttcagcacacctactacaactaggggtgagtgtaaatatagaggaagacttaggtttgagctctggtgcactccaatgttggaaggtaagaaagaaggaactggcaaagaagagtgagaaggagcaaacactgaagaaaatcgagagaatgtgtcttggaagacgaggtagtcacctatgacctatcgaaagctgccagtcaatcaagtaagatgaaggctaagagtcagccattacatttagcaaccagaagtcactagtaaccttgaaaagagcactttgagtggagcgggcataaaagagaatgagaagagaagaaatggaaacaatgaattgagcaatatctagcaggggaagtaaggccaagagaagtttttgcatgtgtcttttttttttttttttcatggaagagacagtagtgtgacttgtatgctgatgagaatgagccaatagcaaacaaacaaacaaacaagattgcatatagagaagggcaaaaattgttggtgccttgtctttaagcacataagagagaggagatgggaactagttggacatgttgagggattgacttttactaaagacagtatatgtgagtgcaaatgctagtagaaaggtataaatggtagggaatattagtattagaaaatagaaattgatgtacacacacacacacatatattttttcaagatggggtctcactctcatccaggctggagtgcagtggtgtgatcatggctcactgcagcttcagcctcctgggctcaagtgatcctcccacctcggcctcccaagtagctgggactgatgatgcatgccactacacctggctaattttttgtagagatggaattttgccatgttgcccaggctgatctcaagctactggactcaagtgatccatccgcttcagcctcccaaagtgctgggattacagatgcaagccatttcacccagcctttttaaaatatttttaataagtgtcaccaaattgccttctagaatagttatactaattttatattcccaacaattttttatttttctaaatccttatcaacactgcattgtgttatcttttttaatctgaaagggaaatattatattccctccagtctttgcagcttcaattctgtcccacaccatttatgtccagagaccttgctggtttgcagagagacaagagtgggttgagtggcctgaagtaaaggaatgtcagcaagttgcagttctcttcgcataactgctccttccaatgataagtgaagacattcagcctgtacagttgtcagctagctatcaaattcactttaaaattttagagattaaaagagaaaaagaaaaggtaaatcaatgtgattgattgctttgtaagccaagaaataacattgtttatactgttagtttctcctggtataagatactacggtggtatatcttatcccttgcatcacttttctaagtattttgaggcgtagcaaattggtggaatgggaagcaaatagcaaaactgtaatcccctgcagctaattctctattgaagaaacacaagaggctgtcaaatgatagagtattgaccttactttgaattgtgtaaatgaaaaggactagagggaagtgacattattttataccgcacacactcagcttcacctcctcctctttttgaggctatagttcctccaaatgtgaacttacaggaaaaaaaaaactgagccccaagtactgtgtattgtcatagtttacatttatagagcactgtgccagctactttacatatgctgtctcctttactccacgtaagagccttgtgaattataggtgttattatcctcattttgtagatgaggaaactgtgaagtacacaagttaataatctgctcagatacctagatagtaaggaaagatctaggattcaggccaggtcagtatgagtcaaaagcccacactgtaaatcagtaccttctgtactatatgtttatcttctgttacaatattatcttattatgtagttctccagctgaggcctgtgaaagaaagccattcttctttgggtaatgggagtctcttctgaagaggaagacatcctggagtcagtcactcagcaaaaaggatgggtctcaggagaaaaaataattttaaaaaaatacacctgagagtcggtcgcagatgagcaggagatgtgacatcttcctatgtgtatccctctttaaaagtacatcttgcaagttgtctagaagggtacttctgagtgttggaagctaataacaacaacaaagtcctctccatgaaggacagagagtggaggtgaagaaggagaaccccaagcagttctcttaagctattaatgaggaaaatatttctaataagccaaattatgtagatcaggaattatctgtgctcatttcctagttgttttccctcattatttaatgagatttcttatactgctacagcaagtacaagagtaagaatgggaattccatagtacttgtgcctccattccccgttattgcctttggccaggttaatcattcaattcacagtattcttttcccctgagccccaacatagcctcagcatctatcttacccagcttacggatgttacagtatctttttcccctccccaaattatggcaaatgtactcagtgggaaacaattagagtttttccttttagttctagcctttgaaagtctgttttatttcagtaaagtatgatttatttgtgtgctgctacagtagtaccaaagtagcagctgttactggttttagtagctgctaacctggcaatgccatcatctcctagctgtccatcagtgcaatgtagatctccctcttaggaaggaaatgctgacaaggaaggaatagaactttctaggtgtggagtggagcagggaggacaaggagggatatcatacctagagaggaagatcaaaagcaaacctaagccctgtcacttttgtttatactaatgtgagtctaactcctagattttcagctttttgagggcaggatcaacaatttcagtaagtattgctgaataatacatattgaataaagctgcattccagtaaataaatggataacatggccaagccttcttttccatggtcttttattatcgccatggaatgctgaggcacttgagcaaaatgaggtagtttcctatttcagaagtattcatcattctgttgcaaggtcaaaatagtatattaattactgtcttaacccatttatgcctagtcttccattattaagacgctaagcttgtgggagttatttgtatcctactgctcaaggtcatcaccaaggtctgatttttcacacaaaaaaatttgcaaccttcggcataaatgggttaatacagatgtatctgacatagtccaaaaggcaggacatatatgccaaattgcaatattaacatagagataacagttatgattctaaatatttcttgatgatagattatgcagtcctttacagattttttttcccaatcaggcagttcttggcctgcctatttcatctgttgctacagaatataggacctttcctttccctctaaggatatcaacataaaaaggccccaaaagttttctcacttttaccctggccttcccaacaaacacaaaaccagtgaaaattaccaaaattaccctagctcttttcatcacatgggtatacagtgctgttctttcttgggaaggggaaggagggaaaatgtctaaccttggtttaaattgaatttgaggcaaaggtagaaaaacagtggtgtagaactgttcttttctgaagtacctggctttcttagaccttcatgcctttgcacttcatctacccagagtacactcctctgtttacaagtccatgtggcaacttcaattatccttcaaacttagcctgttctgtgaagcctttccccctgccctcctgccaaaggaaagttagtctctttttctgttcacataacatcttgacatacctctctgatggcatttgtcacattgtatggaattatttatttacagatcgatttcccccaacggactgaactccctcagggcagagattttattttattcatttgtttatactaacacctcacacatagtagctgttaaataaatgctgtcatattgagttgaatctttatgcaactattgttatctctctaaggtaagttacattgagatcatgaaagagggtacagaatttggtattgagtaaattaccagatatgcttcagccttctagacagtggttttgtcattcagatatataaattataagcaaagttatatggacttctaaggctacacagaagagaatatgcatatggaaatgctccacatacatggaacagatcaaggcagatcaagaagagggaacctttaccctgtgctggtcctgtgtttcatgctctgctagaagtattggtccttcttaacctcttagtacacatgtgattaccataatatatatatgtcagtcaagcttcaaaccaggaaaaacaagcatgataatacttttggaatggataacttattttagaaattagaccttatacaatcttaggcaaagatggggaaatagggccaaagtggggagttggaggttcaggggaaaaatatcactgatcagccctcctgaaataatggcatagacaagttggaatttgcagggaaatctagaaaccaggcacatttaggtgctagagtggaactatgaaaggattaggggtgagaaggtagctggtgttatggtatagaagtcagtagaaggctgttgcgtctgcatagctattgcttctgtaagtgtgctaccacctgtttggtggtgggcttggagatattggtcagcagggctggtagttctagacacaaacaggacaaggaagaacaaggacaaagtgaaaccgagcagcatttctacctgttactcttaccacctctaaccacagcaacctttaaaaagtcatggcagctactccactcccagcatccaaatctcacacaaatgtctcttttggccaattctagcccacaaccataaagggaagtggattctaagaaacttaattcttgttagctaagttgacacagtgtaagccactatattatacttctaaattttgtaaattgaatttagtttcaattttagaagcaatactcatttgaccaggaaaaagcagaggtaagaaacatatattactttatatttttttaaaacattatcaagtattgcctagtaacatacttactagcacacatttcagaaacagaaatcattgattgtaaatgctaactgtactacagaagattttagggtgatcatacaaacatttctttgtcttctgatggtcaacgcagaatttaagtacaatttttaaaacaatcatctcttgagatcttctgaagaaggatctaagaagaaaaaggaagtaatatttactgtacactgcaccaagaacttctgtgtgtgttatttcattgaattcgtataccaaacctgtgaggctcctaaaaatgaagtaactcaagatcaaattcatataaaaggtcaaaaatttgccgagaatttagggtaatttacatctcagtcaggttatctttttctcttgacttagttttatcctactttttaaaattttttactgacaggataacacatagagtaaaatgaatagtcttaagagtacaacttaatgaaattttacatatctatgtatacatctgtgtaatcaccatgcagataaaaatatagagcttttccaatataaggatattgatttttccttgggccttttgtacttccaggtaaactgccatatgtatttatattttttattacaatgaataaaaaaaaattcttaaaaatatgctgggaggaagtgaacattagcagtaaagtaaaaatgttaaatagtgtgtcccataactactttgaatgacatctacttatgtcactttctgcttttatcctgaaacaggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctagtaagcaatcatgcatcatgggagtgtttgtatgaaatgtgaagtaacaccaccacaggcctggaagtgttataatgaagcccagggagttagcctagaacattttatgttttaagacagcatacttgatctaacttacagaatttggaaaactatagtggcttttttttttttttagcatctctgcctgattatatagaaaccaatatgtgcccaatgtagtagcagtaattacttgagtaacatagccaaatcatgcttaggcttagttcaggctttcccacctgctcccactcaaggttacaagtaaaatctggaaggcctttgttagtcaacctgtgtaagaaatgcttcttgatctcctagtggactagtgcatcatcttccacctttataaactaatcttggaatggctgcatctcaagccaaagagaggacttccttgtagtagaatggaatgatcattgaaggatatgtctgttagacagaaattacaaagtagaaacttgagtcaaatcagccatatgttaaaatcacctcatcaaagagttacttcactacagttaaagtccaccaagacaactggtatggttccaagaatttttctctaatttttttattctaatagtcaaacaaaccttcaactcagtaattctccaacttgaaggtgcataagactctcttaacgtgtgttaaaaatatacatttcagagcctacactagagcttgtcatttagcgagtctgaagtggggatcaggaaactgcgtttttaacaagcaccccaagtgattcctattgagttggtcttaacatcactttaagaaatgctcctctggtttctctttttttctttttttttttttagaggcagggtcttgctgtgttgcccagcctgttcttagactcctgggcttaagcaattctcctgcctcagcctcccaagtagctggaattaccagcatgaacctccatgcccagcttctctaatttatcttacaagtgtgtttctttgatactggtttggattgcatttgagatttttcaggtatctttctcatgcacttatcttttgcctgtagtgtatggtaaatattaagccctttaccaaattattatttagttagatggattagcattatattaatacaacagactatggtgccaaatcccattataacagcaaatgtctttgtgtttaaaaaaccaacaaaaaaaaggtttcctagcgactgttaagcactgttcagtgttacagtattccaatccagaaaaataattcacacagtcttctaaatatcgtactgcagggattttacttttaagtgctaaccatataaggtaaagagatcaagcgattcctatcagaacccctttaaatgctggattgggactcattatgtcatttgctctatatatttattgaccttgtgtttaaataagtttacaatttccagtattataaatgacaattttcactggactgtaacatgtatttttcttctctgtggcttgacatttagtatatctctgtgttgtagcaataccggaaactgagccagtcttattatccactcctggaatgtctcactcaggaccatatgagcttcatcatcaacttagagcctcctgtactcatgtatgttctcacatctatctcagagggactcactactcttggtaaggatcatagaggacattgtttccataggaaaaacttgattatgggcttttaatgtatgtgattattgagactatcatcctacaaagggggaaaagatattgtgaacccaaactgaaagattataattattacttgcaagtgggaaaaatgtatttcttcatattttgatacatagtcagttatgttttaatcagctttactgaggtataatttacatacaataaaattcagtgactttaagtggatagttcagtgagtccttgtacaaatgtgtacatgtacacaaacataaccaccacgaccaatatgtagcacatttttatcaccacaaaaagctcctttttttcctccttctaatcaatcccttccccctacctctcaccccaggaaactaatgctttctctcacaatagttttcttttccagaattacattcaagtggaattgtataatatgaagttatttgcatctggcttctttcatttagcatagtgactttgagattcattcatgttattttgaaaatcaattagtttattcctttctattgctgagtattattccattgtatgtattattagtttgtttattcaccagctgatggacatttgggttactttcattatttgactattttgaatacagctattatgaacattcctatacaagtatttatgtaggtaaattttttttatttctcttgggtacatacctagaagtgggatttctaggttatatgctaagtgtatttttaacattataagaaactaacaaactgtttcccagagtgacagtgacagcattttgctgtcaccaacagtatatgaggattccagttgctctgtatactcactaacattattaacatctttttcatcttagccatgatagtgggtgtgaagtagaatcttcaagttgactaatcttttcttctgtgatacctaatattctattaatactgtatttggggctgggcgcggtggctcagcctgtaatcccagcactttgggaggctgaggcgggtggatcacctgagatcaggagttcaagaccagcctggccaacatggtgaagccccatctctattaaaaatacaaaaaaaaattagccaggcatgatggtgggcgcatataatcccaactactcaggaggctgaggcaggagaatcacatgcacccagatgcacccaggaggcagaggttgcagtgagccgagactgcaccattgcactcagcctgggcaacaagaatgaaattctgtctcaaaaaaaatattaaaagattttagctgggcacggtggctcatgcctgtaattctagcatttggggaggccaaggcaggtggatcacctgaggtcaggagttcaagcctaggttggccaacatggtgaaaccctgtctctactgaaaatacaaaaaattagccaggtgtggtggtgtgcgcctgtagtcccagctactcgggaggccaaggcaggagaatcactgaggatgcaataagccaagatcgcaccactgcactccagcctgggcaacgaacgaaactccatctcaaaaacaaaaaaaggaactgtatttgttttcattttagacattatatttttattctctagaattattttttatttatttatttatttttagacagagtctgactctgttgcccaggctggagtgcagtgatgcaatctcatcttactgcaacctccacctcccaggttcaagcaattattgtgcctcagcctcccaagtagctgagattacaggcttgcgccatcatacccagctaatttttatatttttagtagagatagggttttgccatgttggccaggctggtcttgaactcctgacctcaagcgatacacccacctcggcctcccaaatcactgggattacaagcatgaacccccatgcctggacttcaatattttaatattgaatttttaaatattttccattttcccctcatcaggtttatgtttttttaacattgatcatatgtataagatttataataggccaggcgcggtggctcacgcctgtaatcccagcactttgggaggccgagctgggcggatcacgaggtcaggagattgagaccatcctggctaacacagtgaaaccccgtctgtactaaaaatacaaaaacaaaattagccgggcttggtagcgggcacctgtagtcccagctacccaggaggctgaagcaggagaatggcgtgcacctgggaggcggagcttgcagtgagtcaagatcatgccactgcactccagcctgggcaacagagcaagactctgtctccaaaaaaaaaagatttttaatagctgttttaaggtccttgtctactgatgtgatttctggatctgttcctatggatttttctccttatgggtcatgtttttttcattcttaatataacttgttatttttgaatgtgtgccagacatcatgaattttacatgttgaattttatttctgtgctagattttggtttttattttttggagacagagcttcgctcttgttgcccaggctggagtgcaacagcacaatctcagcccactgcaacctccgtctcccgggttcaagtgtttctcctgcctcagcctcctgagtagctgggattacaggcatgcaccaccacacccagctaattttgtttttttagtagagacggggtttctccatgttggtcaggctggtctcgaactcccgaccttggatgatcctcttgcctcagcctcccaaagtgctgggattataggcatgagccactgcacccagccaattttgatttttttaatgtggattttattctatcctgcagttgaataacttttggatcagtttgactcatttgagatcggatggcaactcttattttggagtaactgggccccaccactaaagtgttaaccttatgacattccagtgctccatgtgttatgaagttcctccacaaatgacttccagcttgtaatcttcaggaattatttggcctattgcttttcagtggttctttacccagccttgggagtttcttctcatactttttttttttttttttttgagatggagtctcgctccatcgcccaggctggagtgcagtggcatgatctcggctcactgcaacctccgcctcctgggttcaaacaattcttctacctcagcctcccaagtacctgggattacaggcatgtgccaccacgcctagctaatttttttgtatttttagtagagacagggtttcaccttgttggtcaggctggtctcaaactcctgacctcaagtgatccacccacctcagcctccgaaagtgctgggattacaggtgtgagccaccgcacccggccttttctcatacttttataagtcactgttcagacaaacactggagaggactcccttggagagctgtagaactctcttacgtaggtcccacactctggtactctgtactacaagttttagctgctttagccttcccagatttcaaccttttattctccaactcagtgagcctgtttggctttgtttgggttttccctttactagcctgcaatctggaaactgctctgggcagtaaacttgagcaattgttttcctcctctctggtttaatgatcctgtactgcttgttgtacaataattgaaaaccattgtttcgtataatttgtcctgttttctagttgtttggcaggagggcaaattctcatagcagttaattcttcatggaataagaagaaattctgtcttctattattacagtttggctggacattcttttatcttacatcatagtaatacttgaagattttgaattagtttcagttagctatgttattttcaacatgtgatcttgttaagacttagaatctgcattttaacagactttcaagggcatcttgacaaagtggcattacgaagggaatactgaacttggatttaagtcccagcactaccacttactacttgtgtgaccatgggcacatgtggtgtgcctgctgctgtcataggtgtttcatgtggatacttgactctcttcattctcagaaccatttgtataccaaaagcaggttaggtactctaagagcactctttattcttatattctacttggttgtaagcttctgaagggcagaaacagtgtcttactcactatttccagctcctagcattatagtaagtgttcgataaatatttactgaatgcattaattagataatattattttcattatacagatgaggtaagctgtggctcagagaggtgaaacaatttgcctaagatcataaaactaataagtgaatgacctaggaatcattcaaactctaaaaccccttcttcctcaccacactaccctgctagatctacctgataaaggtcacagctttgacagctagaggcctggtagagattattttctttgtacatattggtggtttatcttcagcctcttgtattgttgcagattcacattgtaaccactggataactctagcaggtgaatttgggccctgtgtcatcaagaaaggggactatttagaatgttgaaagtaactacttgaatttttcctttcccaacaatgatatattttaaaaagaggaatttattggtattgtttggactacaggcaggtttaatttctattgttgccttgatggaaaaaataaggaggtacagaaaagttgaatcagtgatagagtgatgacttgccgaatattccaaaaatgatacaaaaaattttagttaatttcattcattagcatttttaatttcatgctatctttttaatcatccatccattctctgcccaccccaacccgcaactcttatgcacagacaccaagcacagtgtcttcaaaaagctgctcttactaatggctctgaactccttcattcagtaattatcagttgtgcatatactatgtaccaagtacctttctaaaccttggcagtactgaagggaacaagacagataagattcctgcccacatgaaagcttgcattctagtgggaagagataagcaataattgaacaaacaaatacacatgccaaaaaaatcaaatcattatatgcgctaaacaaagaattaaaatggggtggtggaaaaagaataagtcaagatggctgactgaagacatcagacatctgccctctcccaaaagaagaaccaaaattatgaatagataatcttatacctcgaatagaacatctagaagagaagactagagtcctataaagaactcacaggaaggctgggcgcgttggctaacgcctgtaatctcagcactttgggaggcagaggcgggcagatcacgaggtcaggagattgagaccatcctggctaacacggtgaaacctcgtctctactaaaaatacaaaaaaattagctgggcgtggtggcgggcgcctgtagtcccagctactcgggagactgaggcaggagaatggcatgaacccgggaggtggagcttgcagtgagccgagatcatgccactgcactccagcctgggcaacagagcgagactccatctcaaaaaaaaaaaaaaaaagaactcacaggaaacatttaaggcacagaaagagaaggaagcaagcagccagctcggccaagattggccagaaagcccagaggggctcagtattgcagagaaaagggtaaatgagagaacttaggcagtccacgtgcctgccacagactactgcaatctaaaccacatgaaagcttttctacccttatgaactcaacattaacatgagcagtgatttgaagaccctgtaaaggcattgcaccagccagggaactggtgctgggtcactcacccttccagacctgaaaaggtgcagcagggtaccatttgaagagtgcagccatcacaggactgcatctgcccctggaaaccacagcccttgtatctccacatcctgagaattcctgctgacattccccagtgtccacccagagagctgcactcacccagcctgcaccactcaagacccaaagggtcatcctaccactgctacttccatcacccatgccacgtgggccacccaaggaccctagaatctgctcgcccacccagcccaccgctgctactaccagcatatgtgcaagccacctggaggcccaagaatcagcttgcccataactgccaacacaagtgccagcctatactaccctggggcacaaagacaggcacgttcatcccaccattgccaccactgggcctgaagactgagacctgcctggtttcccagctcccagcacaaaatttgccacagcttccactaataactgcaccctaaccctccaagaaagttacagaaagcactaatgctacttacaaccaaagaaataatactacactactatactactgcatacatccacaatcaaagccaaagtgccctacccaaccaataccacagatacttcttcaggaaaaatgcctcccctatgaaagtaaattcaaaaacaagaaaaagtgactgttaaactggatgtacagatatcaacataaggccacaggaaacatgaaaacaagaaaatatgacacctcccaaggaacacagtaattctccagcaatagatcttactcaaaaagaaattttcaaaatcccagataaagaattcaaaatactgattttaaagcagctcagtgtgttataagagaaatctgaaaaacaatacaaatacaattcaggatatgaatgggaacattaccaaagagatttaaataaataaataaatagaaattctggaactgaagaattcattgagggaaatacaaaatacatttgaaagcttcaatagttggctagatcaggcagaagaaagaatctcagaacttgaagacaggactttttcaaataatccagtcagacaaaaaaaatttgaaagaaaaagaatgaaccaagccttcatgacatatgaaacaacataaagtgattgaatattcaaattgccagcatccatgagaacagagacaaaggattagaaagcccatttacagaaataatagatgaaaatttcccatttattacaagaaatgtagacattcacatacaggaaactcagtgatccctaggaagatacaatgcagaagggtcttttccatggtacattatagtcagaatatctatagtaaaacttaaagagcaaatccttaaaactgcaaaagaaaagcatctagttacctataaaaggaaccccatcaggctaacagtggatttctcaggagaagctttacaggccagaagacaatggaatgatacattcaaagtacagaaagaaaaactggccaagaatactacatccagtaaaattaacctttgtaaatgaaggagatataaagtctttccaagagaagcaaatgctaagggaatttgtttgttaccactagactgcagccacaagaaatgctcaagggagtcctaaacctgaaaacaaaggatgacatttaccatcatgaaaacacacaagagtttaaaattcactagtaaagcaatcacacaaagagaagaaaggactaaaatggtaccacgacagaaattcaccaaaccacaattagtaagagaaaaagatgggaaaaaagaatatgtaaaacaaccagaaaacaattaacaatatgacaggaacaaaccttcacatatcagtaatagccttgaacataaatggatttaaattatccagttaaaaagatatagaatggctgaactgatttaaaaaaaaaatttgatccaactatatactgcttacaagaaactcaccttggcagtaaacacatatagagtgaaagtaaagagaaggaaaaagataatccacacaaacaaaaaacaaaagcgaacaggaatagctacccttgtatcagataaaaccgactttatatcaagaaaaggggaaaaaagacaaagaaggtcattatataatgataaagggatcaatccagcaagagactatagcagttctaaatatgtatgtacccaacactggaacacctggattcctaaaatgactaaatttgaagagacacactacaatataataatagtggaggacttcaacatgccactgtcagcattaaacagatcatctagacaggaagtcaacaaagacactttgcatttaaactggactttagaccacatggaattaacagagctacagaatctactcaactacagaatatacattcttttcatcggaacatggaacattctctaggatagaccatatgttaagccacaaaacaggtctcaacaaaaattttttttagagacagggtctcactctgtcacccaggctggagcacagtggcgtggtcatggctcagtgcagccttgtgttcccaagctcaagcaattctcctgccttagcctcccaagtagctgggactacaggcatgtgccaccatgcccagcttttttttttagagacaggtttttgctatgttgtccaggctggtctcaaactcctgggctcaagcaatctgctcaccttggcctcctaaagtgctggaattacaggcatgagccaccgcacctggcccaacaaatttttaaaaattgaaatcatatcaggtatcttctcagaccacagtggaataaaaccagaaatcaataccaagaggaacttggaaactatacaaataaatggaaattaaagaacacgctcccggataatcattgggtcaatgtaaaattatagtggaaaaaaaaaaaaaaaacttcttgaaacaaatgagaatggaaacacaacataccaaaacctgtgggatatagtaaaagcagtgctaagaaggaagtttataggcttgagcgccggtggcgacgaaggcagtggcggcccagcgggctcagtgtgtgggtccgtggcggctcggggtccacccgcgggctgcggtgcgagcaggtggccccgttcccctcctcccgcgcccgcccccgcctctgtgattgggtggaagatggtgctggccggatgtaaatcctaatgacagtctccaaattcgcttccatctgtaccatgagtgccaatgcttcggcattagagaaggagattggtccagaacagtttccagtgaatgagcactattttggattagtcagttttgggaatacctgctactgcaattcagttcttcaagcactttatttttgtcgtccatttcgggaaacagttcttgcatagaagagtcaacctaggaaaaaggagagccttcttacatgcttagcagatctcttccatagcatagccactcagaagaaaaagttggagtaatacctcccaagaagttcatcacaagattacagaaagaagatgagctttttgacaactacatgcaacaagatcccccatgaattcttaaattacctactaaatacaattgctgatattttacaagaagagagaaagcaagaaaaacaaaatggccgcttacctaatggtaatattaataatgaaaataataacagcaccccagacccaatgcgggttcatgagatttttcagggaacattaactaatgaaaccagatgtcttacttgtgaaactatgagcagcaaagatgaagattttttagacctgtctgttgacgtggaacaaaatacatcaattactcactgcttaagggctttcagcaacacagaaaccctatgcagtgagtacaagtattactgtgaagagtgtcgcagcaaacaggaagcacacaaacggaggaaagtttaaaaactgcccatgattctagctccacacctgaagagatttaaatataaggatcaacttcatcgatttacaaaactctcttaccaggtagtttttcctttaaaacttagtctatttaacacttcaggtgatgccaccaatccagacagaatgtacagccttgttgctgttgtggttcactgtggaagacttatttgtagacttgcttcatatgaaagtgtggagggtgtgtgcagcctcattgtcagcattggtcccagtcgaggccattgtattgtaatagttaagagtcatgatttttggttgttgtttgatgacgacattgtagaaaaaatagatgcacaagctattgaagaagtctacgggctgacatcagatatctcaaagaactctgagtctggttacatccttttctatcagtctcgggattgagggggaaccgtgatgaagagatactttctgccgcatttcttctctggttattttggaaaggatcaagcactgatttttcaagaaaagagaaaatgcaggaagctctgggggcagtagcacactttgcacacgataaagcaaagacgatggattgacaagcccttccgatcacagtagttgatttatttgctcaggtatcatgctgtctgtacagttccattcaacaaggaggtgaaatcagagataccagttcctcttgtaaaacagccttccagtattaacatgcattttctctttattaattgcaccaataatgccatgaattccttgggggtgcagtagaaagaatcggaatctgtgctgtactgataaggagatgatgttgaacacactgcataaatttgcctggttcagtatgtatagaagcatattcagtggtcttttcaagagtaaaccagaaacacttttgggcccaacacttgcagttgccttcctgatgtaaaaactaacatgctagataatccagtgtcaggaagacaaagatgttttggttctctgaagaagcttataataatacatgtagggagcaattggtcaaaagtggctttttgtttccccaaggggaaagactggctttgtaatcataattttttccttatttattttacttaaaactggtagagtctaagtattgtatgaagtgcccatgattctgtcagtaaatttgagcatatttttattagttaatgtcagtttaagtagtccttttgtttgtttctatttttaaggtgaattttaaattatatctgaaatcagtaagataccttgagaaaaactgcaatgagaggaggtaaatatcctttttcaggaggaactgatatctctggccaaatatttgtccttttattatggtttctaaatcagttattttcttcagctttaatttcataaaattaaaaaactataaaaaatattcctggctaggcgcggtggctcacgcctataatcccaacactttaggaggccgaggcgggtggatcacgaggtcaggagatcgagaccatcctggctaacacggtgaaacccagtctctactaaaaatacaaaaaattagccgggtgtggtggcatgcgcctgtagtcccagctacttgggaggctgaggcaggagaatcactggaacctggggggcggaggttgcagtgagacgagatcatgtcactgaactccagcctgggcaacagagcgagactctgtctcaaaaaaaaaaaaaaaaaattcctgtagttgttggaataattaaaaattctagtgcagtggtggtataccaatctttagaattcttaagtattctaatgttccaagttgaggtcatgcttgggaaaatcatgtcatagcatttatgttattttcagatgtcatttttttaccctggaaagaagtaataatgttcatcataaccctagcagcctggatagtgagctaaacaaaccctttgaagattacattttaatcaagtagactaggaatacaaaaaataagtctttactccccttccacccacctttacaaatcttactggaagggtgttcagaaattaaaatttgtgtttgctaagactttattctgttgggggttttaagaagtaatatatgtacataatatatgtaaaccattgcagtttttttggacacttttccatgcattagtaagttgtctgacagtagccgaatgtaacttgcagaaaattattgaaagttatattcaggataatagcaatcaggcgttggatgttctttattaaactcttttcaggcagtaaatttttaaaaaaatctgtcattttctaaaattcttttgctaaaactgttgactatggaaaaacaaacaacaaaaaggaatgtttttagtctgctgctattattaacatttattatctgtatcttttggctcagtaaatgacttcacctatttcttccataagcagatctttaacagggtcacttaggtaattgggctgcttaaacagatgtgctggaagaaaattataatatttagtatttgtactaaatatcaaaagtattttgacaagtttctctttaagatagtttctaaagccttaccctggctagagatgttttgtacaaattatatatagcctgcctgatctaccaacatgccacagagaatcacagtcaacaatgtggggaaagtcagggcagtggaagtggatgcacactttgtattttgagggcttaaatcaaattgtcttgaaattaaagctgtatttctgcagctttcagtacagagaaaaagaggaaagtgaagctgtgtcagttttaacattagctatatcacaacatgtttaagaaagatagatgaagtcatttgcattaaagtacagcattgaaatactacattgtgtttatttttacatttttgcattaaaaaaaaacatgcagtaaaagccaagttaaatttcatattaaagcaagttctagtatatgtattgagttcctggtagtcacataccttgttcacatctacatcatacttcatagtatgatttgtaaggggagggactgtggggtgacagttttacatttactttttcttcttaatgcagctggatctaagtaaaatgttttgaagtttatcaaaaattcaatatacttttaaaacatatagggtcagggttgggggagaaaatacaggtatagtaagtaagaagtgacctatgaagaaagcgttgtgaggttatatgttggttgactgtgattaaaatgtggggctggtttaagttgtaaatggtggctgattgctgtgtaactatgtacatgattgttaggatggctgtcctatattttgtatattggaataaaaatttctataaattattgtaactaaaaaagtaaatattctaaattaaatcccacttcttaaatcacatggcttctgtcttggaaattttacctttaaaagattatttaagacaggaaccaggaggcttgggaatagggaaaaaaggaaatgttgtattatatgggtcttgtggtaaccatcggtatagggttttttctttccttgatggcagtagaaagaccacattttcataacataactactcttgatactttctttaaaaacactttttatcaaagattctatcatgaggtatttgactgggagctgagaggctaaagcgctcatgtcctggctcttcagtgaatttaactgtgtgaccttgggcaagtcacttaacctctctgtgcttcagtctcactgtcttttaaaatgggagtaatacctaccttacagggttgttgtggggattaattagagataatgtctgtaaagcatttaaggttcttgaagaaggcgctatatagatacaaaataatatctattaaagttggtttatttgtggaaaaaaagaaggaagtttatagcaataaatgctaatatccaaaaaagtggaaagattacaaattaacaatctgacagtgcacctcagggagctagaaaagcaaggaaaaaccaaacccaaaattagcagtagaaaagaaatagtaaggatcagagcagagctaaatgaagtagagactaagaaataaaaaatacaaaggatcaacaaaacaaaaagttggttcttcttcaaaaaggtaaacaaaataggtaaaccactagctagactaaccaagaaaagacccaaataaaaccagaaatgaaaaaggaggtgttacaactgatcacagaaatatgaaagatcatcagagactattatgaacaatgatatgcccaccaactagaaagcctagaaaaaaatggataagttcctggaaacatacaaggttctgagattgaaccaggaagaaatagaagtcctgaacagaccaataacaactagtgagatcaaatcagtaatttaaaaaaaaaaaatcccagcaaaaaaactcaagaccagatggattcaaatccagacgtacaaacatacaaaaccaaatatacaaagaagagctaataccagtcctcctgaaactgttccaaaaaattgaggaggagggaactctccctaacccattctatgaggtcactatcaccctggtaccaatatcagacaaggacacaacaaaaaaactacaggccattatgaacataggtgcagaaatccttaacaaatgctagcaaatcaaatccaacagcatatccgaaagatagtacacgatgatcaattgggatttatcccaggaatgcagcgttaattcagtgtacacaaatcattaaatgtgatacatcacatcaacaaaattaaggacaaaaacccatatcgtcatctgaatagatgcagaaaaaccatttgataaaatccagcatccttcctgacaaaaaccctcaacaaactaggcttagaaggaacatacctcaaagcaataaaggcacgtatgacaaacccacagccaaaatcatactgaatggggaaaagttgaaagcattccctctaagaactaaaacaagacaaggattcccatttccaccactcttattctacacagtacgaaaagtcctagccagagcagtgaggcaagagaagaaataaaaggcatccagatcggaaaagtgaaagtcaaattgtccttctttgctgatgatagatcttatatccagaaaaacctaaaaatttcaaaaaactgagatttgataaataaatgcactaaagttgcaggatagaaaatcattgtacaaaaatcaatagtatttctatataccaataatgatctatccgagaatgaaatcaagtaggcagtgccatttataatagctataaaatacctaggaagccaggcacggtggctcacgcctgtaatcccagcattttgggaggctgaggtgggcggatcacctgaggtcgggagttcaagaccagcctgaccaacatggagaaaccccgcctctactaaaaatacaaaattagccggagatggtggcacatgcctgttaatcccagctactcaggaggctgaggcaggagaatcgcttgaacccaggagacagaggttgcagtgagccgagatcgcttcattgcactccagccttggcaacaagagcaaaactccatctaaaaaaaaaaaatacacacacacacacacacacacacacacacacacacacacacccctaggaatgcatttaaccaagaaggtgaaagatctctacaaggaaaactgcaaaacactgatgaaagaagttgaagatgacacaaataaatggaaaaacatcctatgctcatggatcggaagaatattgttaaaatgtccatattgcccagagtaatgtatagattcagtgtaatccctatcaaaataccatccttcttcacagaatttttttttaaatcctaaaattcatgtggaaccataaaagagcctgaatagccaaagtaatcttgaccaaccagaactcagctgtaggcattgcattacctgacttcaaaatatattacaaggctatagtaaccaaagcaaaatgatattggtatgaaaacagacacataaaccaatggaacagaatagagagcccagaaataaagtcacatacttacagccaaccgatcttcaacaaagctgacaagaatacacaatggggaaaggacagtctctccaataaaatggtgctggaaaaattgggcagccacatgcagaagaatgaaactggacccctatctcaccatgtaaaaaaatcaactcaaaatggattaaagacttaaagcccaaaactgttaaaaaaatactagaagaaaacctagggaaaactcttctgaacattgatctaggcaaaaaaattatgacaaagacctccaaaacacagcaacaaaaacaaaaattagacaaatggggcttaattaaactaaaaactgaatcacaaaagaaataaccaacagagtaaacagacaacctgttgaatgggagagaatatttataaactattcatctaacaggagaccaatatccagaatatataaggaactcaattaataggaaaaaacaaataattccctttaaaactgggcaaatgacatgaatagacatttctcaaaagaagatatacaaacagccaagatgtatgtgaaaaaatgttcaacatcactaatcatcagagaaatgcaaatcaaaaccacagtgagataccatcttacccctgtcagaatggctattattaaaaaggcaaaaaagagcagatgttgtcaaggatgcagagaaaaggaaactcgtacactgttggtgggaatgtaaactaatacagccactatggaaaacagtatggagatttctcaaaaaactaaaaatagaattactgttcaatccagcagtcctactactgggagtatatccaaaagaaaataagatagtatatcacaggactgcctcactcaaatgtttattacatcagtattcacagtagcaaagacatagaatcaatctaagtatcttatcaacagatgaatggataaagaaaatgtggtatacatacacaatggaatactgttcagccataaaaaaagaatgaaataatgtcttctgtagcgacatggatggaactggagaagtgaaataaaccaggcaaagaaagacagataccacatgttctcattcatatgtgggagctcaaaaatttaatcacgtggaggtagagaatggaaagatagataacaagggtcagacatggtggctcacgcccgtaatcccagcactttgggaggctgaggtcagtggatcacttgaggtcaggagtttgagaccagcctggccaacatggtgaaaccccatctctactaaaagtacagaaattaactgggtgtgatggcaggcgcctgtaatcccagctactcaggaggctgcagcaggagaatggcttgaacctgggaggtagaggttgcgacaaaccgagattgcgccactgcactgcaacctgggcaacagagcgagactgtctcaaaaatcaataaataaatataaaataaaaataaaaattaggtcgggcgcagtggctcacacctgtaatcccagcactttggaaggcccaagtgggcagatcacttgaggtcaggagtttgagaccagcctggccaacatactgaaaccctgtctctactaaaaatacaaaaattagccgggcgtggtggcaggcacctgtaatcccagctagtcggggaggctgaggcaggagaatcgcttgaacccgggaggtagaggttgcagtgagccgagatcacgccactgcgctccagcctgggtgacagagtgagactccatctcaaaaaaaaaaaaaaaaaattatctgggcatggtggcacacacacctgtggtggcggctactcaggaggctgaagtaagaatagcttgaacccaggaggcggagattgcagtgagccgagatcactgcacttcaccctgggcaacagagcaagactccgtctcaaaaaaaaaaaaaaaaaagagatagataacagagacgaaaaggtgagtgggggcaagggagaggatgaagagaagtaggttaaaaggtacaaacatggtaagatggaaggaaaaaattgaatgtttgatagcagagtagggtgactatagttaacaaaaaggtattgtagtcaggtgacagaaaccctaagtatcatatattgatcagaaagcattatatacttataacaaaacttcacatgtacactataaatttgtacaaatttaaaaaacaaagtggggtgttggatagagagtgtctaaatgtaggctgatggaggaaggcctctaagattagtcatagcagggatggatgcatttcaagcagaaatgaagggtagcctaaaagcctaaacaaggaaaggtaagagcaagcaaaaagttgaaccaactaggaactactagatcatttcccatgaagttcattattaataaaacgtatataaagaacaaaagaggatatgttgttattttggacacattattgaattggatgtcatgtggtatgaatgtaatatgcgagtgacacatttaggaaatatttagaacttagagattttacacattagcttcaccccccaccccccccaaaaaaaaaaaccaaaagaaaaaaaaaaaaccctaaagagagaagaatgctttggtgtttaatggattgaaacagccaggaaaacaaatgggaagggaaaaccttgtatgtgttgggtgctgtattacagtttttgcccacttaatcttaatgccaaaccttacaaagcaggtaatattaatcacattttacagaggtgcacctgaacctcaagaagtcaagcatctaggaaataatagattcaaacctagactcacctatttccaaaaccactgccccacccaaataggccttttgtctctggaattgcccttcagactatatttttctaagaccttcattctcctttgtgttgtggtgacaagttttgagcttaaggcagatttcggttcagcctcattcttcctgattctcagttaagcaattctttcctatacagttaacttttcagcacagctttcaatgatgggtcttagtgagcagtaggctattaatgatgcatgtgcttcctgtggagactggttccagaagagaagcacttgattgttttcaatgccaaacaacaagttgctacagaggacaaaatgcctattaggcttaaaaattatttccaaaattgcagatgtaatcccttttaaaatattttaaacaccaagaactaggacaaaatatgaaaattcatgacctctgcctgtgttttatgtctggaaaatatcatgatttgaatctcacatagtagcttgagctgcaaataaagaaaaccaatagttaacacatagtcttcagcaccattcattctgtttttgaccaaatgccctgtgatccttatgattccacactttaaaatctaccttgaaaataacatttatctttttcaaagtcctcaaccataaatcaaccataatggaagctcttcttgcttttattgcgaggatatatgctccaatcttcgtggctaaagtgtttacctggctttttcacagctgactcagtagatgggaaccttttaatgcaacctgcatggcatgtggtcaccaaatctatgtgaagtctttataatttttatatgattgatagcatattgcttttcactggtgaggggaaccatatctgcttcctgcttatctttgtagatgtcgagttacataatccatttactttcgtgactgggacttgaaatgtagaaatatgaaggaaaagagaaaagcaaccaggctcaacaagtctgtatttgacttttaggcctagacattttccatttatactatgctacatcccagagttgtaaaaccaaagctcccttttctacaaagtaacccagttaatacggagagatgcagaagaaattaactaattaatcagttattgattaatcaatcaaatgccatgtctttaggagggaaagctctatttttggcttttattatttttaattgacacttgataattttttatatttatggagtaccatgtgatatttgatataggtatacactgtgtaatgaccatttagggtatccatcactgcaaacatttatcatttgtttgtgttgggaacattcaaaatctgctcttttagctactcaaaaatatataacaaattgctcattatagtcaccttattagtgctacagaacactgcaacttattcctcttatctggctatacttttgtatccattaaccaacctttggaaaagctcctttcttaaaagctttgtagttccacagttttccaaaactatggtccacggctgtcttctagacctccattcaacccctcatccctcatgatcctgtattagctaccattttcctctgtgttaaatgcatacgactgtatttcaaaacttgccccaaaacttccctctttctgttttccatgacatttctctctaaaatgataaatgtgagcttttaaactgtagtgttttatcaatgctgggttttactactaaacacaacttaagacttctaagaaaactttctggggttagctttagctactcattctttaattaattctgctgatatttcacctgtaatctacgtcaggcatacatatgtctcagaacctcagagatgaataagatgaatgagaaactactcccttaggaagtttataatctgcttcccaaccctactcttttagtctccttctcctcttctgagtctacctgctcaccattttaactgttgctcttgttaactgtttctcttactaatcataaactcccagggatcatgtgcaaatgttgtcagccaaaaaatgtgggtggtgtcatgctgattcaaaaccatggacttctgataagcaacttaatctctaagcttcagttttctcatttaaaatgcaaattatacttactataccaagtagttgttagaagtaaatgagataataattttagtgtacaaaggagataataaatggttgctctatcacttacttgtcagtaacacctccattaacctttcatattaaatgtaaatgtcgcactccactattggatgccctcaagtaagatcctcaacctgctctgttggccttctcttacatctcctctacacattcactctctgaaaccaaaagttctacttcttgaatatacccttctctttttaccatgaggcaaaccagtagttactgccatgttttgagtgcccattgtgattcaagaaggtgttttagcctgggcatggtagcacacatctataatcccagcactttgggaggctgaggctggcagatcgcttgagctcaggagttcaaggccagcctgagcaacatgcaaaaccctgtctctacaaaaaatacaaaaagtagccaggcatggtagtgcacagctacagtcctagctacttgggaggctgaggtgggaggatcacttgagctcaggaggtcaaggctgcagtgagccaagatcacaccactgcacttcagccttggtgacagagtgagaacctatctcaacaacaacaaaaaggtgtttggtgcttacatatatttttgcttattacctagttttaatgtagtggttaagaatacagatccagaaaaaacaaatgtcgtatgttcccattgataagtgggagctaagctatgaggacgcaaaggcatgagaatgatacagtggactctggggactcaggtagaaggaaggtaggtggggtgaaggataaaagactacacaatgggtagagtgtacactgcttgggtgatgggtgcaccagaatctcagaaactgccactaaggaacttattcatgtaaccaaaaaccacctattccccaaaaattattggaaaaaaaaatacaataaaattttcaaaaagagtacagatccagagttcaactccttgtttattttcataccttggctgtgcagtcttctagctgtgtgacaatggacaagtcacctaagctccctaaaactcagtgtcctcacctgtaaatggagataataacagtaactattatagtgctgtatgagaattaaaaataataacatgtaaagcagttaacacagtaactcatagtaagctcttaataaatgtcagcttttttattaccaatgaacttcttgtcattttcttctcattcaactctgcaaggtcttttataaatggtgaaaaaacgtgaagtagctctttcagatcagcaactcagaaagtaattggcaaagataggacttgaaaccagaactgtctggctccaaaatccatatctttcccaccacactgttgccttgtgctaatccctctacctgaaaagtgtccttccttatgtctaattggaataatcttttgaaaccctatcaggtgctgcctccttcaccaaactctccttgatccccatctaaatgtgatccgtccctcaaaatcctcaatttgtcatttttacacagcattatgctacagtgacttgcacactaaaccatgagttctttgacaccaggatgaggttagaccactgtttcctgtaaaacagagcactttgcactaagtagatacttaataaacagtcacttgaactgaaaagaggttgttaaggtcgcagatggaaaaatctgcctaatctatccaggaattatttatttatgtgtctctaggccaggacctataatagacactgggttcaaagagttatataagacaaattcctggctggatacggtggctcatgcctataatcccagcaccttgggaggccaaggcgggtgaatcacctcaggtcaggagtttgtgatcagcctgaccaacatggagaaaccccatctctactagaaatacaaaaattacccaggtgtggtggcaggcacctgttagctactcaggaggctgaagcaggagaatcgcttgaacccaggaggcagaggttgcagtgagccaagatcacgccattgcactctagcctgggtgacaataatgaaactctgtctcaaaaaaacaaattcctgccctcaaagaacttgcaatttgataaaagcactttgaaaccagaaagtaattatttttaatggagccgttagaaaatcaaatggagcaaaaacttaagtaatgcaaatgaattcttatttactatttgtacagatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcaggtaactggtggttgatcacctggcttaagaaacaagtgttcccagaagccatacctggccccgaatttatcttagagcagctggtcttgccaagactttttatactggtaaaaaatatatatatatattgtctgggagtattttccctgaacgtggagggaaaacacaggccttaggattacccaccctcaagaaatacctgggttgttcatctcacctcagtggagctagaattcaaaaagaggatagtttttccagaggcctgagaaaaattagacaaaaccggaactggaaacagtcagcctctgatttctctcctggtgactctgataatgtcatcttaagtttgccttatgaatactccggtatattgggaaactacaatttgctgggctcctagtgtatgccaggcagcttgctaggaatttctcattcatcatatcatagttgctatttttcccattttaaaatgagaaatcttggttcagataggttaggtaatatgttcaataacatctaactaataagtaataaaaccactatttgtttattttctagtgtatgttctaactagctaatgggttaggtccaagtttaataccattttttaaaaactcacttgtgcaaataatagtaacggcatgcataagaaatgaatattgcaaggtgcagtacctgtagtaccagctgctccagaggcagaggcaggaggattgcttgagcccagaagttcaagaccagcctgggcaacatagcaagaccccatctctaaaaaagaagatttaggccaggcacggtggtcatgcctgtaatcccagcactttgggaggccaaggcaggcagatcaccaggtcaggagttcaagaccagcctgaccaatatggtcaaaccccatctctactaaaaatacaaaaattagccaggcgtggtggtgctcacctgtagtcccagctagtcgggatgctgaggcagaagaatcgtgtgaacctggggaggcagaggttgcagtgagctgagatcacaccactgcactacagcctggatgacagagcaagactccatctcaaaaaaaaagaaaaaagaaaatttaaaaatttttaaaaaaacatacatgccaaaaatatttcaaaaagaacaataccattttttatggctataccatcactatattttcttttcttttttttttttttttttttgagacagggtctcactctgttgcctttgctgtagtgcagtggcacaatctgggctcactgcaacctctgtctctcaaggtctcaagcgatcctcacacttcagcctcttcctgagtagctgggactacaggtgcacaccaccacatccagctaatttttttttttttttttggagagaaggagttttgccacgttgccaggctagtaggctagttttgaactcctgagcacaaacagtcctcccacctcagcctcccaaggtgctgggattacaggtgtgagccactgcacctagccctatcactgtgttttctaattccactaaatttggaaagtatcttcatcctgttttcagttgttttcttttgccaaattacatccataatagtttgtaatttgcaaatgtaaacacatcaatagtgtgttgctatatgaccgttagggagcaaataagttgcctgcaatcatcagaaaatgttggccgggcgcagtgactcacgcctgtaatctcagcacctttgggaggccaaggcaggtggatcatgaggtcaggagttcgagaccagcctggccaatatggcgaaaccctgtctctactaaaaatacaaaaattagctgggcatggtggtgtgtgcctgtattcccagctatgtgggaggctgaggcaggagaattgcttgaacctgggaagcagaggttgcagtgagcgagatcacaccactgcactccagcttggcgacagagctccatctcaaaaaaaaaagaaaaagaaaaagaaaatgtcactctatatcagtaaatgatgaaaatagaatgagacagctatgaaagaaggttccttcctggctgccattttttgctaatatttaaatgaaattatgtaaactttatttgtggtaatgtttcagttaaccaattattttccagggataatggatgtcattcatattttgtgtaactaggcaaagggctgtagacttataattatttggtgtgaccctggaactgttacaacatgttggtaatataaaggaaaaaggaaggtatctcacatttagtgagaacttattatgtgtcaggtgcaagagctattaagattcacgagatataatttctctccttacaaaatttcttgccatgggacaaagagacaagtaactcaccagttatttgatcatttcattaatatagtgatgacaaagaaagtaaaattcaaggggagggagtattgtcaaagagttctcctcatttagaccccacaacaaccctgaaaaatggatatcagcatccccattttacagatgaataaattgaggtacagagagatcaactggaaagtggtagagttggaatttgaagcaaggtctgtttgactgaaaagcgcaagttcttactactcacaccattggtattcaaggtgaggataatatctcagcttcacctggaatggcttttcaaaatatacatgctatcaaaatgtcagcgcgtctctcctccctccccaccccacccaaatgcagtaaccactggtactggtgggagtgtgtcacagccctcatgtgttttgcatgaagaaggttgaggatcactgacttaaagcatgtccacactgaagaaaaaaaaaaaattcatggattggctaggaatcagacccagcctttaccccaccatggcaagggacaagtctgccaccaaatcactccttccagcactcaaccataatcacagtattgtcccataaactttggcagaaacttttaagttggtagaaaattttagcacaaatcaacaggctatggccctagacaaaataccatatcatgttttgcaaaggaagtaatgtggttgggcaggagacaaatcaagtttgtctttactcagaattagcgtgcatttgttggtttaagtaatttctgtgtgttaataatacttgttaatccttcactttatagcatatgactaagtagtgatatatctttattaacagtggaatactttctatttatttggaatgtaggctttcagatagcattttaaatattaatgactgggctctggtagtcagcataaatatgatttgcattagcactaggttatatcatcttgagtgcctctgatgtcagctattaggtatagtaatatctgacatcatctccttaggttactgacaactttgacctctattcttatgcacagtttctgtcgtctcaaaagctcttttgaattgatttgaaattttgactcttccctttatgaggcagtaaaattgataattattcagatgggaacagagtgctgagtgaaaaatcaattccacccgctctctgctgcgtataaaattacttctgagtcggctggactgaacggatggccagagtaaaagcggcaggcaggagtagtgggaagaattagctggacagaactaatagcctgaagggatggacttgaaaaagagggagtgggccagttgggggttattattagcagggatgggtcccattgatcatctgtttacatcagctttccaagaccttataaatcagccctgaagaggagcagaacccaagattcagcctgttaccagtgggattttgtattggattattttcattttcacactcagatgaaaagtgagccattgattattcattggttgcccattaaatgctgtttttaatagatgatttgcctattgcagaaggtaatgaacaaggttgctgctttataacttgaggtttcagttttcaaggcatctgtgtcggttaagtaatgcctaaccctattaaaaggaatggattacaaattgcttaacagtgctgaaaaactagaccctaatgactaattgtgcttggagtttagagagggtttgtcagctctttaaactaaactgatgcaatgatactgcaattatttactagtttgaactgtttttccccccaacctggtcctattttgctggaagcataattgcatgaggaatgttaattccaaattgcaaaagttatctcctcaagcttccgtagtaaaggaagcatgaacccccacataaaggttttccaacatccttacaggcctttccatttgtgtatagcagcctgggaaagatattttatgtgcctcccacctggaattgtgtttattattctcttctatgtggctttagagcttcaaaatttttaaaaatgttctccaaataatccatttttcatattttgcaaacaactctaactttgcaagcattaaaatttagtccatatgaagatccattgtaagtaagtgaatctatttgaagtaaaaacaattgcgtcaccagcgttgctttgacctaacagttgagaaaaacccagtttacagaaatgaaggtggaaaattctccaagcatttttatgttattagaaggataaactaaaaatttaaggagagcccaaccgtaacagtgatcagattactaattactactgattagtagcagataagacactgatctgctacaataattcggaagacaacatttctatgtgaaattttttcagtttcgtcactgatcagtaagtatttgtatctataatacatagttatagatacatagcattcatttcgttatatcacagtgaaagattttgcccaaattaggtaatgaaagggtgtgttttatagaattagaggggcatctcagagatatgagtaattccttataagattattagaataagacactgatcctgaaagcttctctaaatcagaattccagttaaaactaattgctctagaaagagtaacaccttccacagaaattagcaagaactattacgcaattaatttgttaagagtgtatttttagcaattatcgtcttgaaaaccttaatatattgcatagaggaattagagcagttagggttgaattcatcttactcttgtctatttatctattttgctcaaatcaactgtactgaaatccaaaagaaattctaattgtgattttctttctctcccttttctcccttttctccctcctttttatgttatttcttttttttttttttttttttttttttttttgctaacatggcatttaactacaaattgtgaagagctgtcaggagctataaaaatcatacttcagtagggacttaagctgaaagaacattcacccttttcctcaatcagtcagtcagtcaatgaaaattgcttttgtatagtgctcttcatgacatgcatcccaaagtgaattacagcaaaagggaaatcatctgctcttttttcatttctgtgtttagactgaaatgatattgctcaacattttgacatactaaccaagacatctttcatacttaagattccattccataatactgagtaggagaaaatgcagtcgcatatttaactgatgttgagattttggcctacaggaaccttagcaagactattacagtcaaaaacacttaagcagatgaaatacagtcatatctcttgtcctcttaaaaagaatagtcagattttctaatgttaataaagacatttccagtgatccttaaataaaaaatatgctctttatgtaacccattagctctctctggttgatttacaactttattctcaataatacagtagtatattgatatcaaaaacaaactgaaagaacattcacaactggatcaggtaataacggatttaaaaagtttaaaggaagccagggatatgtcattagacactgaaattggaaaataggaactcaaatttcataacagaatttttgcacatggtgctacaatcttggttttaacagcaatcaatgcatatattatgcatatacatagtgggaagaaaaataatattggcaaaatgtaagtgcttctattcacaatagcacatggaatcaacctaaatgcccatcagtggttgatgggatagaaaatgtggtacatatatacaccatggagtactacacagccatcaaaaagaaagagatcatgtcctttgcagcaacatggatggagctggaggctattatcctaagcgaactaacgcagaagcagaaaactaaatacagcatgttctcacttacaagtgggagctaaacattgagtacacatggacatgaagggaacaacagataccggggcctacttgagagtggagagttggaggagggtgaagatcaaacaactacctattgggggtactgtgcttattacctgcgtgacaaagtaatctgtacaccagacccctgtgacatgtggtttacctatataacaaacctgtacatgtaccccgaacctaaaataaaagctttaaaatttagaaatttaagaaataaaatttttcaaatgtaagtgcttactatctgcaagcactagcttaacttacttacatatgcattatctggtttaatcatgacagtatctttgtgaaggtgtagtattatcattaccattttacagatatagaaactgaggcacaaaaaaaaataggaaacattcccaaggtcacaaagtcagtaactggaagaactaaaattttagctgaaatctgtttaactgtggggttcacatgcttaaacacaaagctatctctgttcctttgtttagtggcttctaatctaaagtatgtatgttttgagcacataaaatgaggcaagttgagcttccagtaagtcccactggggccatccttaaggtagaatggtttaaagcagtcattctataccccagcattatactacagccaggacaaaacagatgggcagtgacccaaagaggcagcgggcaagagagaaggaagtggctttgccagttgctgcagaaaaagccctgtggctcccaccaccaccaagacagacctaaccaagcttccactttcttacgctacacccacacccattcattaattttatagccagatgttgaaggtatataatttagtaggacacgtagtcttgagaaggtcagaatctagttgtacatgtcatggtgttataatgccctttgtgacttttctttaatgcctccgaggtagctcttgaggtttaacctgatttttccaggacagaatcaatatggcagctgtgaaatgatgatagggaagcaccacgtgctttgcatctctctcccgtatccagcacatctctcttcattgtcctgactttcaccactgattcatcagcatagaatgccatttttaacctctttctggttgtaaactgcttctgttttctaaaggaaatttctgctgttgagtaccattaactctatcagtggtcattcttaaggtctgaatctacacctgagttcctttgaccctccttctcactttcctacccattataactataccaggtgtcacaaactaagatgcctgtagggccaagaagcagaaaacctgaatgaggtagacatgaaggaatcctcaagttgagtgcacatctctgtctaaagggggcagcctcagcacacctccagctaattgttgccttataagaaggtcagacccagtgttgccagatacattgaaatttctcccttgaaaaacagccagaaattcagattttaaatgtagccactgattgaaaattaaaaaacaaaaaattgaaacatttggcaggccaacactgtatgcctggataccagctttccacttctgtagtatacaatcttaaggaatttcagaactaagatctcccagtgcatgttaccttgtatttctcacagccaacccaaacagcactgctacagtgatatttttatttccatctggttctttttaaacttctgaagcatacttttttggttagttttaaaaggatgtagttattttgattttacttaatctggggctttgggggttatttcttaatttattttgctcttgcttttacttttactatacttgtctactggaacttaaaggggccattttatcacttttgggttacatctttgcacacaaggaatacaataaacaggcgatgaagtgaaactgacctaatacttttcaaactttctttttcttcaaaatagccaggtttgtttgagataaaaataaagtttagtttgatcaagtgtgtgtgtgtgtgtgtgtgtgtgtgtgtgtgtgtgtgcgcgcgcgcgcgcgcgtgcgcaaaatctaactactgaggatcaaaataaaataagaggtctgggactggacaaaagtatctaggtaacaaccaggtaataaaagtccaaaagagagtaaacctcttaagaatgaaaaatttgtgaccattgcctcaagagatccgtttagaaagttaatgcttataatttaaaaatagagaaacactagtttttttaatattaagatgacattttacctatgatgttatgaaagtacttatctatcttttcaagaatgatctagtccagatcctttgttattaaccatatctttgctattttaatttaatttttattatagaaatatttgatgaatgactatttcaatggtaacaaaattggtattttaaaacagaaaaagcaattaaaaaatatatttgttattgatttataagtcatcaaattaacattgtagccataagaatacatatttatagagtgatttttttctccctcagagatcacctacatcctgatacttgtcccagcacctaccagagcctgacacttcatgatagtcaataagtgtttgcaaagtaaacccccaaaatattagttttcagaagtatgatctgcaggcaatgattttaagtatcaaacctagtgtagtcatagactgctacataataaaccaaatggaaatgctaagagaagattatatcataatatactatagaataaccctgctgaacttctacaagaaaattttattctaaacatgggtgaagaaagaaaaaagtacttcaaatattgttccaaatggttaacagaacagagaggaacccccttcccaacccccactaggacatgtgtttttctacctctaagcacagtttaaggatgtaacccattgatagcataacttgccttattaattgaaagggatggaatccaccagatgtacccaaaccagcagagagttgggtgactaagcaacagcaaagacaccatattgagtgagccagaatccagtctccaagtcatttatttcagccagtgacaatacatttaaactcctgtgcctcagcagtgattgatggtttaatatcatatataatttttttaatgaaggaaaaccatttaaatatgttaccatttgcactggtattctcctatgtacataactgcatttaatcattatggggattgtttttatacttgtgtaatttgtatccaagaaataactgtcaaagtcatctcatgctgttgctggaaatggtacagtgtgcttcatacttgaatagattcattcttcctgtacataattaagagtattggagctttcactattaccacataggaattccatgtttacatttcggagaatgaaaaattagccacaatgtgctttttcaggttcccattttctgaggctatgatatttaagcaccttagttttgtgccagtgtatgatttgaagagtttgattttaagacttttaatattaaaatacataataaaattttattgtctaattacaagagggtttagcctcttattaaagttgctaaatcaggcctagattagcattataatggcacagtttgacatggaatactcaaaagtcaagttcgagggagcagagggtttttttgttgttgtttttggggggggaggttcccctacccccacccctcacacaaaataacatggatgaaatgcacgtatggaaacaaacaaggagcaatttggaacgctgaagaaggagtggaggtgtcagtctaggatggtacccttaggcaaggcagctggtatatgtagccttttgtttatctgctactggtttatgtagcctttaggccggcaccagaaacaatcactcctacagggtcagctgctggtcagaagcaaagtaagaaaagattttgcgtccaaacacagcagccgtaatttctgtacagctggcacctgctactggtgcacagcatgaaggtgaaaggtcaaagaggcagttgttcaaaactcaagaatggcttaaagggacttgtagattaatctgctttattaacttctgtatattagataactattgctgtgaatgacagtacatctttttgaataagtcacatctctttctcttttaaattagcttttgagtaatgaatattaaatagaaagcatttcaggggtaattaaatgaaaacagaatgatgtcattttacaattatatttgtatgtttatagaataggggaattataatgttttacaaggagctaaaagaaaaaaagaagccagctctttgtgaagaagaatttggaatacataagccacgtatccatttggctttgtctttaaactaaaaaatatgatgtggtttggaacttagtgtgaagtcattgggtgccagtggcctgatttggtattctcaggggctccaaatgctttccttataaattaaaggggactgtaatctgtcatctctcttttatctacagtttagctattagtctgcaacaaatgttctcaggatagcaaaggagtggtaaaaaaataaacaacagccatacctttttgctcacattcatgtaaagcagatagagaatatttcataagggaagaaaggacagctacacagggttagcccaataataattaggcatgctttataacagtcactcacaagtatggcaaatggcaaccaaaatggtttttaacctcttcattaatagtggttggcataattgctattattttaaatcaagaataaaaagaattcactaaatgtatcttaaaaaaaaaaaaaaaaaaaaaaacctctgcaaggaaaatttctaacccatagattaaatactaaccccaactctgggaagcgttttaacaatatgtattcaaaaggaattgcttttatctgttgacattcagtgatttttggtttgtctttttttttttttcttaagaattctcagaaaaagaagcactgcagagaacatctgtgtctttatgctaacataacacagatagcagcatttatgtctatttcacacatagaagttatttaggatttcacttgcactcccaagttttgatacaagtgcagcctttctactcttattgtttttatgacataagaaaatgacacctaggatcgtctccctgcatcacacgaagctagcctaagacttaccagacagatcctaaatctgtatgactaccacaaaaaggatggctaccttggccagaaaataatgattcagtaatgttttcttaccatactattccaaagaaccttcatacatccttcttgaagacctaagcatttccttcattctgtaacagaagccttatttcctgcagggtttctgggacataagatgtcgctatagaaggaaaacctcaggctcgaacagagaattttaataagaatgattattatgaaaaaaaaaaccactagaatcaattatatgctaggctgtgtgctaagtgccttacgtatacatatatatatgtgtatatatatatatatatatatatatatatatatatatatatatatatatatatttatgtcttacagctctgtgaggtaggtattttatctccattttgtaatcaaaatattgtaattatagctctgagaagttaaaaaactcacccagtatcatacagctaataagtagcagaacctgtgctcttaaccactgtacagtactattaactaactggcctagaaacaggattggcagtgatggaagagtggcaggaagagccatacagcattcttcaatcaagaactgaattgagtcttcagtccttgagcctaggacttctttctttttttttttttttttttttttttttgattttttagaactgattggacaggaggtagacatttgacccaagctggctcagtttgagtcgttcctccctagatttagaaactggcacttaacagatgctggttgccaggcacagtggctcatgcctgtaatctcagcaatttgagaagctgaagctatttaggatttcactaaaagctgaagcaggaggattgcttgaggccaagggttcctgaccagcctgggcaacatagcaagactctgtctctacaaaaaaaattaaattggccgggtgtggtggctcacgcctgtaatctcagcactttgggaggccaaagcgggtggatcatgaggtcaggagttcgagaccagccagaccaacatggtgaaaccccgtctctactaaaaatattcaaaaattagctgggtgtgatggggcatgcctgtaatcccagctacttgggaggctgaggcaggagaattgcttgaacccaggaggcagaggttgcagtgaggcgccattgcactccagcctgagactccatctcaaaaaaaaaatttataaagatgctggtcagccactagtcctcacctaaattgaagacgtgaaaactcaagagccatgaggcagccattccctgccatatgctcagagaaatagccagtcctagaggagagaaaaaagaagcagacatgccgaggatctcaaatgagaggccaagcagccccagagaaagaaaaagactgagaaataccctgccagctgccttgtccatggttccaagcccttgagagacttaactgcactgccttgtctgggggtgaaactaccccttatagacttaagttttatcagagaccactcttgactcgggagagttgtgaggacaaaatgaaccaatgagtatagacttacctaacacaaagaaagtattcgataaacacgtaaaattcgccttcactttgaaaaacgatatgcaggtaccacttttttgtgtccttgaggggaaaatatccctgctatttatactataaatgtgaaaaataccctttcaggagattccaagcccaagacttcttttcaaagataatttgattttgaagccatatcactgagatctttcctggtcccatccctgtgttttgcctttcttaatgttctttctgtgataagcattctcaaaatcacactcactggactgggtgagggcatggtgtggtgtgagtttgaaattcttggccccaaactgacttttttcttacctgttcctcctgcatacttcaggcattgccttgcagtggccaaaatgaaataaatctaatttcttagtccattatgtgctattatagcagaataccgtaattgagtaatatgtaatgaacagaaatgtatttgcctcacagtcttggagactaggaaacccaacgtcaagggtctgcatctggcaagggccttcttgctgtgtcatctaatggaggtgggtggaagggcaagaaagagcaccaggaggccaaactcaacctttttataaagaaccaatcccagaataatggcattaatccaagcatgaaggcagagccctcatgcctaatcacctcttaacgctgttgcattggggattagtttctaacatattctttttgggggacacattcaaaccatagtacctcataattcttcccattcatataatgtcttcatacctaatgtctctgattctcacaataaccctaacagggagataaggccaacacggattttttttttctaactgaggagtctaggtacatcaacaaatttaatcctgcagtgactgtatgagagacctatgcagagattcagagatgtgtgaaagaacttgcccaagtcacacagctaggaaatagtagcatctagattataattaaggcttcttatcactagatctcacacagtttttataataccacactaagttttcgcagggccttaacctactatttctctgtggcatttcttcttaccttttcatccctgtctaagagagacagcagagtaaatgagaaggtttcccctgccttcatttctctgcatggaattgtgagtggtgtgagaagctctttgaatttcttcaaagaatggcacagtataaagtaagagtgggcttaataaatcacatgacttatttattttacagttattactggtttttcacatacttgcaggttagattatgtgattcccaaagtgtagtgtgctgtagtgtgctggaaatgtgaatccaacctttacattcatttctctcttaactcatggaaagttgttttttgggctttttgggggttttgtttttgtttttgtttttaaataggatatcaccttgtcgcccaggctggagtgcagtggcacaatctcagctcactgtgacctctgcctcccaggctcaaacgatcctctcacctcagcctcgcaagtagctgggattacagttgtgcatcaccacacccagctaatttttttgtatttttggtggagacggggtttcaccatagtgcccaggctggtcccaaactcctgagctgaagtgatccacccacctcccaaagtgctgaaattacaggtgtgcaccaccatacctggccttaactcatggaaagtttaaccagcagtagccactgatggagctgtgagtttatatagtgtgttgaggaagactccttgtttgtctgtaatcttatcactatttgaagaacaaggtaaaaagaggttccctcatcctctggcctttcatgaattaatgctgcctcttatgctttgcaacctagaagagttcttgcttattctctgtcccttggcacgcttagaagaatatagactgagtgctttcaaatgactgaaatttcatcctcctttctaagtttttaaattgcaaattctccatatttgttgggactttctattttacagcaatcagggcagacaggttttacagtcggtatacctggttttgaataccagttatactatttgctaactgtatgtccttggaatagttactccacctcttggaggataacaccacctcacccaagggaattctatagcttacctgaactggcctccaggatcagataactgaaccactccctcctgtggtgtcattcccagactttagttaagactcactgtcttagattctctcccagtccatcactccctcagcctagtctgtagtctggaacattggtaccatggaaaaggagaacatttgagtatatgcttcgttgagatcctgtaaacaaaaaatgtcaagtaaactcccaagaaagacagtgatggaaagtgcaaggtctgaagagaaatctcttaggcaccaaggcaacctaccagaaagaaaaccctaaaaaagagctcagtgtgcatgcccatatttaatgtggcttcttattttacatggggcaaacaagttccactaaggtcagggaactaaaagcatcaattagagataagtgcatttagggatctctctgaaccccttaagactggaaggaaacaacttgatgggtgggcagtagaagattaataaatactaaggctacatgagccctgaaggccgcagagaccacacttgatccaattccgtaccaatggtgcttgacacacagtaggaggtcagaaattccttgagcagtgagtaagtgtgagaaatgaagagggaggggaaaagacagaaggaaaagtccctagcacagtaccagacacactgtaggtcctcaataagtatgaagttacatgtgtgcacctagcacataaaaagagctaataatagaatattattgacttgaaatatacacaggtgaaagaaaccttgtagataacgagaggcattcatagtccctcctgaggcttagcctgttttggagactgcaccttaagggcagaagttccacgctaggccatttagtacacttacccctcaagagagtaagccctccctccccaacttcatctttttccttggccccttgcattgcagagagcctgaaaacaaattgacagaaatctggaggaaagaaactcaagtgatttaggagaatggaagggctggcttatcggggcagattaaagaagctaaatatgtatagcttacctaagtgacaactaaatggggcatttgataagtctataaatacttggaagttgtaaatgccaagaaggaaagggaattacttagcatggcacgatggactattggcataatggaataatattaagaaagggaaaatgaaggttgaacatcaataaaaagcttcctgacaaacagaactattcctgacagggtacactattaagttatgtgctataggccaagggaagtaatgtcagtgccatttctcagagtactggcaacagagccagtaagataggacccaagaagtgtcctcttgacgaaggcacaggagccaagcaggaaaccttctgtgtctgtggcttcccaatcctagaaaaggaagaaagctgcatgttgttgttgttgttgttgttgttgttgttgttagatggagttttctgtcgcccaggctggagtgcagtcacatgatctcagctcactgcagcctctgcctccctggttcaagcaattctccagtctcagcctcccaagtagctgggattacaggtgcgcaccaccactccaggctaattttttgtatttttagtagagacggggtttcacgatgttggccaggctggtcttgaactcctgacctcaggtgacccacctgcctcggcctcccaaagtgctgggattacaggcgtgagccaccgcacctggctgaaagctgcatcttcttgggaaaaatcagatggcccagacctcctaaaggctcagaccctgtggagaatggttaaaccagcagttcactaccacatcactgccagaaagatttattcagctttaatggcaccccatttcctgcacacaagatctgcgcccaacctatgtaatcaccctcatctgccaccagtactccccatccaccctttccattcccacagaactgctcctcattcccccagactcctctccaaacctttgcacctgcttgcccttcttcctacctgactgtcaaacttctcttattctcaacaacagatccaaatgtcaccttctctatgaagccatccctggctgcttccagccctaggcagggttagcctcctctggtttctaaaagccccttgtgtaagcttctgtttatggccacttaaactgtatcttctgccattgtttctatactgtgtatctcctcccctactcaactgtaagctctttgagggctgggactgtgacttgttcatctgtatattcccagggtttgacacagagccttgcccaaattaggtggtcagtaaatgtttaaatgaggaatgaggttctattcccaacgctttcagtcactagcattccttgggctatgtaattattagggaaaaagagcttccaaatctcagtagcgtctttgaatcatctccctggcctcttggccagcactttctgtgccattagataactataaataaaaactctcaaatctgaaaattctgcatggtttaaatataaactctaatacttaatggaaaatatttctgaagggtcccatgaattgtccacaagaataattttcccccatatgaaaaatgaaaacattttggatcctttcgtagttcatgagcatgatgattgggtgttcacgtgcatatgtgaaccctaagcagtgtgcatatccatgacagagataactataagcacatgtttgtattattcagtaataaactctaactgaggccattcaaaagaaagagactggggaaacactgtctcttactcacagctctttctccgcatctctgtttttatgtctgactctgtctctgagagtttctgtttcttggtctctctcacagtctctttcttcttggtacattacaatattcattgcactctcctttgatgactgcatgagacgccctcgtgccattatgcttatgctgttctgttgtgaagtacgataataattgggaaatgtttggtgactgtttagtaacgtggagtgctgtttccccgctcccttccttgcttttgaatggcctcagttagagtttactttctcactgaatatttactataaacgtgtgcttgtagccatctctgtgatgcatatgcacgctgcttagggttccattcattgccatagccacctaaacagcagccacctctacactacctgtagcatttctggaacagtctggcatccttctcttcattggaagtcttgactttgaggccatgttctttttatttcattttattttattttattttgtttatttattttggagacagagtttcactcagtcacccaggctggagtgcagtggcatgatcatggctcactgcagccttagcctccaggggtcaagcaatcctcccacctcagcctcctaagtagctaggactacaggcacacaccaccacacctggctaatttttgtatttttttgtaaaggtggagtttcaccatgtttcccaggctggtctcgaactcctgaactcaagcaatctgcccaccttggcctccaaagtgctgggattacagacgtgagccacgcgcccagcctgaggccatgttcctaaagctctgaatttatccacagcttcagtatgtttctaaggttatgcttcttagaagtatttcactgggaagaaaatggggtatgcagtcaaggattctggccatttctgtctgtctctgctaccctacccctcaactcccctcattttgaatttcttgcagtatctaaacttcttaccttgcctctggtacttacccgtaattgctgttctccagaacctaatcagtattgttctaaatggcagacctcatcatgtcaccttctcctggaaaattctttgaaggctacccttcatgtattagcccaaactcgtttctatattcagcatggcataaaagcccttttatagcctggaccaagcccagtcttctactccttgccccttaaatctactccctgccactcaaaaggtctttttcaaaaacctcctgtgcatgggctgttcgttcctcaaacatgccaagctctgtctccagtgtcttttctcattttatttcctcttccaaatatatacttcttcccaggtaatgctatatgcatcttttaagattcaacttaaaatcacctatcctatgaagataggctggtctttttagatagaatcagagcacatgtgcctgtgttagtctctcttaagcttgcacacattgtttgctagttgggggacccccagaggctggtataggccattagaggttctagaacctatgtggtagtcattcaggaagtaccatgaaccaaaaataagtgtcacttgaataaaaattaggggaaagtggctttggagttgaaagttgttcctcaaaaatacagatcttccctcattcctacccagaggaaatttagatggtatttttgacaagtaatccttaatttttacatcaaatcgaaaagtgttctgtttgatattggcaagagtgagagtttcccaaatagtgctgagtggcaaaccctgcagccttccaatgccccaggttttctggttttattttaatgcagcaagctgctttatgagatctgcagccacttgaaatatgatttactactcgtaaaaagtttcaaatggataatgaagattcaggaatgagactcacagtggtgtagtgtagtcaattttgttgctgttgctccacagtacatctctgccattgaaatgaattatttatcataatttatttcaaccatggaaaataaaactgctttcattgtgatgtgtgcagtaacattcagaatagacacattacatgcagtactctcaattaattaatcctgaagtttcattctaactttatcttctttcttacaagctaggagactgacaggtaattctttccccagtaaactgtgattaaaatggatgttttgagaactaggggtaatgttggtaatagagtaaattgaaacagcaaaactaggttgtgtttttccttagatgtaacaatggttggaagagtttcttaatttttgaagcaattaatcactttgagcaaaagcatcccttagctttccgtaaggaggggatggcagagtgggggatgcttttagttgagatgtggaagcatgcagtgctaatatatgaccaaaaccagctgagtttcctggtcctgaggtgcttttgaggtaaaaagcttctttttttaacagcaagactagcattgtgcaaagaacaagttggcagggatccccagtgattccaggggagagcaggtcatctgtaattgattgcagtcttgtttttttaaaagagaggtgcacctcatcctgcatttcatttgacttttttttaatttaaaatgctaaatacttttattataaggctacaaaaacactataagcagttagtaatgttatttttatatatagataattttaaaatttaatgtaacttagatggtagaacttagttaatccaggcaggaaaatataactaattatatgcttatttatccattatgttcatttttcatagcattccactaatatcacataggcgaatagcagacagagagaacaattgatttcttttccctaaagataactattatctaatttgagcaggatcacatttcaatatccgctgtacacatggcctcaggaacagcatttcaaaatgacagaaacccccttacttccacaaaccctgaaaatctggaagctttttctctttcagtagcactcagattttgcctaatcctgggtctccaaccagggcatggggcttaggtgaaattgctgtggagatgggtaggtttctctgctttttcaaatcctactctactgtaagcaatcatgttttttgtttgtttgtttttgttttattgtttttgttggggccagccttccccttctcttttactgaccttctgaaaggccaatgacaagtgccagaaaattcctgagactcagaagcagctcttgaaacttagatgcatttattattggttgttcctcaaaacatgaccaacttactgaatcagaatgaaggacaatctagcttggtcagaagtacagataattttgtatcctattcctcttcccattaaggctgacaaattaagattaacagattggccgggtgcagtggctcacgcctgtaatcccagcactttgggaggccaaggtgggcgagtcacctgaggtcaggagttcaagaccagcctggccaacatggtgaaaccccatgtatactaaaaatagaaaaaaagctgggtgtggtggcccgtgcctatagccccagctgtttgggaggctgaggcaggagaattgcttgaaccccggaggcggaggttgcagcaagccgagatcacaacattgcactccagcctgggtgacaggagcgaaactccatctcaaaaaaaaaaaaaaaatgattaacagattaagttatcctattctatggtgcataccctattgggcacagctctgatcatccttttttttttttgtcctctgccctccccagtccacaccccctatccaggtccagatacagggatgctttgtcattggtctctcaccttttctttggtctgtctttttggtctgtccttccttcgcctaaaccagagccttcttttttgttgttgctgttgttttttgttttttgagatggagtctcactctgtcacgcagactggagtacagtggcatgatctcagctcactgcaacctccacctcctgggttcagccaggctggaccagggttcatatcatcactttagcttcagttttgtctttatggtaccaatggggagcaggagggaatagtctgaatttttttctcctgtttcttagaactttatggaattttttttagttatattattcagtatgcttaacattaacaataaaaagtgttcattttactcaagggaaattggcttaatttactaatgcttcctattttgttaatttaaattgctgtgtacattacttttggtgggaggaaagtcattatttttatcaaaatgttcagtggaccattttccagagacagcctgttaaggctgccattgttcatcatgagagtctgaaaatgttgaccaactctgctataaaagccttaggtgggaggcaggaaggtctgctgagaactctccaggaatcactaccctggattctaaccacaagaatttcagtggtggcctcactcatcagtaggcgccaagggtgtctgaatggaggaggtacacatggaccacatacctaagagattcactgaaggtggaagaatgagccatggccagaaatgagccttttttgtcacaccatcagtcctccagatgtgtaaagtaggtcgtacagcctcagccactatgctggtggtcttggtcctcactcagacaacaagacagtggcagccagcagactggcatgatggacttaggcagacctatgcacatatcccggttcagcttcacatcctggtagctgcagtaccttgaacaagttatttatttgcccagaacctcagatccttagtctataaaacgggaataatatctacttcccatggttagttgagaattagagatgatgtatgcaagtgcccagcagagcactgagcacccagaagatgctccataaatgagggctattattgttgttggatggtgggaatacttgtcaggcacagcctactgttaggtgaaagttcttgtcattagaaatgatggtgccctggcctttgacctttgcaacctgcaagcccctacaaaggcactctctggagctggctataggacagcagtggcatggaagagttctcaggctgtacacacaaaaacaagatccttgcaaatgaacaatgtattaattccagtatgtaaccattttaagttttagtcatagattaagacaagaacttccctgttttctgtacagtgccctttcaactctttagctctttatactttaccttatgatacttcattcatccttttgcatttattcatttatgtatttactctttcagttgctctttcctaaatctctgatgtgtgccagtgcctaaccctaggccctggggatacagtaccacaggagtttgcaatccagtctcctcaccccactgccattgcaatcatcaccctgtactcattcaagttggctttttccattttctcagcctttgctcctatttctccaaccatcctgctctttgataaggtccagccatcagattctagacccactgagccttcaactttcttagaaaaaaatacagttcactctctagcagtaaagcatccaacacaaaccacatctttgtctattctatttcagcaggagacagaacagacggggtttaaattgggcatttcggccaggcacagtggctcactcccagcacttcgggaggctgaggggggaggattgcttgaggccaagaattggagaccagcctgggcaacaaaaagagatctggtctctacaaaaaaatcaaaccattagccaagtatggtggcacctgcctgtagtcccagccacacaggaggctgaggtggagttgcttgagaccaggagttcgaggctgcagtgagccatgatcacaccactgcactccagcatgagcatcagagtaagaccccatctctaaaaatgaacaggctaggtgcagtggctcacgcctgtaatcccagcacctcgggaggccaaggcaggcagatcacttgaggttaggagtttgagaccagccaggccaacatggtgaaaccccatctctactaaaaatacaaaaattagccaggtgtggtggcacatgcctatagtcccagttacttgggaggctgagagagtaggatcacttgagcccaggaggcagaggttgtagtgagctgagagcgtaccactgcactctagccttggtgatagtgacaggtgaaatcctgtctcaataaatagtgagcatttagttaccgccttgccatagagaaagtatgactcgggccagacgcagtggctcatgcctgtaatcccagcactttgggaggcggaggcaggtggatcacgaggtcaggagttcgagaccagcctgaccaacatggtgaaaccctgtctctactaaaaaaatacaaaaattagccgggcgtggtggcacgtgcctgtaatcccagctactcaggaggctgatgcaggagactcacttgaacccgggaggcggaggtgcagtgagctgagattgtgctattgcactccagcctgggcaacagagtaagactccgtctcaaaaaaaaaaaaaagaaagaaagaaaaagaaagtatgacacagcgtatttgggtaggaaagtccaatttgctttatgcttgtgctttacatcccatgttagggtagaagaataagagaagagttggggaatgaacagagatacagatcacacaacattgctttgttttacttttccaggtcagatatttgtagagtaattttgtgttttatttagaattacaggttttcagaacaacagaaacattgtcattcaaaatccttacaaataacatgtgccagatcaaataaggatgctttctgaactgtttcctattttggttgtatatgtgtctgtgttttaccttaaccctcaacaaagttagatagttgtgaagagactataatctcatttatctgtatctaatcaggacatgaattggggcccttcattgagcgatgaaattccactgggctagacctgagagagtagctgcagtagcagtgaaggagcagtagattgaatgcctactatgtggcaagcacagtatcaaatgcttgatatatatcagagaagttattcctcacagcagccctttgaagtagctgttattgtcctccattttatatgtaaagaaagaaaggctcaaataagtgaaatgactcgcccaatgtctcaagttaagtggcagggccagattggggctccattctgattggctccaaagcctggctttaccataccacgttggtttctcttcattgagagaaatttcctaaaactcctgccaaatcctgtgggaagaatggaggagaatgaggaagcagctgaggcggtgtggggcatgcttttcctaagtggaccaagtcatacaactctgcctcagaaatgggccctttcctggtatggcagaatagctgctcagggtaatgcagtagatatcgtatgtgttttcagacataggccctagaaaatgtagcctaggttgggcacatttgtttaattttattttatttagatatagacctccagaagctgggcagatttgaaacagccattccagccatccctgtagcagtattggaagtgagcagaagttgaaggattggagccccagctcacgcagccattccttgtaccaaatactgatggtaccttgtgactcaccgtgggccgggtggtgcagaattgccaagagctgtctccttttagtattcctgtatttgtgtcgttaaccacagaaagcctcccaccagagatttcatatgacctgggaagtgattctgtgcttaagcatttcatccagtattcttccacatgccccttctccagaggaatttgcccccattggttggctgtttcccccataccctactgtaagatattacaaaaaataattctggatatgggttgccatgtcagtaccatttaagctgatttgctcactaattttcgtatttccaaaagaataaaaaagaaaaaaaaatcacccattttagcacagtttatttttagaaaagtgttttattcaaacatatccttacttattacagacataaatacatgcattcagacaaatgaatacacaggagaaccatataaagtaattggcgcatcacttcaagatgctttttcagttactggaggaatttgatgcctctaactttaatcttttccattaaaatatccgttctgccttcagattgtgaagcccataatattttagactgtctagatggatctgttagttttgcttgtcagtttaatttgtggctctatgactttgggtggcttgttagattgtacatggaaactcgtgatctgcaaatgatgttcaacatcccaagcttaagtcctctccccagagagactggacataccataaatatgcaattggcagatttcatttgtaaccagcctaattgatatgatgatgtatagaatggcagacgtttagaacggcaaagaagctcattgctgttactatatcccttaaatgtttatagcactttttactctttgcaatgcattttatgtacactatctcatttgattctcagagcttccttgtgctggattattatttccctccttatagttaatgaaactgagacacagagagaagttcagtaacttgcctgagatcacaggataaattggatttcaaaaaataccagaggacaaaaccaactgtgttccaaacaagccaggccaccaaagcccagtaagggatggtgtgtgcagtggtctttgccacgtaattgccgtttcccctgccctcttttggggaaaggagttctggagctgtgggaacagaagagcttagaggtaggaggtaaagagtccaagaagcagaaactatcatcagctccacatgaatgacagaaacctgtttcacagccacttgcctggactatcgcagcagcctcatccctggtctttctcctttagtttcacctgcacagtacacattctacatgtccccaaagagatctttcttaaatgcaaatcagagcatgtctcatctgtgctgcaaacatatcactagctccccactatcatcaggatgaagtccagattcctcagcagggtcttccagtctggcactggcgtctcacctctggcccacctctcttctctcctgtcatgctaagtttcttaccatggcagaaccctttgtgtgcatccccaccctccttttttgatgccttctttgcttagaacacatttataatgaactctttaaatgttaccttctccgtgcagtcttccctgacttctcctcaaggacccagagtcatccctgcctcctcgcatgcccactgcactttgcccagccctatttcctgttatttctctcctaagtagtctcccccaggaggtttcaaactacttaatgtcagaggttgtggtaaatgcctgtataatcttatctcccctatggatcttacaggctgaatttaagagaacggatgagtaatgtacatgtaggaatgaatgagtgagtgagggaattagtgaacgaagagtgaagagaaacctcgaacagcctaagccagcaggaaacatgatgttccaggatcacatggaatgtgtcccattcccctccctctctccaagaggggccatggagagatttcatctctctataacataacctcttaggtgaaataggaggcagacaggaaggtgagctgagcttttgcctggtgccctagcatagaggaaagcatatcagggttgagaggcagggactgatcatcttggcccagtgacctcttgacttatgcccatctggaatgttctcaccaaggctttcagaggtagaagctcttccacagggagctagctgggggtctttgccaacagtttctacaggcagccttataagcttccagagtctagaccgtttgtccagaaagagctttcatagctgttagcaagatggaggggtggaatctgagcacatgaaaggcctgggattagggggaactctgagacaaggcatctcaatctttatgtgattctatcttctagatgatgtctgtcctcatgaacaccattgtctttgaagactgtcggaaccagtggtcagtatccaggcctctcctggggctcatcctgctcaatgagaaggtgagtgtgattgcaggaagtcacgggaggtggtccctgggagaagagagcagctataagctagggtgagctgtgatgacgaaggacagaggagcagagccaattgaatttgaactgggaccttgcgaactctgtgaggctgtattcccctacaaggcccttccccaaaggcctcagatcttcttcaggtaagcagaggcctcaaaacgagtgcttctggagcccagagcccccactcaccaggtgggtggtttgctcagtagtatttccagcttgccctcactccactcccctgattccaggagaattctgagcaacaaccctttttgccttccttggccaccctttatatctgagatccccactgccctaggtggtgacagcagcagcccatcaggcattcctcacagaaccagcacccttcatctggggagcacacatctccagcttctttggaggactcaccacctgggctacctcccaagcctctccagcttcctcttgaacccacacatctccctagtagtaggaacagtgcattacagcttgggagaatgaattgtctatacaataagatagtactggggaaaaagacagtgagattagaggcaggtgcatgcattaaaattcaaactaaaatcccagccttggaaggaaactaatagaagaagaaaatatatcaaaaagagaagagctgtctcatcattcacctgtgctgaagtatccaattttagccacattcagtagcactgtcattcatcttccctcggtgttattgtgatttaaatccaagctctataaaagagagcagttcttttaaaatgattgagagggaataagggcaaattcagtgtttagaaaaagcttatgacatcacaatattatactttactgatggaggcaatatttcacagtttaggatgaaaaactaataattttctatttggtgtgagtcactgcatcattataaaagggaaaaataagtagttttgtgcattcccaatcttgttcagtaagacattgtggtttaagtataatgcctctgatatatagtatttaagtattagtctgactacatattaattatgtgtgttttttgatgtaagctgttttaatgtatgatggaaattaaatatcatgcttttggggctgggaagaataaatgcatgactggcaaaatgttgtctttgtgctgaaattaggctgtttccaatgattaggagctgtgtttagtatcagaacttgtgtgtgtataaaagcccacagtcctcagcagagaagaaaaggctgtgcaggtgtttgtgagcaggcctgacagacattttccttagtgccacaaagctctccccaaactaaagcacgcccctctagtaccccacctcagaggagtaaacccattctaacccccaaggacagagacttggaaaaaagcccaaagtcatttaaggagtgactcactgaagccaggaaagatgataaggcctgaggaaagacccttggccttgccttcagtcacttaaaatgctccctgggcatttttagttattttcttcagtctgggggcccctcccatttcagtctttctgtggttagtagagatgagagtcaggaaaagcatgcattcagtcccccacagaggaggcaaggacttcatcagcctaagcagtgacactagaacaattacagcaagacattttatggaaggcatcatagaattgataactaggagtgtctctatggcatggattttctctaagggcttaaagttcaaagtggacctagacaaaaactcctctgagcattagtgagccctgagtagatgagagctgctctatccatcccctgccagctgtcttcaggcgggacttggagtcggagctctgacactattctgtctcccatcagtatttcagtgaactgagagcaagtttgataaacagccagcccctccccaagcaggaggtccttgcccagtgcttcagaaacctaatggaaggagtggagcagaacctgtccgtcaagaacagagacaggtgagcattgcccagtagtgtgtcactgggggaagtagacattccaggtttgttgaaaataactctctcgtgcttgacacagctcacacatggatgtcccttttctgttacaccttgtgatcctagactcagttccattccattcagtaaatattgttggttatttgctttcctccaggcgtcatactaggcattatacagggatgcagagattaataaaatgtagtctctgcccttaagcagtttacaattcaacaggagagatatgaaaaaataactgtaattgaaagatcaaaagaaggaaagtgcaaatccactatggaaaatgaagaaagacttcttggcatttgaacaaacataggccttgaggtcagacagacccgagatacagctgagttaggatcctgactatagctaacaataatgtattgtatatttcaaagtagctaaaagagaggatttgaaatgtccccagcatatagaaatgataaatactccaggtgatggataccctaaatcctctgacttgatcattacacattctgtgcatataacaaaatattgcatgtaccccataatgatgtaaaaatattatgtatcaattaaaaaacaaattggctgggcacagtggctcacgcctgtaatctcagcactttgggaagccgaggtgggtggatcacctgaggtcaggagtttgagaccagcctggccaacagggtgaaaccctgtctctactaaaaacacaaaaattagctgggcatggtggcacgtgcctgtagtcccagctactcaggaggctgagctaggagaatcacttgaacctgggaggcagaaattgcagtgagctgagatcacaccactgcactccagcctgggcaacagagtgagactctgtctcaaaaataataaaattaaattaaaattaaaagtttttaaagatattttatatctggcctttttaggttgtgtggcagtaggcagttaacttctctactcctcaggttctttaccagtaaaatggagatgatgataatcagttgtgatgtttaaatgacagaacgcagtgaaacatggcacctgggacctatgacctacagtattagtttctccctctgcctgttctttaagaatggctggtatctcagttgccaatgagatctaaatgaaaggagataggttcaggcttatcagctaggtctgacttcattcattcattcatttagttcacaaaactttattcagaatctactgtgtaggcattggggttaccagtggtaaaccaattatttaaggttcctccccctcatggatcttacattctagtagaaaagacagacagtaatgaatgatggagaaaaagcatgtgttcagggggcgaaaaaaaaggcctgcaccatccttttataaatgtggtagcattcaaatgctgctccatttgaaatgcaaatcatcagtcatcccagtagccacagtgtattctggagttaccagcctgggctttggtaatacatgaccaagtcagttggggtatgcagacatattcccttgactgctcacttcaagatcctctatcacgcagaaagggacaacctcagaagccagcagatgagagttgaatggggaagccctaggtgtctcggtggaaattacttcacctaaggcttggaaatttgtgtactgcgtcctgagctgctctgtgaaatgatggcaggtggccctcgtagtttaatgagagtaataggcagtgaagactgacttttttccgtgtaccaggcactgtgttgagtacttacaggcatacaggcattgcctcaaactgacccaataaattctttttttttttttttttttttttttttgagacagagtctcgctctgtttcccaggctggagtgcagtggcgtgatctcagctcactgcaacctccacctcccagattcaagtgattcttcccacctcagcctcctgagtggctgggattacaggtgcccaccaccacacctggctaattttttatatttttagtagagacggggtttcacaatgttggccaggctggtgtcaaactcctgacgtcaggtgatccacccgccttggcctcacaacgtgctggaattacaggcatgagccaccgcacccagcctaaattctcactttctgcaatcccttgaggtaactactcatattaggtaccaagacaagaggttaagtattcatccaatatcaccggactcataagtggtagagctaggatttgaacccaggtagtctaacccagtgccccctctttttcagctactaaattcagttttctctctgtaaaatgaggatactcatacctacctcagggaagacttgtgatgactaaatgagttgatcagtaaactcaatccaatgcctggcatataaacttttgttcttttttttataatccttactatctatgtgtaatttaacttttctaaaattgttttttaaaagtagaaccacaaaatgtacacctcaagatggtcagagtgaatttagtggcaaccctgttttccaggaagagatgaggggttggcagtactggtggcagaacagcaatggcggtgaaagtggagagaaaggagctcagctgaaatctagagccgtcctccaggagggggctccccaaagtcctgaactccaaaatggccttatcgtccagaaattcatggaggctttgcctcattactacccttgaccctttcttcctctttctgcaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggttctgcagtcaaggttgtcaatttgttggagatgcagccttcaccttggatcctggattgagacgaatgccattggaacctgttaaatgagtagtttgttatgtgtctggaagaagcagcgttagggactttgggctgtgagcatttagaacgagcctggaagcactacagagcatcccacaggaccacacgcaggcctccctgcctcagctgcatctgataaagttgagagacagtaacacaattaaatgacttagaaacaatgtttgcttttcactggcataaatctgaagtggttcagtctagaagaattaagctgtgcaattactgcctgcagagatatttcttcaggaggagtcatgtagccccagtcagaagttctgggtggtgccagcacccagtcctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgacttaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctcatttctcagactcatgtttcttgaaacctttcttgagagttgagttttgcaataggcttgtcatataagagcagagtcatcaagcttatctcaaaatgcttgtcttctgtgtatgaaggaactcaggggaaaatacgttacctatggggttacttctagtatttaatggataaataagcttgggccttacactgtgtttcattagaaatgggaaatataattttccttgagaaggcaaattctgaattctgtaaaaacatcagctgttcagagaagtttgacatgaatttctgtttcttgaaggcttataactgcacactcacctcacagaaatgtgttaaggcaagtttgtcccattctggcactgttttctttacaaatgtctagtatctaaaagcaccatattgtttgcattaaagtgttcaccagaaaatgaccatgggcactcgcttctgcttgccacactgccagaggtcacctggtggtttcatagcagacaagaatggctccatcagagttggccttggagagctagctgttctcagaggaccggtcaggcctgccccactgctgacgtctacaggacctgctagtagagctggcctcgcagagcacactgcaggcagcatgcgtcagctggagaagactcggcagacggttactgaacatctctcttgccctttacatacgtgatctcttccagtcctcacaacagccctctaaagtttagacagcattagctccactttgcagataaggaaaccgaggcccaaagatggtgtctatagcttacatgggtcacacaggcaagatttgaacccagatctgtttcacctcaaaggaattcctggccccttgtaaggaagacctgtatttcagaatggtgagttgaaaccagttaatatttaggtccattatcatctgtttctcagaactctattgttacataacacattaccccaaaacttagtgccttacagcaacatttattaactgacaattcctgtaggtcaggaatttgcagctgggtttcaggctgtctctctctcacaggctgtgatcatctcaaggcttgactgggtaaggctctgcatccagactcactcgtgatggttagcaggagtcagtttctcactggttgttacctcagtttcttcccaaat

SEQ ID NO: 16074 - DNA, 11237 bp, Human; identical to SEQ ID NO: 11913

SEQ ID NO: 16075 - DNA, 34422 bp, Human; identical to SEQ ID NO: 12701

SEQ ID NO: 16076 - DNA, 62072 bp, Human
atgtgcaggttagttacatatgtatacatgtgccatgctggtgtgctgcacccattaactcgtcatttagcattaggtatatctcctaatgctatccctcctccctcccccctccccccaccccacaacagtccccagagtgtgatgtttctattgttctatcttaattctttcctctgttcttaccattatcctcttgatttgattcactgaatttatttccattattgtatttttcatttctaaaatttccatttggttcttttttatatgttctgtttctctgctgagaattctgattactttgctgagactttctatatttttttcatttgcttccaagcatggttgtaattgttggttgaagcactttaatgattacttctttaaaatccttgtcaggcagttctgacatctgtgtcatcttgctgttggcatctgccgataatattttccattccatttgatatcttactggttcttggtctgacaagtgctttgctactgaaacttgggcattttggatattgcattataagactggatcttatttaaattttctgttttagctgacttcctctgacactgctctggcagggaaggcgggcaccatcttattcttcattgacatcagggaggatggagctcctcattactgctggacaggggtgaggattccaactccctactaggcttttactgatactactctagtgcggatagggaagggcacctcattactgctatgtgggggtggagtctaggctcctcatttggcttttgttgatggaatataatgggactgcattttcttctatggtgtttggctggagtagagcagttattgtctaaaagttttctgtcttgctaggttacctctttcctggtcttttggctagaaagagcaggcttttgttggggcttctttgttagtgcccattggcattctgggtttctggcttcttcagctccaagtctggtatatatgaggcagaaacaaaatccagagaactcgccactgcatcattgctcaggtcccaaggtccctaaccagtatacttttttctttccaccttttaatgtcttattatgtttgttttatatataatgcccagaggttttagtgatactcagtgagagaatggggaaaagtacttctccatatttccagaggcagaggtttagacttgagattttagaggctgatgctgtactgccaaggaggtttatgggaagtagagctgtccttatatattaatgtcttagtggagctcttatttcatgtctacatcatgaaaaacaaaaagaaatgaaactttacctgggtttgcatatgtctgcttatctgtcactggaggagtagccatgatcataacctgctcagtcagtttcctttacatcagtgcaccagggtttcatgagccccctttcaatatctgttgctcccttcctgtgtctgtcaggctttgaactgttagctcacttggctgtatcctaacagtgccacagttggtggctgcttcttctatgaaccataaggcttactctagtagagctgaagaggccctaagccatcacctaatttagccaccatgttttcatataaggaaattgcatctcagagaacagaggaagttttcctggatctcactgcatatcacacaaaagcaaatccagacgtaggacccagatatcatacttgtaggcccagtgttattttagtcacatgaagctgctcctccatccacccctctaccttccagtgaactttgttctttcctctggtcaaggactgtcattttatcccagccaactgtctcacaaaaatgcccctcattcttgggggtgggggtgctcaatgagggtggtgggtgggaggaagggaaaaggaatgtggctgactccacacaaacctgtcttcagagtgaaagtctgtgattcacggggtcagtggtctcatcttcatatctgaaagacagtgtactttttgtctccctaagccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcggtcagacaatgggccatggggggaggggggtatttaatgcttctaatcttaaacttgaacgtaagatgtgttattgaaattttctgtgcaaacttggtggcagggatccaactcaaaatataaggaattcaaatgtgatctagaagagatctaggagatgagctgatcccaccccttgtgggtttctagaagagctggaaatatagtctaaggttccatatagcctcccagtctagtagtgatcactgcattgcacccattcaataagaaaaatgaggaaggatgagagagggaagacgagtttactttttctcttaatagaagccagtcagaatggcaagcactagatatattgcatgagcttcctagtatgactgagaacaaaaagctagtgagtaggcacagagaggtcttcccattcaactttctggccctgttgtccttttagaaactcatctgacacacttctactttcctccctgggaactcagacatcatccaagtgttctgaacctcaggattagggattccagtggtagttctaggagcaggatgatgatagaagggactatgagagccattgactagtttaatttgacaataaaagcctgcaacaccaccaatctaccaagattagctctgttagcaggaattgcagcaaacacaatagctgttatctcagggtattagggccacagaggagtggcttgcttaatctctggaattaatagagcagagaggaaatggctcttatagagccgtgggtcggcttccttccttttcatagaactggaagccctgggctctgaggtaatgccatttcacataactagagggcctgtcttctccaattcccagggcaatccactttcagcaagtcagctttcaatttattttaaaattctgatatgtgcacagatgtggatggaggtgattgaaatcttgttttctctttgtttcctcattgtcaaccaccaacaatgtattgagaatgtgctatcaagttgagcatgtagacatttacaaaactgtttactgcactccccagctctcacagagattgcagtcaggtgggatggcagagatggagacattacttggccagcagcctgtccaaattgccaggccttaggcctcttctagaaagaaatctctaacctccatcctaattaccctttatatttcatgcttctcttttatgatcaacaattgagtcagtaaagaaaaacctgataatgctcccagagtccgtgatcagttttagcatgactttaaatttctcttttatttcccacttgtttccattcacttgggccaaattgtagaagaaagtgttgatggattgtggatgcaggggtcctcttccccttctccccaactccatcaacactcttaaaaagtgtggccagtaagtaactgctttggttttgatcagtgtacagttgaatgcacagattccagtgggggttgtccttagaataggtccttggagtggccatctgtgcatttactctggaaaagttgtcattgcttacgtcatttccaggcttggcttctctttgcagatggcctttagagccctttgtaagctttgccaaaaattcacattcattgctttagagtcacactttggatttgatcaagatcagccctctgcctcctctatgccacaccttgttctctgaaagagttctctgttggttctgagtggcttgactctttctaaaacttcaagctgtcctagaagaccaagaattcaccccagttgaggagaacaaagaattttaaaaatttgcctcagcctccaaaagcaactctctcagatggtcttcttcacagttgaaacagcattggatgacattgagagagcccactcctttggctggacgtgacaggtgctgctgtacggtatccctgtagcctcagaaaggtacccagtgctaatatgaaactctgctgcacatgctgaggatctcagcatctgggtgcttgtgaactgaggttgaccaaataaaagcagaatggcctgtgagtccaccaagaaacctgcagtccaaacaagttattgtaaggcctggaaggtgagtggccaaaggaggtcctttgcaagagctgggcttgcatttccagggtgtagccttagctggatctcagatgtttcccttgtttgctctccttctgacacttaataacacccagggatgacaccctgaaccctagtcccaggaaaccatgtgcatctggaagcacgtttcttgcaccactctccctcatcctgaaaacatcgctaacagagatttgcttcaggcattcagcttaactggttctcttgttctttcctagaaaacaaacaaacaaacaaaaaacatgtttcaaatcaatcttgaaataaaatgatatcagtcccagaggagagttctcttttagcagtccttgaatttacatggaaataattgtgagctcccttgaaggaaaacgtgcatctcacgtaacagttgttcttggcctaagactagggctcagaacacctgggttctagtcttgcagctactcctcactagctatggggctttgtctatcctttgccctccctgagaacaaagttcaaatgaacgaaaagtaagaataaccacctttaattcagcattgactaggtgctaggcactttactaagcatttttggggcattatctcctgtaatcctcatgataaccctgggaagaagaagctattattatctccaggaaaccgagactcagagagattaagcaatttgaccaaagtcacagatataagaagtggcaaactcagaggccaatgtcatcaccactatactctaatgcacattgaaaactacaaaatgctgaatacatatcaggcaggggccatcaccataagaaatctcagtaatgcaagtaccttttcagcatctgttcattcatttaatagtgtgactggttaatgactctggcgatctggggaacagaagagtttgaccttttgaacatttgggcatctacccaaggttaataaggcatccagtctctgcacttagtgtatggagttttaacaggaggcagaacattttgtccttccctttgaagttaagatcacgattctttccctagatccctagatcagtaggtcaaaggattgctagtgtgagaatttaaaaggcattagtactccaatttgagagtgctccagagcctgcatggagttgagactcagtgcgcatgtcacatgccatctctgtctcagtccataccccaccataagtggcaaagattcctccagctcggagcaggtacctattcccttcataaggcagctcctagacaaaatgagggtgcaaagggcatgaaatgttcagttggaggaggaaggggacacagtactttttgcacatcttctgtgttcagccatttaatattaagaagcgactcactctatagattacaatgggatgccgtgcccagtatttcttctgagcttcccaaccagtcagtggttgggcagggtggggggattattattattctccttctttatggataaagagaataaagtctgagaaattcagtgactttcagaaggatggccatccagaaggtggggtgctacatcaaggtccacatttggatggccccaagggcagtgtgctttccatctacaatacgatgaaaaacaacccctcagcccatatctttctcacctctaaatgcaagtagggctgaagacgggggagagaggagccctcagtgtaacagcgtatgtggacatttggatggctgcaaaaatactggcctcattctatccatcccttttctttagactggtgaccttagacatatccagtaggaggagctctagtcacctcctccctttgtgtttatgtgacggggttcaagatttgcgcccatcagctttggaggcatatacttcttgcagaaaaagtgctggactcaggaaggagtcctcagactcgattcagggttggaacaagctctttgtgagattttgagcaggtttctttcttcttgaggtcagagggcatgggtatgagctctaagggcctgtctatctctggcctcctgccacatttccagggtcccttctgtgtgcctggccctgtgctcgatcttgagccccaggaattcatagtctaggggcaaattattcccaggcttcctccactgggaacaaatctatcttactctgtagttctcggtgaaacctggaggcaagtgtttgagcgtctctcttgtgcaaggtactttgtgcacattcgctcatttgcttctgtgtcacagagattgatatttccacttccccagggtggagactgaggctcagaaaggatggagactttcccaatgtcacacaggcaggaagttgtagatctcaaactcaggtgccctgcctccaaagctcttcctactcctattcccagattaggagctcaggtatttccagggccttctgcaggccaggcactgttctcagtgcctttcattccagtggcagagacagcccataaacaggtaaagagtagaagcaaacttacttcattctggtagctctctgggatgttctgaccagcgttgtccactgccaagcctggcagaaagctaggctgctttaaaaccctatgcaggggcagccagctgggaacagagtgagttgtcgaaacagctcccttagaagcctcaagagaaaacccagatttacagctttgagtctttgccagcagcccctgcttcatgcaggctgaaggcgcggcacaggtgcaaatctggccccaagagaggggagctcatgtttatgggtccccttccaagacccaggtgatcctaggggctagttaatctagaggcaactgtccctgccacttactgataacttgcatgagcctctgggcctcagtatccacatcagtaaagtagggttaataactctgctctttgcctgcgtcagggtttctgggatggtgatgaacaaggtgtggttgtgcacgtgttccaaaccacacagggcatgatcctaaaccacacactgctgtgagcacttttttttaatgatcagaggttggcattggctcagaggttttttgccatcagaagagtgatggaaaatgtgtgtcctgacccctgaggatgccacagtctcatcagcagccccactacactgaggagacctgaatctgtaatgtagctgtgagcattctgggtcaagggctgcagtgtgtatgcgcctttctactttggggatcctccccatggagcacgcagctgttcgctccctttgctccctcctcctttttctgcagtaagggctccttcctgttccagacacccaactggggtgagaagccaggcagaggccttgccttcacacagacctttttttgcaagaactgagcactgctcagcttgcaggacaccactgggcttggcatctgggtcctgcctgggtagcctggcttggtaaaccagtgacctgcaaatcacagtctgtttgaagggagagtgctggtgaggggagctccatttttcagctggtttatgcaggcacctgggagcatgacactgcctatttctaaacttttaggagcccatgctggcctcatctgcattcctgcctagctctttcccacagtttccttgacataaggcccaaggtaacaggtttctggaggtggaactgccccaggaaggagagggatgctgttagactccaggacagagttgaggctcagaagtgtgcacatttctagggagtatgcagacccaggggccagccctgtgggtgtgggcctggggttcctcaaactctgggctggcctgtgtaggctgaggcctcttgcttttactgagaatccacagctggaaagcccaatgtttctctttttacagatagatatttgggttataagctacccctggagtgctgcattccagacttctggggaggagggacatgagcttctaagatttgggcaacaaattttgatttccgcagttgatatagaataatttgttggaaaccttcctcctccccttttgcttttcctttccctccccttccttcctgcctttcccttctcctcctcatctccctcctaccttctcaccagatctccaacccctaaattccaaagttagaaaggcaagcatcagccacagggaagtggatttgaccactgggcactcaaacccaaggcgcaggcatgtctctgctgtcattgcctccctctctcttgctccgggccccctcagcacaggcctgtctttgtctgcctccctccagtgctgcaggcttccatcaccctctcaagtccccatccagaggcagggctggcataggtgctcgcttgctcactcactgccctgaccctgagagctcctgcttctatgcccctagagctgtggctgagtatatggcacatagtaaatgctcagtaagatgcagctgctgttcatcttggccagaagtcccttagaaatcatctaggccacccacattgctggacacaagagaaggccagtgtcatacagaggggaaggggtgcaattaaaaagtcattgtctctaggccttacacaggaaatgggaaaataacagagttatttgcagagtaccattttctccaatggttcattcacatccgcagatgccagctgagccctgtcacgaggctttggggttaccaagatgaataggaaactacctggccttcagagagttatgtggtggaggtgggaaatgcatagacctaacatggcagcctcaaggttggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctctttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggtttagaaatggtcaccttacttgcactacggaagaaatctttacgtttttctgctccagaaaggttgcccacccactcttctgtgaataatgggcctacatggccccctgcaatgtgaggagggcaacttggaaagaacttatttccctccaagaagatgctcagttcatgctctaggtcagaggttggcaaactacagcctgtgagctaaatccagcccacgggctgtttttgtaaataaacttttattagcacacagtcacgcccagtcattaacatattgtctactacacagagcttcaacagagaccacatggcctgcgaagcctgagacatttactacctgggccatcacagaagaagtttgccaacacttggtctgtatcactgggcatttggttcatttgtttaccctaacaaatggtacccatttcaggtagaattacaggccctcatgcggccacgtgtttagcttcccctcctgtgccaaagctggccccaactccacactcccaattccacccttctcaaaagttcttgcccctaaaagtgtttcttttccttccatttctcctcccatcagcatccagagagaactttttcaaagagatgaagccaatccttcctctgcttaagtcccccgatggcttccctacaaacaaaatacaatccaatccctttcccatagcctgcaagaccctctgcaaattcacgactacttccctggtgcattgtgtgacaggcacactggctgcctgcccgtcactggaacagtccaaaagccccaccccagggccttcccacttgctgccctcctgcctgggatgctctgcccccagtccttctcctggcctgctcagagccacctgccattctatcacatcactattttttcagtctttgaaagaatactgcacacactcttaacttgttcttgttgttcacttaccgtttgtcctactagaattccagctccttctctctggttccccacttctctccctggcctgtgctcattctaatggaagtgtcagttctgggccccctaggcagccctgcctgccctttactgtcatatgacttcatctctatagtggaggggagcccagtgccactctgtaggtgcttctttcctagaataagcttcaggccctaaagttgtctagccttagggctgcccatgtgatgctgtcagcaaaactaaacatgttcttgcctcttttcctccctcaagtcaagcccttagagtttagaacaatgaacttggcctatataaaatacctccaggaaatcagtcctcaaacaccaactcccaacatctgctttctgaatatatggcttcaaacagctaagtgtacagtatctaactgctgtccatccttttgttttttttagccacatgacatctaaggaacttagaaaatgccttgccctttcctgtagttaaatttgacataaaattactttattggcagcatattaacaaacaaaaatctcctgtgtttttcccggtaattcagtttcagttttccaggtaagaaaaagataattttgaatgactacaaggagacagactgttttgaggtttctgttaataacacattcagagtgtgccttcttcctctgtcccagtcagtggtgctgttgacagagtggtacaacaagaatgaaatatactgtgggaactcaccctgatcccaacaccctcatcaacaccatcaccaccatcactattgctaccagcaccaccacctccaccaccactaccctcaccttcactaccaccaccctttaaatcaacaccattaccaccatcaccatggctaccaccatcccaccatcccaattgccaccaccacatccaccaccattaccaccaccaccatcatcactaccacccttacctccgtcattaccacctccatcacctctaccattaccatgattactatcgccatcccctctaccaccaccaccctaccacttctctctctatctctctctcatgtacacgtacatggttatatgacacttcatgatgcaatcatagacactgtccacatacagtgaaataagtacatgtttttaaattgtcattattttcaatatagaacctactcttgttgctatgtgctttggggtggggaacatcaacgtgtgtttatggccaaaattgaattaggattcataagaaagggctatatctccaaatgcgcacttttaaaaaagttaagtttggatgagggatctttcatttcataaaaggatatactgaggatttcctttcagtgacaaatttttgctgcattttattttgatttggtttacaaaagttagcctttcacacagctgttcaggagcgcagccaatgactaaaggcagatctgccttgaatagcaaatgctgctgagtaaaccatgttacaggctattttaggaccaccaagaatgtgtttgcattttcaagagtagaaggagagatcatatttatttggtatctacactatgccacacactatgctaattacatttctaagctcatgtaatccttacaacaaatttacgaaggctttactttccccattttgtaggtaagaaaacaggctcacagagggaaaaatgacttgcccaaggtgaccaccaattagagacaaggtttaaacagaccatgagggctcagggcctacctcaagccctctaatcaccctacactgctaagttcttctattagaatttgttgtgcagaaggttttcttcttcttcttcttcttttttttttttttgtataatcagattatccatttgcctacaaagcctatagtgtgcaaggagtgtgtagtggtccagtcagtgtaccctggcacttgagagctcattaagggcccaggagaatcagcaaattctcagcagccaagctaccctaacgtatatcatagaaactacaataggagatttcttctctgaggtcactgctatctggcactatcctgtgatgtatggtttggaaaaccgtgggtcaaatacaaccgtccctacaggcaagtcaaaatatcgtggctgaaactaaaagtgattttttatcctcagtctaagtgtgaagagctgaagtgatctgcctttcctttagcaccccagaattacctctgggttcattcggggaaggctggcttactgctgaggtgtccacacatctaccactatacatgcctggggttcttgggggttctgttacctgggctgaactctggagtcctgagtgccaagctcttctctgccactatctatatgacttttagtaagccacctgcaactccttcacctcagtttacccatgtgtaaatcagggaccccaagcaaagccctgcctacctcctaggattcttgttagaatcaaaggctgatgaatgagaaagtacactgtccactgaaagggcctgggattttataaaggcctgtagttggtaacaccaagacttggatctgaaggtctagaaaagcacaacatcctgagactctgtgtggatccctttagcctactgtgagtgcttatgtcatgtcatgaacatgatataccccccatacagccctaaaaagtctttgctactagaagccgcatcctgtatgtgtataaaaatacagaaccaacctcccaggtacacacccgttgcacaggcagtctctgctgagtcattgtgcagacacgtctcttgctgcttctggccatgttgttcccagaaatggctctagagggatttcccgcatggctgaatagatggggagcatacgaggagctcaccttttcagggttccagatatacagctgggccggaggggctgggaggcagaagagtgggtgcagcagagtaggcttgtggaagacaaagccttcagaaaagtttcttgcccgaggcaaatgcagtccatgctagatggtacattcccagccaggaagagagtgcaatgtcctctccaactcaaatggcagtgaccagtgggtctccccaaactctgccataggacattagggctttaccaagcactgtccaggttgcagttttagatgggaaagggcacttggccttgagaaggtacagaagccaactccctggtcaccgcatttgttcatgctttttcccttggccctcagcctctggatgccatcatttggcctggagataggaaaagtgttgcctacatctgcctctggtactagcaaagggcatggtacagtgtggtgcagaccagcagcaggaacagaaaggtgcttctctaaggaagctgcagagatttctctgccagtctggagatcagctttgggtcccagctctccctgctactcttccatatacctccaatgatgcaagtttccaagaagaccaaggctgtgaaaaacagtgtggtggttcctcaagaagttagttcaacataaaattacaccatgacctagcaattccactccttggtatacacccaaaagaactgaaaacaagtgttcaacaaaaacttgtatgcaaatgttcacagcaacactattcacaatagccaaaagacagaaacaacccaaatgtccatcagatgaatggactgaccaagtgtggcacgtccacacaatggaatattatttggccacaaaaggaacggagtactgaggcatgccacaacatggatgagcccagaaaacatgatgccgggtgaaagaagccaggcacaaaacgccacatattgtatgatcccatttatatgaagtattcagaataagcaaattcatagagacagagggtagataaatgtgttgccaggagctgggggtttccatttgggatgatgaaaaagttctggaactagatagtggtgatagttgcacaacattgtgaatgtcctaaatgctaccgaattgtacacttttaaaaagttaatttcatgctatgtctattttacctcaatttaaaaagagaggacctagaccatgggaagagtctttggactgactccttatcccatgttccctccaagtttcagctgctctgatgccaagactctcatggcatcagagctcaccagcctggctctaaatctactaagtggggtcgatatctctgcaggctaaaagttggcactcaggagctaaaatgtgcttattcaataagcatgtgacccctctgctaagctacagaggcatgttctggacataaattgttttaaatgtggccattgatagcagcatctctctttggtgtgtcctagcaggaagaggtcatagacaggatgcccctctagaaggttctgaactaatcaggtgtctctggaatcttctcccacctacatagcagttgaatttctcaagcagggaaatattctgcatggtctgaagcttgttgccattttatttagcctactgttggggcacagagagaggtaaggtcacctctggcctaagcttcaaagttcatccctcaagccttctaagacccggtacctaattttgttttaattttatattctgtttcataaagagggccccagattataaaagcttcagtcccaaaactagagacccaaacacctcactataggaaagaaggctctgattaaccagcagctgttttttttctttctctttattctttccagctctattgaggtataagtgacaaattaaaaatgtatatttaaggtatacagtgtgatgatttgatatacatatatattgtgaaatgattaccacaatcaagttagtcaatgcatccatccataacttcatctagttatatttgtttctgaactcatagaactgttttaaaatcatagaaacagtagaaggctggttaccaagagttgcagggggtggagtgtgaaatggggagatgtcagtcaatgggtacaaattctcagttataggatgcataaatttgggcaatctaatgtacagcactgtggctatatttaataatgctgtattgcatatttgaaatttactgtgagagcagatcttaaatgttcttatagcaactatttttctatttgccccatttaaactactctagttggtgtcctggcaatgaggaggactgtcaccttgtttcctgaccttgccactgcaatccaaatggggtctgtttttatcatgccaggaaaggagggggaggctgcgtgggttcagcaggggtgtctcctgactgtgccttccaggcagtctgtcactgtgtgttcccccaggaggccctggaccaaaggccttttcatctcagtaccccaatttctaacctcataaggttacactgaagatgaaaggaattgatgtagttaacagggctgaagcagaggcttggtaactagttgctcttgttatttcctctgcttgtagaggaagttggtatagtctctctctctctctctctttctctagctctggctctccttcaaccattgccctatcatctgaatggcaccttggcccatttcctccaagccccacttctgcttgaggacagggctctggaggctgacaaacccaagttcactccctggttccaccactttttagccagccaaatgcccttaagcaagtgacactccctgtcttcaactgggcaccctcatctgtacaatgagggtgggggtgatcacattagtactgactttcttgagtcactgggaacattaaggtaaagcctaaaatgcatttggaactgtacctgtcacttagtaagtattccaaagtcactcttgaagtctacttataaatcaggtctcccttactaaaacaaaaggaaatggagaaagagaagaaaggagaaagatgggaataagaaaggaagagagggagggatggagggagggagggagggaggaaggaaggaagacaggcaggcaagactctttaatctttgctccttgttctctctagccactcacactcaagttccagcccccaccaatttggagatgattccctgataaacctctaaactgcaggcatctctgttcttcatttctaagatgaggatgataatgggaatatctttctcatagagttgtgaagataactatgtgaatgcatacaaagtgcttagtaccacaatagtcatttgtgtcttgtgattccaggagttttgggcagaggattgtgtgccctggtcagggtgcccacaggcaaggttgccactgatctgatggggccaatccaacaggcatggagcccagaaacaggcttccatgtccaatcccatgtcctgctcttgggaaggctttcccactccgaaccacaaaaccactgggtttatctgggccactctgatgaaagtcacattcccctgaacaaatatcctcaccacaagggcacctgggtcatcctgctctgtgaagcactgaaagagtgaggcagaaaatggagtgactacttccagaaatggaatcacctcaagtcatatcaattctcttgggaagagccccttgggtttgtatagttctttaaagtctgagggacagtggagaggcaggtcccaaggagtgctaatgcagaagtaacatactatggcagcctggcatgggtcagatcataaggggggccagccagggcgtggaggcaggactggcagggcctggcagtaagaagagatattgctactgcattcacacggtcccaatcagaagtcttagagattatctgtagagagagctgtggctaccccatatagtacgtgacttccacacagcccaaactaccctaattaataatgacccagaagctgattgtttctagctctcagattagcagtggctccttattgccccagcttagctctaccagatgtcctgtccctgaaatgtaccagtagcccctctaaaaacccacttggctcatcagggcccagtccagggccctccccacctatcccattcctaatcccatcagcattagcgagaagcctgccactgcctcagggacctcgcatctggagactcagccaagatggtggcacctgtgagaggatccacaggtagccaagtccaggtagccagaggccaggtggcaatggggaagagcataagtgacccctgtccaatatgccctcatcagccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctggattattctgcctctttagagcattctagaaaaggggtgttttctcggttcattggccacacggcatggctgcatcctggtgacattttcccagcatcagatggttggagactgcaatgaggaggctccacacaattcatagccttcagccaggccccttgctaaagtgctgcatgggacggagaagaccaaaccaattggagagggactcgatggaagccacacatggagttttgtgttgttgtccagtacttactgtggttgccctgctcccattgacctggacgatccatgttaccatctgcccctcctcccaaaaaagggaagcttcctgttcttggagttggcactaggagccaccctcagtggcttaaacagatttcttttaactatgaggtagtgcactagatgaaccagactacaggagatgccagctctgtagccatcatttcacaatgcagccatacctaagagcctaggacaggccatacccggtgggcggagcagggatgggccacagctggaggactgaaagtgggatctcagcctcagttacagaggcactccctgatggccaggcagcaatcctgtggagggctttgtcatcagaaaataggagcccatcatctctggaaggttggaagcaccatggtgagatgggatgtgtgtccaagagttaaactggtctggagttctcttttaacaccatcatcacaccccttcatttaatctatgctggactttgaccataaaaaaccaaacttgaaattgggatccctgcaccgactggtgaggcacataggagagggttggtttgggttccatatgactgacataaagcagagcaaatattggcttgggacccaaaccaaccctctcttaggcttgttaaggccccattcaggatagttccctggaggtggttggagagctggcagcctttctggtgactggtgacctggtagtactctctaatagaatatgtcaataagcacagctcatttgaccagaattgtaggccgcctttctcgatccaacaggtgcagacctgctactctcaggattcactttgctagtctcccgcactccacaccggatcccaaagtctatgttcaagtaatcccctatttaaatgtcatagatatatttggggaggctcataatttgattcaagtaacagtctgatctgtgcctctcactgagctggtgcaggtaatactttctttaagagtgtgtgcaagtggctctcctcagcctactctcacccccagggaaagaagccctcgtggatggaggaagaagatttatcttttctctacaagagcagcccaggaagaaagcatcaggtaagcataagcttaccaaagctgggacccattcactttacagtggggaaactgaggccccgagtgtgaaagggacctacaagaggtcacaccacaaggtcctttaagagaggcagagcccagggagaagtgagaaggttgggcttaaatgatctctgcccggtggccctggtggcctccaacctcggttctgcctccacttctccctttgcctgtgtgattttgggcttgttagccaaatttaggtgaaatgtagattaagcttgtgaacctgggtccagcagaagtggagtcatctggattgggacagggccctctcctttgacctttagcttctattacagctacctcaggcagcacctacttcctctatagatcaacctcaccaaatccatccagatgtttctcttctccccacagtaatcatctctatcccactaatgacagaacctgggaatgtgtttggggaagactgggtgaggatttcttcctgtgaaaacagagtacaggcctcaccaggcttaacatgagtgggtgtgagcagcccgtcttgaagggcccagcagttctgacggtctaggagttagaggctagctctcaacaaatgcttgttcaatggcagaataccttgattcttctcaggagatggtacaatacaaattctgagctcattaaattcatatacatctataggttgaggatcatccttagagctgtcagttcttccaactggcatgtctacactacagaaaaggagaaagtagttctagaacactgcccacccaggtttgctcatctctgcctttgtcagtgcacttccagccactccaggctgctgctcagatagttctggcagaagcctgttgaagccccagccctcaggtcagggtggctaaaggctgatgactgtggcagccttcagagtggcaggtggtggcaagcagcaggaggcaggagtttccaggctcagccaccaagacagcatccctggctgtcaggtcagtgctgtcaggtcagtgctgtcaggactaagctgcttgcctccccctacttccactccatccccctatcctagtgaatgcatccttatttgtaagaaagcaacagaggcccaacacgaagacacagggccttgagaatgatatcagtagtgattactgctccccaagtgctctcctcagtgagtacagtggaacctttcactaatgctgtgaagcacacatggtgggccaagtacccattttacagaagaagaaattgagcttcagggaggggagtggcttgcccacagccacacaacaaacggaggagctaggacttaactgcaggtcttctcatgtgcattccagggccccttcctccaccgcagcctgcatctgcctgcatcgagtgctggttcagggcgaatcagggacaccaataaatccccgatttgtaggtcgaggttcttgctccaaaccacccattatcagagatttgctcctgagacataactgactcctcttgaagccaatcagcattagcattcagggttccctgccattcccaaccaccctggtattctccagagcctcatgtcttgcaattctggaaatgctcaaaatcctgtttgttctacagaaagatcagtttcagtttgctgggacattctgctgaaaataaacatgtaaataacacatccccaaatacaggcattgatactatacacacggatattcctttgatcccatgtgcaaatgcaaacatattcattctgtctttctctcctcctcgctctcactctctctctttctctccatcccccatctctttgtctcttcaaacccattcctgatacattattttcttatctattctacagctacctccatcatgccccacgacatcttcattactttcttctgagatagtctactgggggccatccttgtcctcagagggcttgaagtctaatttagttggccaacatcaggtgcctcaaaattcatagggggaaaatgtaacaatattgaataaagttgttcatggagtatggatgtaagggaagagactaggagaactggctagcaaattggcctgaactgaactggtgaggcactagtgaagaaagagcagactaaataaaccacaggcgattttcacctttttgacaattttgcccagggcctacaagcccagtgccctctggagggaaaataagtctccctgagtttatctttcctggttacctttgacctcctatcttcttgcccaataggaacagtgcataccctttgctgacctttttattggtgtccatgttaaacctccaactacagtgtccaaaatcaagcatttataacagcctgccagacttctttggataagttatattctttattctccttatgctcatttcatggactgtattcgtataatctctaccttctctaagaaatttttccccttttttgtcattctggactagaactatagaaagggaagagttgccatatgtcattgttcagacagaaccagaaataatgttgacttcagagctgaacttgtctctatcagaagagaaacctttgttttctcattatctagggggtggggaggccatcacatgccttgaaatgcattttaatgaatgtttataaggtcatggggatcacattggtggctttgtctgccggattctgaaatgggactctgcaggcatttatgtatggagagaaaggaattcgtttctaaaagatgccagggcactgtcactcactccctcccccttcctcaccaccaaaggccgggcctgtgagggctctggctgggagttgggacgtctggggtccagtgtccttttaactaattgtctgaaagcaaatcgagatatgctctgaggaaatcctgccagtggctactgattgtcacagggagaggcctgaaagaagtaggagctgtgggacagctaggactaataccctgctgtcatcaagaccgcagagactggagaaaagcacatgggtgaagcagggagattcatttagaaagggctgggagcttggttggggaccttccgcccctaccaggattctgggaggggaggtcattccggagcagtgagctatctcctgcccttgatctaaaatggtggctgtgggatttagtcagaaacacccagtctgggcaggcaaaacctcagcggcatcagccacaggcacaggtgacccagtgaaggcacgagtgtggcactgggcacaggggaaagcccagccaacttctcgcagttgagatgagtaacagatcatgggactgtgaaagagaagacacgaaagcaagtctttatctaggggcaaaattaactggataatagatttccacgcctcactgatgtctggtgaaggcagacgctattacagcaaggctgagccttccgtgtaaacacagccgcctctcctcggccttgtttagggttggctggtgttcttgctgttcagccagggcacttcaggctcactgttgaaagctcattccatgaaatccaaaacatggagctgcatggcctctgacaaagtgaattctcactgaagtccattgaaaaatgaaagctcagaagaggcttgcagcttgccactctgccaaaacagcagcctctatcggcaccccaaaccccacccctgagaaaagccaggtgagcctgccccctttattaggcatccttatgaaagtcagtgagtgtacatgccagcagctgtccagccacagacttggcatagcaaaagtggcatccgctccagcagtggcggcctgctgggatctactttgttattgagtagtcagttggtttctagaattggaattgatcagggaccatttgcttgggatgcagttgatgagtgctggaaaaggtgtgtgtatacgggctctcatgtaggagaggtgcagcctccttccctttgccagtggccccagctggtacctttagtgtctggtggtcatgccctgcctcctccatccctgcaccttactcccagcaggttagtggcagaccaacaattaagtgaaagctctgggagcccatagaagctgccagcaaatttcagaggctcacgtggcagggatgccagaccattgcccctcacagccccttccctcccttcctttccccaacccccaccccctccttggcctgcctggttctgcattgcttcgccattgttaaaactgtcttgcagttcgagacatcatggacagcactttgggcctgactgttgccagctcagactccctgcaggggatccttatgtcaaatccacatgcaatcatccctgattgatctatttcatacatttctatttttaacctattggattctttgggagaatgtagaagagacacaatttcagtttgggacccagtggcttgtttgtaggttactccataatggattgagtaaatggctgagctccctgtgtgttgggtaatttatgttcctttgtccattgattcgttcaactgccatttactgagcacctgctgtgggccaaacagttagtgagctgctccatggaccagctcagggacactatgggtgctgtgcccagtcagactcctgggaaagtgggcactgatgactgcatgggcctcagccctcttattgtgcctgctctacacctctccaacccattcctgcctgacccatggtattcaggcctcagatgagtttggtgacagagctgtcccttgaagtgcccttgttcagattgtgggcatctcaaaagaaaagtcaaagaagtgtgcaagtcctctcactcaagttggcaagccccttctgtgggggcgatgcagtgtcctaccaacaacatggcgaaggcagtgggtctggaggcagctgagtggtggtggaggggccctgcatctgacctgggccttgttgccctctggctgagcaactctgggtaaggcctgcccctctctgggtctcagagacctctctgtctttaagaagggtattggactcccagaacccttccatacctgccctttataatgccgggtaccagttagtgaggagctattaggtgtcatacaatgtgccccgtttcacttaatagtcagagcaccttcatgagaaaagaactataattacactcattttacacataaagaaactggggctctgagaggttcagtggcaaggccaaggtcagagccctatgccacgctgcctccacccttgctctgggccagtggttttctgttgagaatcagccatggagctgttggaaaaactcccgatgcctgggccacaccctggatgaagctgtcagtttgtggtgggagggcccaggaatgtggatgtttctaagtgattctgatgtgcaccaaggcctgagacatacagccctggggatctgctttgatgttcacttggccatgacagtcatgcccctcatcgtgctggcaagtggccccatgcatgccttgagctcctagtgggctacaagctcatcaaaccagaagagccaaacttaaggtgacatcagaggatgagcactgtatgtcctagtgaaacttccaaagctggaaaggggttatttggggggtaccgggtgggggaagctttaaaagaattctacctgttcacctatcggcattcaggtgatttccagatccctctcttcctttccttattttgatcattcctgcacatactcctttgcccccacttcctttcccatttacctgctaacatacaggtcatggtcattaacacaacagcgatggatgactgtatgaagccatgaagagtaggaagtctcacattgctagtgactttgctttgttcccaaaggctgtgcttctataaatgatgggcagctcccccaaggttcagatcccagattggggccttttctcattgtttaatatctccccaacctgaggatgcatcttcagaggaaaatttcttatttagataactttatacttttttaaatttttggattatgagtcgttctcgttaaagacaaacaagcagaaatgaagagaatagaaagggaattgccagtcatcccaaataaatgaccactccaaattgttgggtataggttcttccaaattatttttgtgtacacatagcaatgtgtgagagtgtgtgtgtgtgtgtgtgtgtgtgtgtgtgtaaaaataaatggaacaatgaatacgatgcctacaatgactgttctgaaacttgtgctttcccaaaaacagtattttaaacagctccccaagaaaacacatccagatctacttctttcctgtaagggctctgttgtattcaattttaccactgcagcctgatgcatttaaccaagactagaaggcagcctaaaagttcaattctatactatggtattccttcgttaaaatctatgtgtctgtagacaggaaagaattaaaactatttagctacttctagttttctctccaatgcctgcctttggcagcatggttcatttagtgacttctgcatagttttgttgaactctccttgaagtgggcagattaccctttgaataacgttctatcccgttttagtatacagacaacataatgccttatttgaaatgtaattagacagtttagatgaaacataataatgaataaataagcactatggttccaaagacaggctgtattttatagttttcacaactataagtctttaaactgagaggtctgttttatcatgcacatttcctgttcattagctttaatgtgccaaacctttataaaaattcctctctctctctctctctctttctctctgtctctctctctctctctctgtgtgtgtgtgtgtgtgtgtgtgtgtgtgtgtcacctctcttcccttctcctctcctctcttctcctcttctcttctcttccattcacagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacaggtaagacaatctcatatctggctgtgttcttttgttttggaagtaacaactgtgtttcatgttgccaatatctggctctggagggtaaatccaggctatagttctctctgagactggaaaagactctgaaaaagtctactgaagtcagctaatcctgtgtggttaaaagcacagtgttaataaggccaaggttatggtttcagtgcctgttcaagtcacctaacttccctagaaggagagctgcacccacaaggtgctcccggtggaaggagccaggtgggacaagtccgaatacagaaatgccttccctgcactgggccatgtagaaagactagtgaatccttcttaagatgtaaggaaattgcactgaagcatttaatcttatccctgctggcagaaggacaaacactgagccttctagaaatgccacagcaaacttttgctgagcaacctcagcatgccatttgtcactgtgctggatactcagtcaggtcgtgaaaggaaaaagacaggtatttgcaaggtagtcactctcatcatctccattttacaaatgaagaaactgaggctcagagagttgaaagacttgcccagagtcacatagttcgcaagggacagagcaggaacttgaagccaggtggtctcactccagagcctgtgctcttcttgaaattacttttgacttctcaccctccctcatctcctccaggcttttcaatcatgaaatgcagctgattccacctgggtcgtgtctatcacagttcccagttttcatttctgtgacccctgcctgtattagttatctgtggctgcataacaaattaccccaagcaccagcttcgaaccatatgcatacgttaccaccacatcctgatttctgggtgttaggaatcctggcatggtttaactgagtcttctggctgagtatctcctaaggctgcagtcatctcaaggctcagtggggaaggatctgcttccaagcccactcatgtggttgctggcaggaagcagttccttgcaggttgttggactgaggcctcggtttctcatgagctattggccagaggcctccctcagttccttgccacacggtctcttcacagagcatctcacaacatggcagctggcttcatctgagtgagcatgagagagtgtgccagtgaagcagggtaatggggagagagggaggagggatagtgccagcaagtcagaagtcacagtctctatgacctggtctagaaagtaacatcccaccacttttgctgtattctattcatgagatgtaagccagaggagattgcatgagggtgtaaataccaggaggcagggttcagtggggccaggtcacacgtgtgcctacacagaatactcagtcaccatctaccatccctccttcccattcctctcatccttgcccaagttcaggtcctcttgattctttatctgaactcatacagttgacccttaactggtctctcccaataaaccatccattgctctgagtcgtcttgctaaaacagtgacctgatcatgttttacacttgctcagaagtccccagaggcccataagctggccccaccagcctcctgggcccttcagcatccatcaggccctgccttgcactttgtttctattacccagaagtgcctgcagcacttggcccacgctatctggtctcagcctttactctggccgttccctgggcctggtcatcccttcccacattttctctcctgtccaacacctgcagctacttagggctcaggcaccatccctccaggaagcttttccatgactgtcctcagtacttccatttcccactgtgcctccctcttctggagagtggtcaaggaggagattataaagtgcttggccagagacctggcccaagggaagcacctgtcaagggctgacctcttatttaagagctctgtatgagcacacctgtggcaacccctagagtacagaggttgtgtcttttccatccaggtttcctggagcataaccatgcagagtgcttgacaccagggagttggtcgtttgatagaccatgcggcaagcagagctcccatgggggtggccgggggagcggtgtggagataggcaaagcacataggacacggcaggccacctggggctcgggccctggtctgcagttcaggagcactttggtttgattttattatagggctgttgccatctgtttgcatggacttctgcagctagctcggtgaagccccagcatcaacacgggaactctttcactagcaggcaagatcctcagcctggagacgtgtcaccgtctaacattgtgagcctttctgttttgttttgtcttcaattgggtacatttttgtagactgattgtgttgtcccagagctggatcagctggctcagagggagaattcttaattattggggtcatgcaaatcatacccaaccaattacctaggtggggttggagaaagtgttcaggagaaagaccgaacagtcaagctccctggggctaggagcacaataaagggggcaagcgacttttgccagcagaggcaagaagctgggtccccaaattggaaatgctattgccaccaagagctgcctttccagcccatgctggcctgtgcccaggggccaggcatgggacctggtgcttcacctgcctcttctcattttaatcctcagaggcaggggctgttaccattctcctgagagttggggggaaaggcacagagaagtgaccgaagttgcccacagtcacacagcaagctggggccagagcagacaatctggctacagagcccacactcatactcccatgcatggggcactgcctctgtagccttctgtttccactgtcacctcttaactgtttcctcctctacaaatcaaggtgatgataggttgtctgaggactaagtgtgttaatacatctaaagcactttgaacagggcctggcataaagtatgtgctgagaagggatttgctgtcacgatgactctacctcctgaccctgtgctcccagatctgtttcatgggactaagatgtggttctaaaaaccagtagctgtggcaggacagacacaagccacgttatctccagaccctgtacccaccatgagattgataggagttgtgcagcctctgagccttgtgggctccttttgctctaggccctgcctctcctggacaactcccagcctgatgggaaaggggaaaggggaaaggtccatccctgctttgcagactggggatctcactttgctctttcttgagctctccggcactctcactccgctcctctccctagcactctgttctctacctggtattcttccaggcctccaagctgggggaatctcaacagtccttctgtttcttcttatggcctctccctattaactctaagacctaagaactcagccctggtcattcttccaggggagagaaaaaaataaagaaaaaagcgagtgtttgaggcaagagctgggaccgctgtagaaggacagatggtggccccaatggtggggaagaacatatttcccacttccagcaggctaagcaaacctcccaagttttactgatggccaagctgagcctcaggaacactaattacctatgatatggcatttactagcctgttacatttgccatggacgataatggttaccatggaaaaactggacattcatttgaatctggatctttgaggttttgtgcggggggtgggggcttttttggtttttgtctgttcatttctttagaggcagggtctcactatattgcccagtctggtctcaaactcctgggctcaagtgatcctcccacctcagcctcccaaagcactgagattacaggcaggaaccaccgcacctggtctagatcttagttttctaaaggagttatttttaaatgtgagatgagacacaaacgcttgagtaagctgaaaagccaaatccagccttctatagaggagctcatttttatgtacagaccagcatctctctatttggaggattttgctttaccagttgagtgaactattcaatttcaatgcaccattcatgtccacgtaaggtaaaaggcaaatgccacatgactttggggcagctgtttagcatgggaggttgagcaagcaagggcactggaggcagacagaactgaggctcaagtctggctacagatgctgactgattcaggtcccatgagcaatgttactcaactcctgagcctcagctgaaaatggggaaaggaatagtccccttcacatagggcattgggaaggcaaaggagatgctaacctgaaactgcttagaacggtgcccagcacacactacaggctcaatcagggctagggcagccttgtgggcttggacctgaaacctccggggcctgatgaatttccaaattcagaacatttgggactttgggaaggtaatgtggtgcaaataccaaatgtcacacaaccctccagtgtaatctgaagcagtgtttcattacttttgcagagaaatatgaatatttaaggaagtccagagtcaacttttgcccccacataaaatttggcaccaaatttacaaaagtaaaattggctttcagagcttcttggactttaaattacagataagggatgtggacctggaattattaagggagggatctttaactctttatggagttgcaacacccagcactggtttgtcagattttaatgaccccaaattgcgtcactgaattccccaccctccctccaggctgggtgatatatcttgatgtttaatcagactgaggcaaaatgaattttgtttgcatcatctgatgtcccttctccctgcagattactggagataccttggcgtgttgcaaaaatcgcggttaggacttacttcagtttcactattcacgactgcagaacagatcttacatttactcaaagacacaaacaagtatgtcaaggagatgggagttggactgtggaagactggggatagcaagaggcagcctctggccagagtgccctcagtgcacgtgcatttgagccccactcagatctgcagagctgggagtgtggtttcatggggaggagggatgtggatggaggccagttggaataagaacaaaaaaaagcctggaatctgatccttgaggcaggctgtgcagcacagagggaagagggcagctgtggagaaatagaccaaggaggcacatgatgttgttttgacaaatatggagagggtagagaagggggaatcaaacctgccttggagaaggctggattaagcccctactgggtctgatatgctttctatcttaaggataagctttagcttaggcagtcgtgagcaccaggcaattgcagaggcagtgaactcaccatcttccctttctgaggggttgggcctatgaagaggatctgggcagctccctctaaagtggggccttggggaagcccccactattcccacctgtggcctctctcacccctggtagactgaaccctccgaagtgcagtacttccagcacccagggcctgaagatagatggcacagggcgggggacacaggggccttaccctggggccttggcaggggacaggccctggggctgggctcaaggccaagttcaagaaagctcagactttggatcacttgggtccaaatcccagttctgccaccttttccgcggggcaagcgatttaccctttccaggcttcagtctgtaaaatggagatactagcatacctatctcatggggctgctgtgaggattaaatgagatgaggtaacagcgcttggcatagggcctggtacacaattatgctccattgatattagctgtcactctcaggaaagttcccgaaacccagaacaccagtaacccaatggaatgaatttagtcagcctcggctcagcatccaggctcctctctgacccccaggggtggacggtgacttggagagaaagggcaggggagagctcagtccctctggggctgcgtgctcacggacagtcccttaggggcgttaaggaagacttttgccaggtggctgaggagcagccaaggcagcagacacaggttggtgactccagaaggaagtagagccgccaagccaggctgtggtttcctgagtgcccctgaccgtgggtaggggagaatgttgtcttctcttccctctaagcacggccagctgaacttctaggagttacatggatgctgaataacaaatgcaaccacaggacgactttaggtgggcagagaggagggggaaggaggagctaagttccacctgcagccagcgtggatctgaccccacctgcttgcagcaggctcaggggtgcctgacatttcaagactcaggcagagggcttactgatacacagtgacaatgaacagggcggaaagcgtgtacatgagtggccaggaaggaaagctggtcctgcatagtcatggcgcacagagcacgcatcctgaggggatacctcccctctctcctctcgtttccgtccttcttctgcaccactgactctcactcctaaagcctccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggagagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgcaggagtggatggtgcagagcgccaaggggaatcaaagacgtgacccttccatccaggtgagcaaaggatgagtactcagagggctggactgcaccctcccctccccatcctgtgcttctgactctcagatccacttctgactctcacttccagcttctgactctcagatccactcatggtcccatatcgtggatttatggaatcctttcccgagtctatttgtacttttagcctgttctgtcccttagggattgacaaatcccacgatctgggcctgccctgtaaaacaactatgtggggcctgacctggctgctttttagcttgaaggggatagcagagggtagaatgctggttacatttaaagcaccctgctcccagatccaaaagaaagtttctgctttttcctaaggagttgaaacagtctgggattttatctgattttgttattttgcctacaatgacaaacactgcttttgtttgttttatcatgttgtgttttttgctagatgagtgtttatcatgccggctgcacccatccaaagcagtaaggttgttgaaagccaaaagcagcagaaaggcccaaagagatcaccccacctcacccacaggctcacctctgcaggtgtcttcagacagctgactcttaactctcatctcagcaacagtttctaagatagagagtggaataaagagtcagcattcatccatttcttcgatgttttctcctttaccccatgtgaaccaagtttcttggtaacgtgcagctaggactcacacagacgaaaagcacagagccacaggccttggctgggttattggagctaggtgcacaggaaaaataaaagtgggtgctccaggacattatatatatagtcctgggctaaaggtggccttcagggcctgaaagatggatagctgtacctcactaggaattatcccacctcttgctttgcttgtgggagctttcagtttgcagctaaaggctcaggttccggccagctttttcccctgtagcatgctaccaaatccggccatcttccagttttgagcagaggaggtgagcgtagctgtggagacacatattcttctgcaggcccatgtcggggtggcccatgaagagaatttgccaaagccagctggctcagcagaccaacagatgaaggtggactactcatttgcaattgtgattaatgatcatttatttccatgtgacaaagctttgaacgatgtgggaggccctcacccatccctgagtgggaataactgggaatgattccatgaccctttccctttatctggcaatcctttcaaagatgagctctggaaaatgtgaacagacaatgcactccactatagctttctagtttcacatcttcaaacaccaaaatgttgacacccattgggatggttattataaacacatacacacagagagagaaaataacaagtgatggtgaggatgtggagaaattggaacccttgtgcattgttggtgggaatgtgaaatagtgcagccactgtggaaaaaagtacggcagttcctcaaaaaattacacagagaaataccgtatgatccagtgattccacttctgggtatatgcctaaaagaatcgaaagcaaggctggacacagtggctcacacctgtaatcgcagcactttgagaagccgaggtgggaggatcgcttgaggccaggagttcaatgccagcctgggcaacatagtgagatcccacctttacaaaaaattacaaaaattaaccaggcatggtggcgttgcctgcagtttcagctactccggaggctgaggtgggaggattgcttgagaccaggaggttgaagctgcagtgagctgtgatcactgccctgcactccagcctgggtgacatagagagaccccatctcaaaaaataaaaaaaaagaaagaaagaaagagagaaagaaagaaagaaaaagaaagagagaaagaaagaaagaaagagagacagagacagagacagagaaagtaagaaagaaagaaaaaagaaagaaagaaagaaaaaagaaagaaagaaagaaagaaagaaagaaagaaagaaagaaagaaagaaagaaagaaagaaagaattgaaagcaggggctcaaccagttatctgttcatagcagttttgttcacaatagtcaaaagagagagacaacccaaatgtccatcagctggtaaataaatttaaaaaatgcagcatgcccatacaatagaatattattcagccttaaaaaggaaggaaattctgacatgtgctataacatggatgatcactgaaggcattaagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggatggtggtgatagttgcacaacactgtgagtgcacttaatgccactgaattgcacacttaaaaattgttaaaatggtacattttatacatatttttaccacaatgaaaaagtaaaggctgcaattttaaaacacttgctagtcctctcctaatcaaaagcagtcttttcttttgcaataatattagtgtacaatctaaaagaagcagcaagctgaactgctcattttccatccctggtaagagcagtatttactgcacatccactcatcatgttgtatgggccatctgggttttttgtatgtcttactgaggtgcatgtttgttaaatgcacaggcataaccagaaataactttcctggaaaattgagcataatggctgtccctctcttgacattttggagaaatgataatacgtaggtgggggaaacaaagaagtgactgtaaacaagaacggacattatctctgcttctgaatgagatgagaaacccacttgcttcattagctctctggtatatctgcaagtctggaaacaccgggatgactcacagtttgctgagtaatacaggagccgacagaatgctgctagtgactcgccatctctgactggctttctgtgcaaactgtcactctagagcaagtgctaggccttggaatagagttctgaaaaaggttacggttctcaactacagggagaaccagctcctaaggccttgacactggtacacaaagtaggacacctctgaccaatgccaaaatgacttttagaaagttcacacctggtcattgtgtccctgctcatgctccagctcacaagatctctggtttctgcctttcagggtgtggtgatgtccacttcttcatcagagttctttgtgacttgtctgcttctccacttggtagtaaactcctcaggcataggaagacgtcttcgctagctctgtaatgtaagctgaatgatccttggaatgaatgagtagaatatagaggggaatgaaccaatgaatgagctgtatctgctagccattgcggaatgctaagttttggaaactgttttgagcattttagaggaagtattgatagacactctcagtcttcaaggcttggaggccgatgaacccatattcttgcactgggcagaaaggagaactttgcatctgcatgtagggcccatttacccactgaccatgatgcatttctctggtccagttaagctccttatccttctatagcacttgtgcaatgtctgaaaacatgtgatttcttcaacttccaacaagtacacaattttataccgccagtggtaatttgtcctggtggttctgttgtttctgctgttgttgttgttgtcgtcatttaatgcaatttacaaggacaaaacaaaacttctggctgccatttcacataccacagtgacagcttcacatggtaagaaaagccaaaaacagctagtttcgaaattcaggccactcattttattacttttccctgattaagattcattcataccactttggggtggtgctgatattcctaacataagccaatcgattttggtcagttctgagagcagtgagtggtcttcacttacacacagtgtgtttgtaactctgctatttctttatgactagcacagtataaagtgaacgtttttggaaggctgttaagcatatgttctcctggtaggcttaaatgtgacttataaaaatacttgatagtatatgaacaagctcccactactggtttaaaccaaaaaaaagaggtttattttactagttcataagcacagattctacattctttgtgagaattatctttttaggtttttgtttttatttgttcttatcattttgatagccattttaatcatttcttttattcttttgtttgctttgttgacttttaatttggaaatgtctgctttggcagaataattacatcacaaggaggccctttccccacccacctacccagaaaggtctcctgactcccttatgctctatgaattgccctagttcaagattgatacagatcaaagcagcagaatggggttgaaagagcagcctctggcaatggccttgaccatgtcaattccctgtgcattcatatagatctggaatcatgtagatctattctgcccagcttgttccacagcagctggtgggcagaaccactcttccaagccgtgtagttattctgcactgcaagaggcaagattacaaccgaggactcattcattaataaaattgtttaagttggctttctgaatgacaacgtggtctcaggaacttaaaagacttcaccaagtccctgctgcaaacaaaaagtctgcattgtgatttgtcagagctagattgacatccagtttagagtttagaatccttctccatgccccacttttgagacaaattacaaatcttgaggttcatcaacattctagtacaatatgaccccccaaggtttaagagccctttagagatttgaagacaactgtgatgttcccactaactctccctccttcccccagttctttgcccctatcttggctgctggcctctgaactcatcacagagcactggagtgagggcctctgggtaagtaaggctctgctaaactgatcaaatgctccacgtacatttgtcccagtagagaggaaagctcctcttttccaaacaatctactttattcctgctcccctacatcccacttgcaagggtagcagccacatcccccatctgtcctgcccgagctcattgtccaagccaactccagctcagaaatttcccccagagaagaggttcctgaaggctaagcattgctctgtaaccctgaacttgatttatgtctatttctcactctctcattatataaagtttttcaaataatattagactaggaattgagaaagagaatgagctctcacaattgtttctagagccatcacaatcctacccagcaacaccttttacgggcttttaatttttttgtttacagttattacctttgaaaccaaatcttgactttctggtatgctcttggactttttaagggatttaaaaattcaggagtttgatgccaataattgcttttatgagctagcattgcttcttttctatagatgaatcccattttaaatcatcaattattttcttcacagaaacccacaaagtacatattctagtttgcatcagaattgaatatgacccagaaattcttaatgttattaagctagactattgtatctaaaatgtgtatcacattcaactaatgcatattgaagatcttgagtaccacacttgagatctgaatgaagagcccaggattgtgatatttgatccatactgaatgtatttgctagagtgcattgtacagatggttcaggtgtgttagatttgtctctgtaaatgaattggtcagtagataaaagaacatgactcaaggctgagcagggttcagcaggccccaagcttcatcattaaaaatcgggtgttttttaatatgaggctggctgtgtaaagcagacctcatgaactcaggggtctgagaggccaggccagattatcagttgggatgttttcagtcccaattagcagacagcgcagttcacactggcttaaacaataaaggggacttactgattcctgaaagttaaagtccagcggttgggtggacttcagggttggtttgaatcaacagttcctcagtgtcatcaaagatgctgtttctttctggctgtctactctgccttcagtggcatgagcctcatcctaaggctggctcccccttgtgggcacaagatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagccttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgcaataaaaagaaaaaaaaatttcaattgggaaagaggaagttggaaagcagcacacggtggtcactgatccatcatccatatcacatcctgctggacagcagtagcaaggcttgaccaggggtcagactcagtttcctattctgtataatgagaggattggattaaattagtggttctcacattggaatgtggcctggagagcttgttaaaatgcagattactgggttccatccccagagtttctgactccacagatacaggtggggccctggaatttgcatttgtaatagatttccaggggctgctgctgctgctgctgctgctagtacaaggacacccctgcccttccactttgagaacctctgatttagattatccttatgggcccttctgattctgacatttaggactcagggatttttcttagctatctcttctgctctatactgacttatgatggattgttttataaatgggacacacccaactctactgtgtgaacaacttaaaaacatatcatggaattcctgctttggtttgtaatctaattttcaacaattgaggctgaaaatgaaggacaccttacagcttcaggaaagtaaattttctggaattgaagaaattagaaacagaaagataaaggctttcccatcctccccaaccccatctactacagcacagcggtctgtgggatgattccacgtgactgcagaaagcagctcttttcccaaggacatccaacattttgcaagcattctccctatgtgacccgggtattcattgggtcttagaataggagtagcactgggtgaagctgtgacatagatcaagttggtttaggaattttgccaactttcttccccagggcccctcacctggccaacatctattcatcctcaggtcacagcttaaacctcatgtcctccaaggagcctcctctaaccaacgccccaccccagcctaagtcaggttctcctgttctttgttctctagtgtcctacaatgttcctttatagcacttaccagcctttgttaaaaatcctcactgacgtgctccaccatctgccttgtccatcaatgttttcacaacacaggtcctggatcactgtaaatgctcagtaaatgtgtgttgcacaagtgctatcaaaggcagactgggagcagattccagtcacagtattttattacagtggtgaactatcaagcaatctatataacacatcccacagtgtatgattatgcatgctccaaaggaatgaaacataagtcttcagaagacacaaacacacagctggagagtcccagtgtccctggcatctacagccaactttttcatggccctcccccttctctctgggaagctggtgccttccagtgcccaaggtatctctctaccaggcaccctgggcattggcccagctccctcttcccccatgcccatttgggttgttgattgacacttaggtgaagacaatagaagaccctccagcttacagagtgcccaactcagcagggcctggagagctaatctgggtcaacaccacatttttcccctgagaaagtgggagtccagcaaggctgtaaaatgatgagctccaaataacagcctgagtctcctgacttctggctgcatcttgaatgcatctgcaggcagcttcaaatgtgagaataagatatgaacttatgacactctatagtttatcaccattgctataattctctgccactaaatataattttaccattaaatcaaaccaaaccaaacacttaaaataatttctttagagaagccagattatttattacaaataacgtctacaaactgactaaaagtatatcccacatatattgaatttgaagactgtgcctaagtttaaggtaattgatggattccattctcattagatattcacacatcaaaaaagttgtctgctttcccaggcacagtggtaggttatgcttatgctcatcgtttttcttcccagagctggctcttcctttgaaacagacccatataagccacccatttgctgggtcgcaagcccttcatgagggagagagaagtatggtgggacaccagcaccttctctacagaaacgagcagcatgtttgctaagggctgctggactttggcaggtagagaccatcagaggactcaactgaatccccttttatcaggaaccctaggagagtagagttgtcaggagtttccccatgacttacattgtcttttttaaaacaaccaattcatgactgaggtgaagaaggaaaataacagaaaaatatatctagcccaagaaatctacagaataacaataaaactcaggcagaaatgaacccactgatctgtgagccaagtgcttaagggaggggttggggcacttctcatgtggctcactgtcttagtcagttcaggctgctatgacaaaataccataggctgggtggcttagagacaatggaaatgcattatgcatagttctggaggctgggaacttcaagatcaagacactggcagattcagtgtctggtgagagctctcttcctgattagtagatggtgccttcttgctgcattctcatgtgatggaagagtcaaggtagcttccttgggcttcttcttataagggcactaatctcattcaggagagctccaccccatcatctaatcacctcctcaaggtcttgcctcctaatgacatcatattgtgggttaggtttcaacatatgaatttggggggacacaaatactaggtaggtgcaaaagtaattgcggtttttaccattaaaagtaatggcaaaaaccgcaattacttttgcaccagcctaatattataccacagctctctctgtggttgttcactggggcagtgggggtgtggcagaggggtgagggaaaaagggttccctcgatgtttgtggtagaaagaagagctaggtaaccaagtactcctttttgtctgcttaggtctgccaaaagtcaggcacccgtatcgggttagacattcaaggaatgtactgggggaaatgcctgtgaaagataaacagggaagagcaagagaaggtggggagagactcagaccacaatgcaggtggtctgtgacaattggggcgagaaagaggattgggtaagaagagtctcagacagtagcacagttcaggaaaagttcaaccaggccaatagagagtccttgagccaaagtcacctactggaggagtcctgctcctcacagaaatgggcctgcattactatgctcaccatgttcagtcattggccgggagtacagcccaggccaagtgcagcaaaaatgatggatctaagggggaggctgctggaggcaattatgcttcccatggcaggagatgtcagcagccactggtatggtcaccacatccttccattggtagttgtgggtgggaaggcagagtccctggcaggcagtagacagctacaggaacagaaactggtggtagaattagactgactactttggataacaaagccaaggctggcttgactggctgatagctagactatttctttgttactttgtcactcagtgtttagattgttgtttttccccctttccattgtttgtcaaattccccatctgaacccaggtctggaaaaataaaaccctatgcatttggaagaactttaaaatgaattagcttttaggctttagttgccatcataagcatctagagatattcaggcctcggagttggggcagactggagaaactaaggttatttgagaaataagcacactgaatatttggcttcctaattattctacaaggagtctaagttttgcctgccttgtgcctatgaatcactatttcttaattttcttagtttcacagaatcagaggacatgaatactgaaagatattggaggttgtctagttcgactacatcattgtagggaaactgtggccataaaaggggaaggtacaccaatattccttatgaatcaagacataaaaatcttcaacaaaatactagcaaactgaacccagcaacatttgtataaaggattatacaccatgaccaagtgagatttatccctggaatacaaggctggttcagtctatgaaaagcaatcaatgtaacacactatattaacagaataaaggacaaaaaatgcatgatcatcccaatagatgtaaaaaggaaagggactttctcaagttcacacggctaatggcaaagctgagattaaaactcaggtcatctgacttgtaggccagagttctttatactggtgagggtaggggtggagggctgaaccggaccttgcaagactgtccactgcactgaatcctgtactgagggatttctgtttgttttttcatcctgtcctcacaacacccccaagcagtgggctccgttgttattccccctccttttgcatgaggaaactgaggcttagagaggtaacactggttgtctgaggtcatacagctgccaagtatatgaggagctaagcctagatttcaggtctcctgccttgtctctgatattttccagtgcccgccactgctctcctcactcaacagtgccacaggattaacctggttccattggttctcagatcacctactgccaagcacagtggatgggctttttgttgtaagtggatgggagtgccctccaaattctctggaagaatagcctcctctcctgtgccagtgtgtgacaattctcagagccccagctgttgacctcactgtaatctgggctaagtggccatttatatacactaatgactagaaggtcttttcaaggaatggaggaccacaaagaagcaggcagctctggggaagccagaagctgaatggctgggaggtggggcaggggcaggggacagtggggataagatagaaacaaggctgttctttgctccttgagaagctgggtaacaagctggcttggcttctggtggagtctggcccagtgatagctcttgcctcctgatgggacaaaaaaggggagacaggcatctcagagaatgaggtggagagagacacaactgggccaggacccagaaaagagagttacctttttcgtctcagacctgggcatcccagatggaaccgtgctgagcttctggttagtctagcttcctccaggtgtgcaacacaggggtcctgctagggagccttcccagttgagattaaggaggttgctttcaaaatggccagctgcccaagattgcacctctgtcactgttgaggacagtgggggtaaacatgcctgatgttctgccctggaagggctccagagcctttggattgaagccacaaaggaggcctggcatttggctaccattccttcatctggttcactatcaaggatccctcatctcacccattctgctcccccgttctaatgtgggcttccataagcctctgtcccatcttccaaaatgcagtctggagagcgaggcaccaaggctgcaggccatttgcagggcacagccctggaggctaaagtggaggtgcagtggctttcctaacactggtctgcatgttgaactcagaaatacacggtacccttttcagcaagaatcaaagcaaggttgaaacaggccagcaacgtatgggacactttcttctcttccctttcgtgaaatttgcttctcgtatagatctgttttcaccaggaaatgaatcaaagccgcatactctgccttccatccttctcttctcttctctcttcaggtctttcagaccagggaaagtggctgcctttgggatagtcacaacaaggtgccctggactgaaaattgagagtgatgagtgacactctgccctggcttggggcaaggccctttcctgccatgagtttcagtgtccccacctaccaagtggggagttggtgtcagacaatgtttcttagtgggtggcattccaggagtccacacacaaaggctaagtccctgcaaaacagtgcagatagatgctttctgtaggtcttgctgactctcatactctctgtctttaactcgcttggcaattcttgagcaaaccattgggcctcttcatctacagagaatgatgacctgactaggtgatctctcatttctcctcaagttacaaaagcgttagggtggtaaggagaggaggtggccccaggaaaaccagatgggtcagaagaagacagaaggtggagccttcagtgacaggagagcagagaatgatgtccccctcccataaatgtagggaaggaaggataccagaaaggttaccatgaaagagaggagtaataggaaagtacaggtcatttgtagttgaaatacatacttgagtgtctgtgtggaccaaatctggggtgggaaggcaggcttcaaatcctgaacctcggaagggtcggcattcctgacaagagctcagagagccaacaccagacaaactctaagtcccctgaagagagtgtgctgagctaggtacttgcagccttgaacccaccctaatcccctctgcctggagcacgtccagaaggagcgtggtttgctgcagaaaagacaagtcagttagaccaaaattccaaagcaactttttaagcctataaatgatgatgattttatataaacttgagttgttccttcaacatagcaccatattttctacttatgtgattctggttttctctaaaggaaatctttttttggaatccacaccatacatacggaagagtatataaaacatataataataaaaccaacagtcatgtacccaccaaccaggttcagaaatagaacattcagaatgttttagaagccccttgtgtgcccctccctcttcccagagataacaactatcctggcttccaagagccaaccctagaaatagaccctaggctctggcaagctttgtgctcatcctagtgagatcatgcacgtcaccaatctctttaggtagtattctgtgcggatttccacagatggctcatctgttttgtgttgatccttattagtttcaattttgtctttttaaatatattttatgactttctgattataagagtaatatgtgctctttgtagtaaacttggaaaatgcagaaaagtggagagaaaacacaaacctcatggcataatacaatatataaacatttaatatataaataatccagaaacaactactgtgtgaacacattggagtgcagtatttcagtcatttttttttctatgtagaaatatatgtttcacattactggtatcaagttgtgtatataccttttccctttattgtggaatataacattgatgcagaaaagtgtgcaaggcctatatgtacagtttaataaggaagtaaaaaatgggccgggcacggtggctcaagcctgtaatcccagcactttgggaggccaaggagggcggatcacgagatcagaagttcgagaccagcctggccaagatggtgaaacccagtctctactaaaaatacaaaaattagctggtcgtggtggtgcctgcctgtaatcccagctactggggaggctgaggcaggagaacagcttgaacccaggaggcggaggttgcagtgagccgagatcataccactgcactccagcctgggagacagagcaagactccgtctcaaaaacaaacaaacaaaaagaagtaaaaaattaaaacctgctgtcaacactgatcaggtcaagaaatagaatattgacaacccccaagtagatcctcatgtgaccttcctgatccaagataattattctgcttttctacatagcttcatcacttattaatagacttaaacttgtaattgcttcattttcaaaaccttagtggcggggccgggtacggtggcttacacctgtaatcccagcactttgggaggctgaggcaggcagatcgcttgagcccagagtttgagaccaacctgggcaacatggggaaaccctgtctctactaaaaacgcaaaaattagctgggagtggtggtacaagcctgtagtcccagctacctgggaagctgaggtggcaggatcacctgagcccgccagggaggtggaggtttcagtgagccgtgattgcactactgcactccagcctgggtgaccagagtgataccctgcctcaatacaaaacaaacaaacaaacaaacaaacaaacaaaaaccttggccgggtgtggtggctcacacctgtaatcccagcactttgggagaccaaggtaggcagatcacctgaggtcaggagttcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccaggccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggcaacacagaacatccctgtggggtgaagtgagtggcctccactgatctggccagcaggaccaggaaagcagagcaggaaattcaccagacaaagggtcaagccagacctcttccagggtgggggacaggcagatgcctggggacacagagtcagagaggggattcagagatctgcctgctccttaaccagcttccagcccaaccccattacgctgaccatgtccccccattccactttacctcccagatctgggaacatctagagctcctcctcctgaggcttgggaagattctgccgtatagaccacgatcctttccagttttctcctctgctgtcttgtgattcagcttccttggtgctgtgtagtcagttaatcctggtctatctgcattttagtttcataaattatgatgctgttatctcctctcctattctctctatcctggtgggattttgtctttaaaaacaaaacaaaacacaaactcttactgtagttttaatgagactctgggagggagagaatttagatgcttgcattaaactgctgtctaattccagaagtctccaaaggaaatcctgccactcccttcttcggttgcccgaacatgacggttagttggatggctcccttggaagcccaaggtgccatcagggagatactgagagaatttgaggctgggaaggcaggtgggggttggggtgagggttatgttttgaatattgcttcatattgaagcatttgtagtatttgcggttaagagcctggattttcatgtaagtcaactccaggttcagcttccagctctgccagttacatatggtgtgactttgagcaagttactttgcttttctgaaccttattttccccacctgttaagtggggatcataatggtacccatctttcaggcttgccatgggtattgaatgtttcacttagtaaacatttacagcgtttcactcagtgcctggcacattgtatgtgttcaatacatggtagctattgtcatcatcattatcgtcatcatcatgagaaaatagaaaccttccagaaactgtcagggcaacgattgccacaggccgttgttggctactaaaactctagactctggagagccttgatgcccttcctcttttaccccgtccctgatgctcccccaagtagcatgatgcccagtggcccaccaacctcattatccagcattgctgacaacaggcacagccttggtcactgtgaaaatgccccacagcctcaacctcagaagtgggaagtatactgcagattcactctatgccaagcactatgggatatccacaggaatgtgccacagtgaggtaactgcccaggggatagtaattccttcatttctttatacattatggattctaccattttgttattgggttatttttccccttgtcaaagtagcaatttatcagttgaacttaattctctaattaaatttcaaatctgagaatttacatgatgaagtgaatttgattttggacccagtcaatttcagtcagccctaaacatattttgaaatgttaaagttaaattatatacgtttgtggaggaaaaactccaggaaagcctaaatttttccaggtcttgcttaggggataccctgctccaagaaaacttttacaaaatgcaaatttacagaacagatccaccaaatgggtgggattggtgctaccctagagttttctgtagaatttcttttttaaaaaatttttttcttttttttcttttttttttttttttttgagatggagtctcactttgtcgcccaggctggagtgcagtggcgtgatcttggctcattgcaaactccacctcctgggttcaagtgattctcgtgcctcagcctcccaagtagctgggactacaggcacgcaccaccatgcccggctaactttttgtatttttagtagagacggggtttcaccatgtcagccaggctggtctcgaactcctgtcttcaggtgatccacccacctcagcctcccaaaatgctgggattacaggtatgagccactgcgcccagccagaatttctttagtgagacttatctacccccctccacccaccataccacacgtatcataacagaggtcccccaacttggagttctcctcatttcaaggtacagttattataaaaagaagaggacacctgggtctcacagcagccagctctgcggccattgcacagtagaacctcagtggccttacaaaatattcttgctgttagtctacttactgcaataacaaaagtttcacttgggcactttgatcacacaaagcttggcacaggctttgaaatcagacaatacctaggttctagtctaggctctggcacttaactaatgggtgatcatgggcaggtcgcttaacctttttgtgcctcagtttccttatctttacaatgggattataatagtacctccttcataggattgtcctgaggattcattaattgaaatgaccctaggaaagggtcagtgccttacactgagtaagttctcagtaaatatttataatatcatcatcatcatcaattattattattattaatttactttaccaaaacacaggtcctgctgagccatgttggccagaccacacctagaacagcatgtccagttttaggctaatctgtgtaaaattcagtgcctggaccattgaaaggggctcgatatatggtggaggtattattgttaattaatgctgctgctaaccttcctggagtgcatacaacatgccaggcactgcatacgtgctaattctattagtcctcttaacctttaccactctatgaataatatacaattattaatcccttttgcagatgagaaaattaaggcacagaaacgttaagtaactctcccacaattacaaagcatggaagtggcaaacccataattcaagtctagactctctttttccagagcctggactcttagccaccatgccaaagagctgtgctgtccactgctgtagccagcagtcacatgtaactatttaaattaataaaaaatttaaaaaacaagaattcagttcttcatttttactagccacatttcaagtgctacacacttcatgtggccagtggctaccatattgaacagcacagctctagagcattctattctttctgggatgattcagcatcaactcaggaagttctgttggatggtgatgcttacagagattctgtttcttacaaaatctcagacttcagttgtacagctttcttgcattgttattaatagatgcatacttatgatatattgaaatcccatttgcacttggccaagtagggtaatggcaagaaaaaagccaagaagcgtgacttacattacgttttcctgtttccccggtgcattatttcaaattcacaaagttgtctcctatcacctctctttgatatggggcaggaggcattcatcaacttgcccaaaaatccaggttcttccacatgtctgccttcacctctttgggctatctggataatatttagtgctctagcatagtaacctcacaagtgacttgaacaacggaggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaagccagtggaattagagtgcactactataaccttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgaaagaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccacttcctcatcttattagctaggaacaatctatctcaaattcacatgtgcacagagttcagtgcccagcacactaaagcatgttcagtaaatatgttagctgatgttattttcaccatatgattatgatcactctctgttctactgatgggttttataaacccaccagcattgaaaagagatgagtagatgtgctaaaatgagagtaaaggctcagtttatcattggtgtttatcccaaaaaaaagactagcacaatgctcaccagattataatctcccaagtgcctagaacatcatgccaagctagtaacatagtaaagtttattgaattttgcaagtatttgctgagccctttgcctgggctagatactgtcggggcaccagagggatttagagatgattaagacttggcccagcaagaatgttcagtcagccaagggtattcagccacaggagctggacctggaaagagaggcagaatttccagggtggaggagcttcatctcgaaagacacacagaattcccagagtacaatcatggagaaagggcattccaggcttggcaaaccaaggagcacaagcacagagggccgaccacacatggcagcctgtctggagagctccaaggagattggtatgactgggggtacgtgacattatggaacgcaaaacctggctgctgagagggtggatgtgcttgcacttgcatctctagtcttggtgcgagccattggaggatttttcaggggaagggaaactgggctgacctggttccagcaaactctctgacaatcatgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacgtagagtgtgtgataagcatttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgatggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcatttgtaaaataagggcaataatagtccctttctcatagatggctatttatacagatcgaataagaccaaatatttaaagaacctgggttagtgcctaaagcacagcaaatgctcaataaattcagtggtggcaatttttattgttatttcaaatattacatcaaaatatctactgaactattatccattgcaaagacttgcccacaataggtgcttagtaagtgtttattgcaataagttgaagtgattccaactatgtagcttagatttcgggtatgagtgtttccttctccactgggatgtttgctaatggacatagatgatcactcacagctcaggtattaaaagcaggagagtagaggtgttccttcatgtagaaagaagagcaacttctcatcaaggcaggcttccagctggtcctttggacaccactgttgctaagcacttggtgtgctcgtcagggtaccagggctcttagcagccacccatttgcgttttgcagcttttgctgacatggatatcaagtatgaagttattttaattgcctttggctgaaaaaaatgggtcatatgttcaatatgttcaattctggtgaaatccctgtcttctaaagcatgatagaaaggggaggtcccacccacacacaagtcctaaaatcttggggccctagtggggtatagttcaacaagggctgcagctcaggacgtggttgttgtgagatttactcgtgactgtttggttttgcactcaccatttggttttgcagattcctcagcgtgttcacacacacatacctacaaaccagtttagagttgtgtgctccattgtggggggtggtcactggggtggggtggggtagggtgggatcaggcttggtcaaagtcattgctgatgaaccagctatctgacttagctttgttcccattttcaacaagacagtgatttctcaagccaggggagtcttcacatgagatccatggatgggtattaagtggtccagaaaacccccccaaattagatgtaaaatgttggtgggctggaaagggggagacaccataagtgctttttctgtggagagaaaccatagcttataactggttctcaaagaagtctatgacccaagacaagctaagatcacaaagctgtttggtttcgttccaccaaagcagttggtgggtataaccacaacacccagatgacccagctagacactcagggcagtgacaagatcagtcagaaccattttgtggccaagcagctgatggattgttcaatcggttgttgtagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacaggtaagtcacttccccctgagcctcgctttcctcatctgtcaacggggcacagtcccctgctcagcctgcccgcctgcctcacagggttgttgggaggaacacaggaggtgacagctccgaaggtaaagctctgtccacccatgagggacttctagtgcttcctgggcctgcttgttctctactttctgcccggcattctttggcaaagggacaacccaagcaagcagagtgctccaggtgcctcagccccacctccagggaaatgagtgggggattgaccagggtgcagctgctctctccctcagctgtatgccttccagtaccccgtttccatacctacctgcctgtctgtccctgaggccagactgggaacctgagggggacaggggctgtgcttctgcacctccgaagccctgcacctgatacctgcctgcttggcacctagtgggtgctcgggaactgcctctcctgccagccatctgctgtggattccaaaccccgcccaggactcccacaccctagaggcaggaagttggattgccctgctggaggactggcagtctgggtagtacaggcagaaggaatccaaagcaagcttgtccaagaggcctgtgagttgggatcatcctctagattctagagtctagaaggaatggcttgacttgcccccagagtcgcatcagtggtcatgagagcaagcggatggacaccagccagaggggacctttgcagagaattgcatctggtgcataaaatatcaatgtgcacaggatgtctgcactatctgcagagaaaactggagacatgaacattttctaagtgatagtgatcagaagatggtcattaagctgaaagggcctcccaggattctggcctttaatggaaattcggctttggtatgtacagccttgttctctttatcctgcctgccctggcctggaagaacaagcagtgctttcctttcaagggctattgatttctctctctctcagagtcacagagctcctcagctgttcactcttcagctgaaaccagagaaatcttgtccagcacaaagctgccagggaaacagaattagcaaaacggacgtcgtcccctcaggatgtcgctgtttccaccctggtctgccttgcctttccctgtctttggaagccacaaatgaaaggatatcagctagcttgccttgagaattattgtccctcacctattctctctcttctcaagccaacagctttcacccagcagtgaagtggcagagcagatttgtggccccaaatcttctctaagaaccttggaaattggccccacctgagggcctttgagggtcaggcctggcatccactaaatcctccctgtcaacacagccactttgtcagtccagcctgtgagtcagtgcgagacagaggatgcaggcaccacaggggaagaagaaaagcaagctggaaatatatttgtttcctttgcccgggatcattcccagcatctaaaccaagttcttcccagaccggccaagactgaggaggagtcagaatagagtttgcagcagtcatagatcatgtgggaagacagaaaacaaagggtaaaaagaatttcatatacagatctctgccgtttgctttcagtggcattcattttgtgaagcccccagtgacagcttcagaccagttcaaacctgagggcagcatcattaccatgggtgaggtctctagaagggcaaggaaagacccctaacatagaaaatggtgtggcagtttccagttccccattggggtcccatgacttgaccttaggtttctgccagcacctgcccaccctccatcccttcaccctactgggtggtcattagaacattatctgctttgattgatttacttgtgtccataagagtagagacacacggtgttatccccatgcccggaacagagcctggcccatagtagacccatgaccatgtttgttaactgagtgacagagggactgactggactgtcatgtaagcaatacc

SEQ ID NO: 16077 - DNA, 15595 bp, Human
agtggcacaatcatggctcactgcagccgtggcatcctgagctcaagtgatcctcccacctcagcctctgaagtagctgggaccacaggcatgcgctaccatgttcagccaattttcaaaacattttttgtagagatggcggtctcactatgttgcccaggctggtctcgaactcttgggctcaagtgatcctcctcgttagcctcttaaagtggtgggattacaggtgtgagccaccatgcccagccagggcctgcaaattaaactgacaaaagacagattaacggaacagaaaatcagcatgggcatataagaactcaacaacaccatcgactaatagggtctaattaaactttttataggacactcccaaaaaaggcttatttgcatggatgctggagctagcaaaataagtagctagcctactaaatggttagaggtttatgtctgggcgcagtggttgatacctgtaatcccagcattttgaaaggctgaggcaggaggatttcttgagcccaggagttcaagacccgactgggcaacgtaatgagaccaaaaaatgaaacagaacaaaacaacaataacgaaaaccacacaagaaaagaaagaaacaaaaaaccagttagtggcttgtgtgcctaactctaggtaaaacggagaggtgacgaaagtttgtatgagaacaaataggattctttaggacagacgaatgggttttgggagaacaaacacgagataagaaagggttttttattttttttgagacggagtctgttgcccaggctatagtgcagtggtgtgatctcggctaactgcaacctgtgcctcccgggttcaagcgattcttctgcctcagtctcccgagttgccgggattacaggcgcgcgccaccacgcccggctagtttttgtatctttagtagagacggagtttcaccatgttggtcaggctggtctcgaactcctgactttgtgatctgcccgccttggcctcccaaagtgttgggattacaggtgtgagccactgcgcccggccgatagttttttaaaaatgtaggtgctagtggtcttactgtcttcttcatggacatgaaattattctcatataatgagaattaaatatgatccttcatgtaaagagtttagaataatgtcagaaacaaagcaagcaataaattatcatttagttgataagaatcattccaattcatctggcgagtgcaacacacacacacactgtatttgtgtatggaataactgttcaagaacacacacacagtatgtgtgtatgaaataactcttcaagaacaaaggggaaaccgttatagggcatgaaaggggaaaccgttatagggcatggaaggggaattaggacaaggtgtgagtggaaagagaaacatcccaccgcacacgcttaaaaaagccgtttaatttaaaaataggtaatacagccatacagagaagacattaaaagatctacacagaaaattttcgctcccaatccattccctactcacagtcctacatacgttacttttattttccttttttttggaaatgcactggccccctactctctcacgaaggctgaactctctctacattcttctgcacctgttttttgtgcatactctttcgttgtcaaatatttccctccaactgttgttgtgtatgaaataaatacacacatataagctaaccagccccacttgcccgcaccacctacacgcccgtccccgccctccctcaggcccacgtgctccgagggccgccttcgcaggttgtttctggcgatgcctgtctgaaggcctcagactgaggccccgcccactctccctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggcgagccccctcccttccccattccctttgcctttccatgcctagttgggccacttcgcccggccctcctctgtcgctcagtctcgggcggtggggacgcctccgagggtgggttgcttcccctctagctttaggttaggcactccccgcccccgcccaaaattttgctgctctgtcctgattccccgtgttcgagtctcagcttctcagcatcacttgcctcgtttgtgtcagttttccttcttttcagcacttgtttatatcgaaggctcgattagcacctggtcttcagcgaatgagcgtttcgtgtatttttgttggtgtcttaaaagcacatgtgatctgcttaaaactctcctgtgatttcctatgccacacaggataaaaaatcagactctactgtggctcacatggtttctcttcaatctcgtttatgctctctgtctttgtgtatgatgttcactttacctcttctagtgccccaaatagcttcctgcctgtttgcttttcctggaatttgcttctttcccgttcttttcctgattgtctcgtatttatctcattggcgtcacagtctaagcgatctatttcctgttatgttttctagtagcacattaactttttttaatgtgtgtaatattgattattttaaaaaaatcttctccctcattgtatgttaaaccgccagagggaagggattgtgtgcttggttccccggtatttacacagtgcctcgcacataagtatgctcagtgaatattttaaaaatgaattagaggcggggagcggcgcctcatgcctgtaattccagcattttgggaggccgaggcggccagatcacctgaggtaaggagtttgagaccagcctggccaacatggggaaaccctgtctctactaaaaatataaaagaacattaactgggcatggttgcgcacacctgtaatcccagctactcgggaggctgaagcaggagaatggcgtgaacccgggaggcggaggttgcggtgagctgagatcgcgccactgcactccagcctgggtgacagagcgagactccgtctcaaaaaaaaaaaaaaaaagaaaaaagaattagaaatacccgactcttgtgttgcatttaactcttcattttgcaagttgcgttcacacacgtcatccattataatgtcccaattgaatacttgggtttaatgggtggctattattctttaaagggtatctgaggaatctaaggctttttagtgactttttgaagtcttacagaggaaataagtggaaaagtcaggattcaaacttggttatgatagatcacataagctatctaatgtgttttgtgtgagtgtatgacaatgattctgttgagtatctgatttttatttttaattctctctaggaaatcagaaaagttgtacagagtttagaacaaacagctcgagagattttaactctactgcaaggggtccatcagggtgctgggtttcaggacagtaagttctttgttttgtatccaattatcagtctcttatttagagggagagtttctatccagaagacattttataatgaaaaatggctatcatgctttatggtgagtaaaaattgaagaagtaggtgatttgataattttggttgatttttcttccacttccacacagtatggtttaaacagagatgttttctattgcgagggcattctactgatgataattacaattgcttaacccatttcctgtttagaaaaaaaaagtgcagctctctgccagcacagtattctcagggtaagcgggaaaagggtttattattatttttttaattttttttttttctgagacggagtttcactcttgttgcccaggctggagtgcagtggtgccatctcagctcactgcaacctccgcctcctgggttcaagcaattctcctgcctcagcctcctgagtagctggtgttacaggtgcccgccatcacgcccagctactttttttttttttggtatttttattagagatggggtttcactttgttggccaggctggtcttgcactcctgacctcagatgatccgcctggctgggcctctcaaagtgctgggattacaggcgtgagccactgcacctggcccaagggtttgtaactcttttgtgttatctagtgacttttatttggccctttgtgtgtgtgtgtgtgtatgtgtgtatgtgtgtatatgcacctgtgtgtatttgaatccagcctttcagtgattgaataccttttaatatgagattaacagtataaaatgttctcaaattaatgtgtttataatcagcctcttgaatgaaaataaaatatgtcaagtttagacatggaaccttcattgtaaggtattgccagcacagctaaaggagctgaagtatattttcagatacaagaatgatataataatgcatttacacgtgccagaggcaagtgatttttcttaatgatacggagttggtcatcctgattgtgaatacttggtaaaggcttttttctgccaaatatgggaggaagaagcaatccaattttaggcatcctctgaggagtgaacaggaatagcagctggtgtgcatctccttaaggatgacgttatttatgacaaccaaaccaattaccagtgtgtctcctaatatattcccttttagcaagttgtttatttttcagtatagctaattagtagggaaactggggatgatattttgaaagccaggttgaaaagcacagatgtgtacgttagttgtgaggtttttttgttgattaatttccagatagattacttagattattaagcaagaactgtatttgaaatttggttaagtttttcatttggttatcttttgtgactagttccaaagaggtgtttgaaagctcgagaacattttggtacagtaaaaacacatctaacatctttgaagaccaaatttcctgctgaacagtattacaggtttgtaagaaaaatagcattattttataatgttaagtaaaaaaaaggagaaaaattatgtgtaccaaatgattgcttacaactaggcaaacatcctgtgtagaagtaacaaaaagagaaaaaaccgaactaataatggtcatgacaaaaattggtgattttatttttttcttctttttactgtctaaatcttaaggaacatgtattacttttgcagtgaaaaagcaattaaaaagaaaatgtggtatgagggtcaaaagtgagaatatctttttgctatattcaagtttcttgtgaaattggatgaactatagttagtgaaataatgagattaggtggcagtatatatatggagtcgagttttactttgaagcttgaatttcactgccaagtgatgtaattagctaatattttatgccatgttttcttattaaaatcaacactgttgattttaagatacaccattattttatgtaccagtagggaaggaaaattttgccagtcataaatgtgaaacatgggccaggcgtggtggctcacacctgtaatcctagcactttgggaggcctaggtgggcagatcacctgaggtcaggagtttgagacagcctggctagcatggcgaaaccccgtctctactaaaaatacgaaaattagccaggtgtggtggcttatccctgtaaccccagccacttcagaggctgaggcaggagaatcgcttgaaccaggcaggcggaggttgcagtgagccaagattgtgccattgcactccagcctgggcaacagagtgagactccatctaaaaaaaaaaaacaacttgtgaaacatggattgtgaaatgtctcctggtttcataggtgttaaactgggaaaaactgcacctgaatcaaaagtttctacttattttaattttcttactgaaaaagatgttcttttaagacgtatatatcagcagtaaataggatgagtattttcagggggtgggtagtataaccttatgagaatattcttttaagggagaggttgacaaaccactagtggctgctgcctctgggagctaagaattgcttttgttttttcaagagttgttaaaaaaaagaaaatcccagataagaatatgtaacagtgaaagcgtcccacaaagcctaaaatatttactacttggccctttacagaaaacatttgctgatccttgctgtaaggcaggggttcccaacccccaggccatggactggtactggtctgtggcctgttaggaactgggatgcacagaaggaggtgagcggtaggtgagcgagtgaagcttcatctgtatttacagccgcttcccatcacttgcagtactgcctgagctccacctcctgtcagattggtggcagcattcgattctcatagtagtgcgaaccctattgtggactgtgcatgcgagggatctaggttgcatgctccttatgagaatctaatacctgatgatctgaagtggaacagtttcatcctgaaaccatccgccccccttctgtggaaaaattgtcttccatgaaaccagtccctggtgttgaaaaggtcagggactgctgttgtaatagctgaagcacagagagaggtaggacagtagaacaggtggggtctttagagaccatcttctctggaggtcacacacaggctgccctctggctggatttggccttcagaagggtttgtgtgacctgcattatgttgagaccttttttttgaatgtattgccacatttgagaatcaggaggcattgcataaatatccacaggttgtaaaatttccttttttcaggcttctagctcagtattctattttaagtgcatttgtttagtgattgcaaatggtaattttgtgaatcagaattttcttggtattctgcactcaaatcaaaatggaggaatacgttgaggatgatacataactgcagttgtcttcaatcatcagttacaaatttttatttttttcagagcagtatcactgttcttactgattaaatttagaaggcacaattgctcttgtcatctgtaatcttcagttttcttttttctgtctttttttttttttttttgagacggagtgtcgctctgtcgttcagggtggagtgcagtggtgtgatcttgcgcactgcaacctctgcctcccaggttcaagcagttctcctgcctcagcctcccgagtagctgggactatgggcgcctgccaccacgcctggctaatttttgtatttttagtagagagggggttttgccatgttggccaggctggtcttgaactccttacctcagattgatcaacctgcctctgcttctcaaagtgctgggattacaggcgtgagccatcgcacccggcgtaaattttcatactcatcaaaattagaccatatttgtcactgattaaacttaattgttataaattcgaacttgtaaaattaatgctaaatgtcatatttctctttatatattgggggtttgtgtaagattttatttgaaaaatgatcgcatttctaaaccgtttgaacatggctgtattaaacccatctttctgaaggtccctaaccttggaggctaaatgtgcttattttcatgcagatttcatgagcactggaggtttgtgttgcagcgcttggtcttcttggcagcatttgttgtgtatttggaaacagaaacactagtgactcgagaagcagttacagaaattcttggcagtaagtgtctttattagtgggatctgcagaatcaggcatggttgcttactttttggtggaaagggtggttgtactttgtttattaaaacaaacaagaattaactaaaaaccacttatagttgtagcttggtatctgaggatgatgcttccagagctcttccaatacccaaatctgaggatgttcaagtcccttatataactggtgtagtatttgcatataacctatacacattctcccacatactttaaatcatctctagatttcttaaaatatctaatacagtataagtgctatgtaaatatttttttttttttgagacagagtctctgtcgcccaggctggagtgcagtggtgcaatctccgctcactgcaacctccacctcccaggttcaagtgattctcctgcctcagcctcccgagtagctgggattacaggtgcctgccactatgcccagctaattttttgtattttttttttttttccgaaatggagttttgctcttgttgcccaggctgtagtgcaatgacgcaatctcagctcaccacaacctccacctcctgggttcaagcatttctcctacctcagcctcctgagtagctggaattacaggcatgcaccaccacacccggctaattttgtatttttagtagagatgaggtttctccatgttggtcgggctagtcttgaactcctgacctcaggtgatccgcctgcctcagcctcccaaagtgctgggattacaggcgtgagtgaccgcactcagccaattttttgtatttttttagtagaaacagggtttcaccatgttggccaggctggtcttgaactcctgacctcgtgatttgcccgccttggcctcccaaagtgctgggattacaggcatgagccaccacgcctggccttttcccaaatattttctatccatagttggttagcgcagagggccgactctacctggaaatgtaaaagctaaaaataacaatggcaaacacatttgcacttgctttagtttttaaaattgaatttttaaaaatttcaagcctacagaaaaattgaaagaatagtacaatgaatacctgtttacatgccacttagatttaccacttgttaacattttgctacatctgcttaatcttctcattttgtgtgtgtctttgtcagccatttgaaagttgcaaatatcgtaactcctttctgaaatgctttatcatgtgctttctaacaagaagtatattctgtgacacaactagatactgtttttgatagtatttttgagggaagactgaattgaattttgcttaagaactcaaaaaatccatagtgaggtctagttgccaaggttgtgaatatattaaaaagccagtttttaaaagattcatcctttcttcacttactttgggagaaattatgtgtatatttttatattctgaggcttaacttgcattcacagcatgactttattttcatgtgttttttagttgagccagatcgggagaaaggatttcatctggatgtagaagattatctctcaggagttctaattcttgccagtgaactggtaagctcagtaacttgctggttgcttttttgatctttctgcttcactgtcagtttttttttttttttttttttttgagacagagtcccgctctgtcgcctaggctggagtgcagtggcgcaatctcggctcactgcaagctccgcctcccgagttcatgccattctcctgcctcagcctcctgagtagctgggactacaggcgcccgccaccacacccggctaatttttttttgtatttttagtagagacggggtttcaccgtgttagccaggatggtctcgatctcctgacctcgtgatccgcccaccttggcctcccagagtgctgggattataggcgtgagccactgtgcctggcccactgtctgtttttaaaatgggtaccaaaattcagaacgtcttaattcttttctaagccatctctcggtcaccaggtagtcactgactggcactgtatgtgttacaatttactaggcatcagagaaaagccagatcaaatgatgagtgcatacttactgagttaagaatttttaaccgatgataagacctcttccttttagggtagtggcaaaacatttattcctggtaactgttaatccatgtaattgttttggacactcatttgtctatataactaagttattcttatcctttattcctttaaccactatctagggaaattgccctgtaaaagtctaaagaaaaaaaaagctgtcagtagcaaaattgagtagttgtgatagagactgtgccagtctgcagaggtgaaaatatttactatctggctcgttaagaaaaagtttgcttgtccttgctccagaggaaagcagtccagggctggtctgatgattccttgatctttggccctaggttcttctagcttcagcttctttcttatgttccagaactgttgctctagtcacatcttcactctagccagcagtaggaggaaatagggaaaatggtatgccctcccgctttaaggacatttctttgaagttgtacacacaacttctgttaacattctggtgccttgcctgcagggaggcagaaatggagtctattggagtgggtatgtgtgcattgaaaacctgaggaagatggtgagaatggatgatggggtccacttgtaggctgtaccacttgtctggcttgttggagacacctgaccagtaaacaggaagcatcttgttagtattagttaagtgtaaggtgtctttaggaccatacatgttggggccgggcacagtcgcttacgcttgtaatgctggcagttttggagaccaaggtgggaggatcccttgaggccaggagttccacaccagcctaagcaacaaagcaagaccccttctctatattaaaaacaaacaaacaaacaaaaaacccgtatgttgacagtgcactaaaggggtaagcctggaaaagtggagaggattttacagaaaggggaatcttttttattattttaatatattttttaaagccagtcaaatggagcagtagggggttgtatactgacaccgagaaggggagtcttgggttgggtcttgaaatcaatgttagttctccttcaagacagggttacactaacataattttagattcttatcccaagtctgccttacttgattctaggtgactggagttgcagcttagtaggtgggctctagaaatgtgatcatttggccaaggttggaagaggtagtggagctgctgtgattattttgtcgtttctttcttcgatatgatagcagatgagctgtaaagatgcttgtgtaatgtaacactttattatgcaatagccagtttaagaaattagagaaattttagatgttagtaatgttaaattttacttggcagaactggtctcattttcagtgggattcttttcagagaagctcctgtcttgtctgtacttgtgtgtaccctgagatagaagatcagcgtggctgtctaggcttgcggttcttctggttgtgattcagaggaagatgcgctgagaaggagccatgttgtaacaagcccctgttttctctttcctggtacagtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgtaagtgagtgtgctgctgtaagaaatctcccatgtgcataacaaattctgaatattttttgaggctaaagaagaccggggtgacaagcagatactgctgtgtaatggttacactaaccaaaagacaccagccactcagagttctatactgtaaagcgcagataacatttgtgtgttataccttgattggggaattaaaagtcatttaactgaagatgttgagaaacctgggctctggttttagtataccggaattacttttttccaattttagaaaatcaagcaggttagagaaaatagagatgaattaggggacactgtcttatggattcatttataagaagagaaccagccatatacacttggggagatttgccacatcttaaacttgaataatagtatgagtaatgcttaagggagtttaatagagaaggaaagctttggcagtgttttgagaacttaagtggctaaagagatgagacaaacatgcaggtcgctactggcatagtttcataattgtgtactcggaaattaaagtttgcttgtttcttggtctggattaaactgtttgtcctccttttcagatagagcatcacagtcagggctgacaccaaaataagactttccctgagcctgaaataatttttttttttttttaagtatctactgtaataagcatcaaacaagcagaaataaacaatgtcccttcccctggacaacaacaacagcaataacaaacatttaaaggcggtaaaattgccaggactggtgggttggttgagtgggctgggtgcgggtagtaggacgagatgggacgggacggggaggaatctagcatcgctgccaggtttctggctcaggtttggtgccattcactgaggtgaggagtgtaggaagatcgcatgtctggagggggctgggcagctgatgcatttgcttttggatgtgttggatttatgacactggagcggcaggtggataaatcaaaagtgggtaagatctccctggagaacgtgtagaatgagaagagtcacaagctggggacaaattcttggttaacagcatggcttaacaaggtaggcagaggaaatggagtccatgaggaagtggagaaatggtcagagaggctaacagaatgggaagagtggcttgtttcagaagccagggaataaagggtcttaagttttggggtgagggatttaaaataatctacagcctgggagctccatgactaatctgtcaggttacgctaggttatcctgtgggaacaccaccagagctcataggcaaagaacaaggtttctcactcacattccctctccattgcagcttagctggggatctgttccacgttgtctttatgtagggtgacagagcagccactaactggaccattgctagttttagtgggagagggagggagctgtggagtgtcttgcacaaatacatgatctggtcactctgacaattattgtttttttttttttttttttttttggagatagtctggctctgtcaccagggctggagtgcattagtgcaatctgggctcactgcaaccttcacctcctgggctcaagcgatcctccctcttcagcctgcctagtatcaatagctgggactacaggtgcaggctaccatgcctggctaatatttaaaattttttatagagacagggtttcactatgttgcccaggctggtctcaaactcctgggctcaagtgatcgtcccactttggccccccagtgtgttgggattacaggtgtgagccactacacccggcttcaattcattgtttaaaggtagacacgtggccctgctaaaccacaagggggtcggaagtgaaatcctatcttgtaggatgagagtcaggaatggatagacaaaatactgaagtttgggggtatgtttagttcaatttgttaaatatatagttgtaatacttccatatacacatgaacaccaattggcttgggagggagagaaggtgccccaggaccact

SEQ ID NO: 16078 - DNA, 39295 bp, Human
tagatagtaccagctcactgaagctaagcactggttccttttacattattgctggtttacacttcttgtaggaaggagaaggtaacaaatacattgatttattgaaaggtctttattactcttaggctgccagagcaagcaagatggaatatttaccatcttggtgaagtaattatactttagagttggcacatagtaggtatttaataagtagttcctgaataccgaaagcattgcagaaggcattgcagaaggcgaagagttggttgtgtggagatttctgttaatcactgtcttcacgagaagtccattgtgagaactggcagataaaaagctaactgtattcttattttgcattaagataagcatggcatccctagagtggaatgcagttcactctgttctgcattgaccttagagtgttatatttagttttaatgacccatttcattgaagatttattaataaaatatctgttgagagcatggtgaggggtctagagatattaatttaaggactagttagatggaaggacctagcgtatttatatgaagaatagtagggcattaatatataatattcatataataggattcatgaaaacttttttgaagtacttgaagggttgatatgttgggggagtaggtgagtgctttcacataccccgaaagaataaagaataattgcagagaagtgtggtgttaatgaaataacagatttaagaggaggaagcagaaagctgctagtagtaaggcgggaagttgaaactagaatgtggccagtagtagtttgtaggataccttgaaaagtctcaagagatcattttcttggggcaggaggaggaaggagttatgcttggaaaatgttcagcgattatagataacattcaggaacatcttggccttgagaagaagagatattaatccattatttttccctttatttaatagctgttgaatgactgttgtctgctaggcactgttgtagactctgggaatatggaaaacataatcgtttacttcctaccatcaagtggaaaagacaataaaatgttataaatttttaatgtctggtagtgttaagtgctttgaagaaaaataaagcaggataagaagataatgccaggggagccattttaaattagatggttaggaaagatctctctcagttaacacttgataaggaatctgaatcatatgaggggtatcagaaagggtcaagacaaagggaaaacttgaagtatgggaatagcaggggtgagtgaagaagagaggtaggaaatgaagttaaatacttggccagggactggaggccagatgattttataggtcttgctttttgggatgagaatgcattggaaggttttgaacagaatgatactaggttttacttaacagtgttaactctggtgttctgagactagattaaaagtgggcaaaggtaaaaagcaggcagactggttaggagtcttttccagtcatttaggcaagtgatgatggtggcttgaatcaagttgatagcagtgaaggtgctgaagtggttggaccccagagttattttaaaggcagtggcaaccatattttcttggcagtttggatgtaaggtttgagagagagagatcaaccaagatttttttgtcttatacaactcgaaggaagataaagaagcctctaggagaggcaggttttaggtggaagatcaggaatttatttttagatatattaagaaaaatctaaatggtcatgtcagatgaacagttaaatatgagaaaaaataatagtagacgtaaaataaaagcttattttattatccctacagtaaaataatgttgcctccagaccattttaacataaatatggtaacatggggataatgaatcttttggaggctagagtttcttagcatctaatagtagctttgctctcaacttttacggtatgttttgttgtttaattatcaaaaccacttttatcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaaggtaagagtgtttttaaagctattttttaaagtctttttaaaaaaaaaaaaaaaaagacagagcctctgttgcccaggctggagtacagtggtgtgatcatagctcagtgtcacctcaaactcctgggctcaagcaatcctgcctcggcctcccaaagtgctggggattacaggcatgaactgccatgcctgaccttaaagtcttaagtattgtatgtgttattttgcccatttttattggactctttcccatcctctcttcacggtagttgagacctcactttcttgtattgaatgtgatgttcctatagttactataattctctcatcagttaaaattagctaagtggggccgggcgcagcagctcatgcctgtaatcccagcactttgggagaccgaggtaggcggatcatttgaggtcaggagttcaagatcagcctggccaacatggcgaaaccctgtctctactaaaaataccaaaaattagctgggcgtggtggtgtgcgcctgtaatcccaactactcgggaggatgaggcagagaattacttgaacccgggaggtggagcttacattgagccaagatcgtgccactgcactccagcctgggtgacacagcaagactccgtctcaaaaaaaaaaaaatagctaattggtttattagaagggaattttaagtgttagaacattttcacatacattttttttacaagcattattttctccttttgtccatataattctggtttcttttagcttaaaaaaattttttttctattcttatttcccgaaatgaaaggttttagtatgtattgaatgaaaaaggattttatggtcaactaagtaagggaaagctggtttaaacaaagacaaaagtgttcctttattgtaggagttttcagattatgtaatatgcttatatacattttcagaagttagtagtatgcagtgttcccagactcatttgttgacaaaattatctttatggaaataggttttgaatgaaaaatgtttcggcaaacacactgagtagaattatagtagtagactgtatttcctattcttcaacctgccttctttgttaatatctctgctgaaattttctctttaggtggttaccagtgttttttactgtggaacttacttgcagtgtatttaatcttgacctcactgtttagcactgctacccacaccatccttgtttttaaatacttttacctcttaacatctctgacactgcttaacctagttttcttatcactaacagttttttctctgtctgtgttagggttgggcttaaagtaatgccagcagatataatagaaatcttaaaatctgagtggtttaatagttgagaaatctttcagggatccaggttgaaagaagctgttaccttcaacacatggcttataagctcaccataggcattgacattggcaagcagatgagtgaagacagagtatgaagaatcatatgggagattttactcactaggcctgatggtgttgtatgtcatttctgcccttatgacattggtcagtacccagttacatggctttgctaagatgcaaatgggttgggaagtatagtccctggctgagcagccacttagcacaacttatactgtggaagagaagtgtaaatcactggtgatcagttaaattgaccatctagctaaaggtataattctcctttgtttttgtgatgtgtagtctaagaatacccaaaacaaatttttgagagttgcccatgttaagaaacaataaaggatagtacttttttcctgttttcttatgcttatcatacattgatttgcacctctgtgactttgaaatgtgtgtcttaatttgatcagtgaattttttttttttttgagacagggtctcactctcatccaggctacagtgcagtggcatgattatagctcatcataacctttaactcctgtccccaggcaatactgccaacccggcctcccaaaggcataagccaccatgcccagcctacaattcagatttttaacttttttttttttttagcaaagtcccaagagtacttttttttttaaattttgttttaattgacaaataataattgtacatatttatggggtacatagtaatgtttcattacatataatgggattagatcagggtaattcgcatatccatcacctcaaatatttatttctttgggttagaaacattcaatattctccttctagctatttgaaattatataatatgttattgttaactgtagtcatcctatagtgctatagaacactggaactacttctatctagttgtacttttgtgtcttttaataaatctctccctatccctcttttcccctaccctttgcagcctctactgtcatctgttctgctttttacttgtataagatcaactttttttagcttccacatatgagagagagcatgtggtatctttttaacttaatgtcttccagttccatccatgttgctgtgaatgacaggacttcattcttttttatggctgaattgtattccattgtgtatatataccatattttctttatcagttaatctgttgttagacacttaggttgattccatatcttgactattgtgaatagtgctgcagtaaaatgtgagtgcagatttctcttcaatatactggtttcctttcctttagttaaatattcagtagtggcatcgctgaattgtgtgttagttcgatttatagttttttgaggaaccttcatactgttctccctagtggctgtactgttgacattcctaccaataatgtgtaagagttcccttttctcttcattcttgccagcatttgttatttatctttttgataataaccatcctaactggggtgaaccttgttgtggtcttcattttcctgatatgtgtgcatttccctgatgatttgtgattttgagcattttttcatatatttattgaccatttctatgtctttttttgagaaatgtctgttcagatcatttgccgattttaaaatcggattgattgttttttagctgttgagatgtttgagttccttctatattctgaatattcatcctctgccagatgagtagttgtatttcctcccattctgtaagttctcttttcactcttgattgtttcctttgctgtgcagaaaagttttccagtttgagataatcatatttatttttgcttttattgactgcacttttgaggtcttattcatgaaatcttttcccgacctattaaagaggttatccttttcctaatgagtggtcttgtcaaaagtcagttggctatagataacatggattatgttcttttgttctatgtgttctattgatctatgtgtttgttctcttggtcaatgggtctgtttttatgtcagttctgttggtctgtgggtccgtttttgtgccagtccatgcttattacagctttgtagtatattttgaggtcagtaagtgtgacaccttcagctttgttctttgctcagtattgctttgactgtctggggttgtatgtagttctgtacaaattttatggtttgtttttaaatttttatgaataattttattggtagtttgatagggattgaattgaatctgtaaattgctttgagtaattttgtcattttaacaatatttgttcttatataagcatgggatgtcattacatatgtatgctctttggtttctttcatcagtgttttttttttttttgtagaggtttttcatcttcttggttaaactgcttcctagatatttaaaaaaatttttgtagctgtggttaatgggattgcattttttattttttattgtatgtgtatagaaacactacttatttttgtgtacttattttgtttctggcagctttattgaattcatttattggttctaagggttttggtagagtttttaggtttttgtttatataagattatgtcatctgcaaacagggacagtttgcttccttcccaatttggataccttttatttttttctcttgcataattgctctggctagtacttgcttaactgtcttttttttattttttatttttttgtcttgagacagggtcttgctctgtctcccaagctggagcgcagtggtgtgatcatggctcattgaagccttgaactcctgggctcaagcagtccttgcaactcagcctcccgtgtagctgggactgcaggcatgtgccactgcactcagcttcttattcttaatgtttatcaaaatgggggtctcactgtgttgcccaggctggtcctgaactcctgggctcaagcgatcctcctgccttggcctgccaaagtactgagattacaggcatgagccagtgtgcctggcctttaactgccttttttcccacttgaagatgctttgcctttatctcaaactgacctcattgactggctttctcttaactactgtttagggcaaaggtcagcaaacattttctttaatagatcagagagaataaatattgtagctttgtgggtcacataaggcctctgtctcatcttttttttacaatgtaaaaaccatttttcattcacagacctataacaacacagggattttgtccgttggtcacagttcatggacccttagcttgaggtgtcctcgttgtagtttgtcttccacatttagttacaactttgtatttcatgggttttttttttttttttttttttttgagacaaagtcttgctttgtcgtttaggctggagtacagtggtgtgatcttggctcactgcagcctccacatcccaggttcaagtgattctcctgcctcggcctcccaagtagctggaattataggcacacaccaccacactcggctgatttttgtatttttagtagagacggagtttctccatgttggccaggctggtctcgaactcctgacctcaggtgatccgcccacctcagcctcccaaactgctgggattacaggtgtgagccaccgcacttggccaaaaagtttttgattgttttgatttgtgtccgttagattctgttagtagagtggagggatggcttaggtaaagttcctgccatcagagatactctgtttctgttgtaggattcagaaaagaaaaaaagaacaggaagttttcttcttttacatacatactttattttctttaaaaaatgtgtttatgaaaattgaacattaaacaagtatgttatgggaagtgggtctggctataaggagctaaaaacagttataaaattctcagttttgtcatctttgcccaaaataaatccaactaattagtgttaaagtaggtgcagcagagcatcccagaagtagtcttgtggcctccccaggacagaactcctccccacccaactgtttgtgaagacaccctgcagaggtccctgatgaactccttgtctctggctgcttttctgttcttgctttctttagagaatgtatttttcccttagccctttgaaagcttttgagacacacagttggtatgccaattatagcattctttatccctgagatctgggggatttcacggtcataaatacacactgttttgaatatataaatatttttctggggagagttgattgttttcatcttaatatcaaaatggtcagtgacctgaaagaatttactgtctatccattcattaaagcagttttgcaacagtagtgttttactctacctatgattaagatttgaactttgggaaacttttttatttcttggtaaaagatgtaaattttttggaatgaaaagatttcagtctaaaccaacaatttatgatattgctctctatgaatctcttactagtgactaataaatattaaggcacttaatggattcactttagctgtattttttcatgtggatatgtgtaaataccttgccataagagtaataagcaaaattgatttagtatatttttgaacaaatgcatttttgctagacctttaaagtttaaggtttctatgggagagtccaactatgttctacaatctacattttggatttttaatttttactagtttactgcttatacaaatctgaaaatttaaaaaattaaaaaacaaccttttttttttttaaattccagatggagatcttataacaatttttgatagttctgacctttcctttgcaattcagtgcagtaggatactgaaactgacattatttggtgagtagtaaactttctaatgaatttactattttattcattgtattttaaagatgtttggcttttttccttttaaagactcaggtaagcaataacttattcaaatattattacatttatttgtgttcaggtagttgttttagattacttgaagcttatggctgtgtatgtttttaagaaaatgatagaagtttaattcagtaagaacagagtgttaagtatgttttttttgaaatcaggtataacttaggtatccctggtgcagtattatagttttaatttagctgtattagaatttttaaattgtaattatcttccttcacattacagtatgttgttacttattatcagggcttaacatgtaagtctgatacttgaaaccagtagtcgccaacctttttgcactggaaactggtttcgtgtaagacagttcttctatggaagggggcaggagaaggtttggggatgaaactcttccactttgcatgtgcaattcacaatagggttcacactcctatgtgaatctaatgccactgctgaactgacaggaggcggagcccaccacttaacctcctgctgtgctgcccagcccggtttggttcctaacaggccacagagtagcactgggttggggacccttgctttagacagtatttcccgaggggtacttaaagattaaaaatagttctgataaaaaccaatagaagactaattttaatcttttagattttttcttttagatcttaatagatatgcaaggcagaactcttaagggacaagatagaaaagattacagagttaaatggtagtgtgattatgtgaaaaataaaatgtgtacactttttccggctgttttgttgttttgtttagcattaattttatttttttttaattttgttgcatgaaacttagagttcagtgtgaaatatgatcatggtctattgatttaatttgtatctatttcatctccatctaggaaggatgaatatgaataatcagaatttaaatgttaataacaaaaactgtttaaaattatttaaaataaaggtatctttttacagtattgaatgtaaaatacttaactattgactaggcataaagcagattagataatctgaagacccttactttaaacaggatctgctagataaacttacaaatgtgttttctgaattctgtaactcagcttgcacaggaaagtaagggaaatatccagggaacaaaaaagtagagggaactaaaggcctgatgtaccaaaagctgaaacttggggtgttcttggtggtgatagtagagattttagcctgcataatttaaggaattgccatctggtgtctacatggtgtaggcccttggtcctagtccctcagtaggccatgctttcaaaaagaatattttagaaaagtctaccttgatacagggaaagtcaaggaagcttaactcttataccttgggccgtcaggggcttgggaagtctcccttcaggattcataattgtggtccttaggtgagttgggtttaaatttaaactatccatgtagtttggtaactcccaagcccagatgttaccattttagaaaaatctcagaagaaaggccaaaatctctcttgaggggtatattctcaatccaggtcacataggtttctcacagacaaaaccgtaagacacatgaagctgtcaggtaagcaagaaccactggacacaactaatagcaggattagattttcaacaacttcagttaagatatgtgatagtctacaaaattaaaagttatttaagacatagaagaaggaataagaatataaaagcagccggccgtggtggctcacgcctgtaattccagcactttgggaggccaaggcgggcggattgcctgagtgcaggagttcgcgaccagcctgagcaacacggtaaaaccctatctctactgaaatgcaaaaaattagccagctgtagtggtgtgtgcctgtagtcccagctacttgagaggctgaggcaggagaattgcttgaacctgggaggtggaggttgcagtgagtcgagatcgcgccactgcactccagcctgggtgacagagtgagactccatctcagaaaaaacaaaacaaaacgagaacataagagcaagatgctattgtattatggaaaaacaataaacagattttataaagaacttaaagtaacttggaaatgagaaatataatcattgaaattaaatactaagtggataggttaaacacattagtcatagctaaaaagagaattagtgaactgaaaaggaaatccaaagaaattacagagtaaagcacaaaaacacaggcaaaagagaagttgaaaatgagaacatccagaatatttctattcagagtttcaagaaggagagaatgggagagtggaaatacattgaggtaatgactaaagaaattttcagagttatataaaagctatagaccctcagattcagaaggcacggggagccttgagcagggataagtaaaagtaaatccccactggacatattgtcatgaaactggaaaatgtcttaagacagagagattaccttaaaagtagccagagagaataagactgatcacatatgaaacaattagactgttagtagacttcttcatagtaataatagaggctaaaagacagtattatcacagttgcaaacagtaaagaaaaataactagaaaagtagcatcctatactccactaaatttcacgaatgaggagaagtaaaaatactttgaaagactgagaatttaccactcatggacccttgttaaaataatttttaacagtggtcttcatcaagaaggaaatttagtccagaaggtggtgaaagatgcaagaagcaatgtgagcagataaactgttgcttggtcagtaggctatgctttcaaaaactattttagaaaagcttttccattgatacagaaaaagtcaaggaagcttaactcttaaaccttgggctgtcaggggattgggaagcaccaatgaaatttatgtgtacgttttaatgagcattgattgttacaaaattaatagtcttagggaataaaaacaatttgggacaaaaatactgggcaataatatgtaagaaaggaagggatgataggaataaaaatattttaaggacttatttgggaggaacattgtaattacctttagatttttttaattgcatactacatatgcagaagtatgcatggtgtacatgtaagagttataattgaaaaattagacattgtcaggaaaggagaaaaaaagaaaacaagggtacctgttcagttcagtagaaagtggtggcggaataaaagaggtagaaagctcaatagatagaacagaatactaatcacagtacacagaaattgactacatatatcggttaaaataatctcttaatggaattttaaaaaaaatccagttccatgctacttccaagagacataaaagattattatgcaaagcttgaaagtagagggctaggaaaagagactagacaaatgcaaagaaagctggttattaacagaatagacttatataaaaacttgagtagtaatagtcactttatgatgataaaaagaataattcactaggactatatagcaatctgaacacttatgcatgttagctttagatgttttcccctaagaaaaattgacagaacaaagagaaatcaataaatttacaattatgggagagccgataaatcaagcaggctcaaacagcgttggtcttgtacatctagcagttagggagaaatacagtttttttttttttcgagtactcatagtgcattatagaagttgactgtaagtcaagtcttccagaaaatcccaaaatgtaacagataattagatatcttaaaggtcatattctctggcttctttagagactattggacagaatatgtaacccaaatttccctacttttggagacaaaatatggttttaaataagtcaaagaagaaataataatgggaattataaataagtagataatgacttctgtgtaaccaagtttttagagaatgctaaagctgtacttagagtagtacttacagccttaaatactttatattagtaaactggattggaaatttttgagcaaggtattcaaacagttacaaaaggacaaacctcaaataacttggaaggaaataataagagcagacgtgaactagaaattggaattgttaggatcaacaattttgaaaagatgcagttggcaaatctttatgaggattagttaaggagaaacaaggcacaaataagcaatgttagaaatgaagtttatagtagaaactttaaaaatttatatataccatgaattcctttatttaaatttgaaaactcaggtgacatggacagtatcctaggtaaatttaatgtactgtttcaagaagtagaaaaattggttgccccaattaacattaaagaaattgggccaactattttaccaaatatctaaggaacagatgattctaaattatacaaactattcaagagcataggcaaagagggaatatacactaattcattttgtggggttaatataacattaacatgaaaaccagccaaggaaaatgcaaaccagtgtcacgtatgaacatagatagaaaatattaagtaatatttacaaatcaaactcatcagtgaatatttaaacacaccagtgtcaaaattgctcacccaaggagtctaagattgctttaaattagaaaatcacatactattttccataaaacagattaaaggagaaaaactagatcatctctagataaagaaaagccattcatatctcaatcatgttgaaaagtcgtagcaaactatgaataaaagggaattcttttttgtgaggcagagtctctcactgttgcccaggctggagggcagtggtgcgatctcagctcactgcaagctccgcctccggggctcaccccattctcccatctcagcttcccgagtagctgggactacaggcacctgccaccacgcccggctaatttgtttttgtatttttagtagagacggggtttcaccgtgttagccaggatggtctcgatctcctgaccttgtgatctgcctgcctcggcctcccaaagtgcagggattacagatatgagccaccacgcctggccaaaagggaattcttttacctcatatgggggcatttattacgtagaacaactgctgtatgcctaatataaaaggattataaatgtaactaaaatacctattataattatatacaacaaaagatacttgggataaatctaacatggcaagattgttttggatgaaacataaaattttttaaaatcaagtaggggaatgggttttgaggaaaggtactctgggagatttaattatgtctatgctgtttcatttcttagtggttaggagcaaagatgaaaaaaatactaagatttggccaggtgcggtggctcacacctgtaatcccagcactttgggaggccgaagtgggcagatcacgaggtcaggagttcgagaccagcctggccaacatggcgaaactccgtctctaccaaaaatacaaaaaaaaaaaaaaaaaaaaaattagctgggtgtagtggtgcgtgcctgtaatcccagccacttgggaggctgagacatgagaattgctgaacctgggaggcagaggttgcagtgagccaagatcaggccactgcattacagtctgggtgacagagcaagactctgtctcaaaaaaaatataaatacatattaagctttaacaaagatgggtgtttagtaagtttatcttgttgtgtgcttgaaatggttcattaaagtcttatgattatattcacactaatgaagatacattattatgtgtgctagggttctccagagggatggaaccaataagatacatgggagttttttagggagaattgcaaggtgattacaaggcgaagtccggtgataggccatctgcaagctggggaaagagagaagctgatgctgatagtggctcagtggctcagtccaagtccaaaagcctgaaaaccagggaagctgatagtgcagcctttgtctgttgccaaaggcctgagagtcccctgggaagctgctggtacaagccctggagtccaaaggccaaaaaacctggagtctgatgtccaagggcaggaggagtggaagcaagcatctggcataggagggagagcgagctaaagacccagcaagcaaacttatcctaccttcttctgcctgttttgtgatagctgcactggcagctgattgggtggtgcccaccaacactgaagatgggtcttcctcttctggttcactgactcaaatgtcagtgtcctctggcaacacctcacagacacacccagaaacagtactttaccagccatctaggcattcctcactctaatcaagctgacacctaatattaacttaattaatttaaacttagctaatttaaacttttaattgagtataatttggagcttagtgctcttaaacccactgagtagataataacagattataggccatactaggaatgtaaatgcaaggttcttaaaagttctggtaagatgtatcagtgtgctccaaagaccaccaggaacacacctgtagttgaatgaagttgggtttactgacttactgcagcaagggagaatgaataccacggagaacaataggatgtcttacaagtatgttagaaaagtatttttttttgggcttgggtttgtgttacctgattttggataaggttcaaggaagtagagctttgctctgcattggatgctctcaggaagtagagatgattctatgtttgggtatcttatcaaatcttatctagaaggtgagaggaatgaatcttactaaatcttatctggaaggtgagaggaatgaattgaggctaaagctgcagttggtaaagtagtagcagttactcatattagccaggataaaaggttgtttggtcatttttctggtgtggtcagtgttcttgtttttgtctggagttttgacatggttatggactgttgatctatcacagattatagtcttgtgtgatgttggtgttctttgaaatatttatattcaacgggagaacaccacagcctacctgtgagtgccaggccagcttccagcaacactaaggcctgtcttactgtaccagaccagtttctggctgctaggagctgtttttctcatcaaatattggagaaaaaacagtaataccaagtgaaaaccaataattgatgtaggtaggagattgtattgaacttcatagctatgcagggagtatgtgaattactgtgagttttcttctaaaagcttataattggtggtttgattttgaaacatgtttaacaaagaatcgccctgaacttttattttcacgtagatgtccttttctaattaggtgcttcaggagtttgtatgtatgtatactggcaatgtgcaaagcattttagtttaatttttgaacgcctgtcttggggtttgcaatcagagccttgtgtcactttctttttaaaaataacctgagtggtgacagtgtttgttgctgaatgaaggatttcatttttttcagtcaactgaaaatcatttggacaaaatgaataataagtgaagtaatgttgctttcattaaaaaatcacaactagagattaccgagtaatctctggcattttgtggcttatatactgtttctggaagtaactgctttgaaggacagtcatgatgtagataagttctgcatatatttttaaatttatatttattttttaaaattttttgagacaaggtctccctctgtcatccaggctggagtgcagtggagtgatctcagccaactggacttcccctcccgggatcaagcaatcctcccaccccagcctcctgagtagctgggactgcaggcatgtgctgccacacttggctaattttttaaggtttttgtagagatgaagtctcactgtattgctcaggtttttcttgaactcctgggctcaagcagttctccctccttggcttcccaaagtggtgggattacaggtgtgagccaccatgcctggccctgcatatatttttttaacgatttcttttaagatcagctattttagttagctgttttttttcaagacaaagttatgcaagagggataacagacctatcagtcatgttatatctttaaacatgtatagagtaaggtatttttgtattattttaagaatagcgtgaaataaaatgagctttttaagttatataatttttattaaatttaataatttctattaaatttaataaatatttaagaacagcatgaaataaagtgagcttttgaagttatgatttttattaaatttaatcatttctattaaaaagtagagctcggattttcctaccaaacctttttaccagtaaggtcataggctataggtatggcatcaagaaagactgataattctgctttttttccaaaataagttattagccatagagaattcttttttttaaaaaaaaaagttactccattacattgatatcttgtttttgtttttttaaaggaattgtatttatttttccttgttgcatattattagtatacttattcatgaacttctaattttaagcaaataaatgtttttatttcagttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatggtaaaccctgaatccattgtattctgacttattgttcttacgtctttttggaggttttaaaaaactctttttaagtaggagaaggatggcatccccaatgtcactcttgtttcttcctctgcctctctactagtatttatgtctgtgttcctaaactttgctgttcatcagaattactaggaggtttcattataccaatttctggatctcatcatagacctactggagcgtagcacctggaaatcccatttttaaagtgttttttgggtgattctttcgcaactagtcttagacttttggatttgttacacaggtcagttttcaaatccttttgacacatgaaccctttttagtataatagataagtaatgaaccttgggaattgaaaatcatttcatgaataattacatagtgttggaagtattttcaactaaaaatcacttagattagtaatgttcattaaaaatggtatgttgtaaagttgaaacacagtttttaataataattaaagaaaaactaattttttccccattgtataatgacatgtactgtttgtgttaagataaagcaaaatgtgtcaacatttggaactgacataattttgggaccgaatgtattttaaaatgtggactgaactttaagtatgtgttaatgacttgaaagtacagttaaaaaactgctttcttcttttaagattcttagatgttgcatttaaagaaaactcttattattatttttttctttttacaaattctttgtttgcttataattttcatagtttaaaactgtccatattgtgaaatagtaatttaaaaaaagtctagactggatgactgcatataaagggcttaacatgagataatttttgtggataaatggtatgtattctatttttggccactaaatattttggaagtttttgttttctatttttattttagttacagtttaaataaagatgtattttccatcatttctctcttcctgtcttctaatagtcatatggaattatgttaatgatagatgtttaataaatatttggtgattgattattcctagttgcacttctatttcagaacataatggagatttgctgaatactataatgagatcctcttggtcactttatgatgaaaccttttatatttcaggtcaaagaaggttgcctattctgagccctacctctccaaacaaaaatttccaattttagatcaagaatcaatgaaaaagttagacaatttttccagaagaattcatagatgctgacacaacatttgcatataatttcaggggatttaaccatctgcagaatattaagaagtgtagatgagaatttaaccagtatagccaatactgttcagaaattagctacagtggcccacattctactctaaggaatggatttatgagttttttgctttaggtgaaactttttcctcacctctttcttgctactgtttatactttattctttgtgtctatattttttatacatactgttagctttttacctatgttaatgtaaaaggtgttaaaattggtttcttctctgcattttggaaatcatgccatatgttgttttcttgtatggccattttctagttattgtgtcctgtctgacatatctgatgataagatgatataagaataatacaatctgcattatatttttagagatagttcttatttttttagaaaacaaaaacaacaagaaaaccatacatcagaaactgaaatctagtccacaaaatgaaattgccaatcagctatcagtgctatttagaacctgtggcttaccctcaccaagaaatgtggccacctgtggtcttcagctctctattacagcggttcttggatgcttgttttcctttaagaggcaaatgatgtgtaaactaccttagatagaagattgacctgttgcagtatctccagcagctaatggagcaagtagtaggacgtatagtatgtttcctgatggttttagtttgtgataagtgaaaagaggcataggtagtgagatgtgaggggaaacaacttgtaagactgacgtggtatgctcttgggattagaggaaggaagttggtagggaagatagataactggtagacatgttttaaaggaatacttctagtagtagttttctttttccaaacatttagaaaatattagggtagcctggaatggtatgttaggaatgaatgagctgccagccagtgtgtgctgtgggtacttatattcggtttagcacttaacatttttttcagaagatacattttgtattgattacaggggtgatctaagaactgatgttcatttacttgcttggtaacaaaagtgataatcattgtcccttaattgagtaaatggttagcaacagtctttttgtttacttgttcgtgttttttgtttgtttcttttgatgtcttttgtatcttggacttggattcctatttgtaaaatgtatgttaaaattcttgaactctttttctttcacaagacagtagtataaatgcctgtggaatatcttagtatcctgagaagaaaagcatgattttaaatttaacctgctcataatatttgacattttgtttttctgttgttgttttaaacattttattatagaaaagtttaagtatataagaaagtagacattataatgaatcccagaaacccacatccagtttcaacagttaccaacttatagtatcatataattacactatacacatttccgcccctcctgttacccagagtggagtacaatctcagctcactacaaactttgcctcctgggttcaagtgattctcgtgactcagcctcctgagtagctgggattacaggcatgcatcactgtgcctagctaatttttgtatttttggtagagattgggttttgccaggctggtctcgagctcctgacctcaagtgatctacccacctcggcctctcaaagtgctggaattacaggcatgagctgttgcacccggctcccctcctgtattattttgatgcagatcccatatacatcatttcatctgtaagcattttaataagtattttaataagtaatacatattaaaatagaaggtagcaaattcaaaaatgtttttaatgtgctatttatggaagattatgaattaattatggttggcttgatttccatgtaatttaatagtggaccagtagacagtagaaataaaatgtaaaatttgagattataaccttagttcagtttctttttataaaataaagccttagttcctataattattatttccagagtgcccagtgggtatctgatactaggatataggttattgggctccaaaaaaaccaaaaaaagtaaaatgtttctctttatcaaggagcttgtatttttttcatctaatgtttcttacaaaaggaggtaaataatttttttggaaagcttttgttcatcttctgtttctttttgccctcttctccctgttactagaaggaaaaatataaaaaaaataaaggaattaaaatgatctgtaatcctatattccgacatgcttaacattccagactatcattatacacctgcattatttcccttgtacttttaggccttactgaatatagataaaaaggaaacaagtttttgtttattcctctatttttacagatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcaggtaagttggtttccaactcctttacacccttcgtttccttcatctttccgttcttccctttccttctttctttaattgaagaataacttggatatggtgaagtgcacaaatcttaagggttctgcttaacaaatttttacatatgtgtacacttatgtaaaagactaactagattaagatgtagatgatttccagcacttcagaaagctttcttatgtcctctccccaagagtagcaccctcccccttaaagaataagcactgttgggttcaagtaaatttttgaaagtaaaatttagaaagtttttaaaaatctgaactattttataatttgattagttgcagtattcgaattatatttgatttgtcttatctcctcatcttagagaaattgaaaattaaatgtagattttcttgttaaattgcttgagtatacagtgggtttttatataaataagtttttaaccttaaagcagtacctatattgttttattctgtttaacttttggttataatttcttcattattttttcctgctttttctcttttcggattctaataacacatacattggagagcttgatactgtctcatgggtcattaaggttcatttttcttcagtcttctctctgttcttcaggttgggtgatttctgttgaactcttcaaggtcgctgtgatttctaatatgctgtggaacctttctagtgaattgtttaattgtgctttcagctctagaatttccattgggtttttatagtttctgtttttctgttgagattctttattttacattcattaagtctatattttcctttaattgtttgaatgtatttatgtttgattctttaaaaatatttagctgctttaaaatgtttatctgcaatatgtaacacttggacccatttggagtcagtttctattgactgggttcctctcccccacacacactccccccaactccagtagggtcacatttttctgtttctttgcctgtctgatagtgtttggttgaaaactagacattctggttaatatgttgtagtgacttggacttatattcttttgaggattttctgttattgttgatctagcagggagttgatttgtatggacttaacataaataacaaacagaaaagcgctctctaaaagaaaaaggtatttgggaatagagcattgcattgaaaatatgcatgccatagtaaactatgtgcatattcagtgaggtaaaggcagacaaaggtttttaaaggaaaaaatgaggagaatatataattgttttgaaataattattgttggctacaaagatcattagcaagagtgatgccagtctgaggttggacaggcagtttctgggcagatgtcctcacagtcacagaagtttttttttttgcttttttttttgcaaagttgtgatggcctttgtgtaggcttgtggtttttgaactcttttgtgatagtttttgcaagaatcctctcttcatggccttatcagagtttttaatttttttttaacattaatgacttcattttggttttgataactttcacatactcaaaactgctccttctttctccctatggtgtatagcagctgatatgtatgctcagtcctttcagcttgctctaggtgctgcatttttctctgagccttcttgagatatcctcgtctgctctcccagccctatagtcagctggggatttggacagagtgtatatacctagatcgtgggtcttaccctttcagtagcaccttcacttccgggattttcctcctaaatcttcagctgcttgtctagccataaggttgttaacactgtggttttctgccattggagctgcagaggtcagcgcttttaattcttatccattctaattttattggggtaaactcctctggtttctgattgactttcagttatttcaaatagtttcttttgttttgttcatgtttttagttgttacctgggagagagtttatctgatggatttactttgcctttatcagtagttggaaatgtgtacagtccattttgtatttcttagagactttcatggaattactcacaaaagagaattgtgtgaaaatttgatgaggtcagacttttaaattttgatttaaatgtagtatattccagactagaataatattaatatgattcacattatttgaagaccatttttctcacagctttgtatgttgaattatagtaggaaaaactgtatgcatagctaggatacttttgtagttcttcaggtgtgatgtggtaaaaatgtggcttattagaataatgaatgtggcagtgggaaggagggataaaatattacaaacatggaatgaacattaactgtaataaattacatataagggaggaaagaggagccaaagtaataaatatatatatttaggctaataacagtgtcttttgtgggaagaatgtgtgtatttatctacatagatataaatttaagtaaaatggtggtagatagaaaccatcatccattttattttggcaatcatcagtctctcttgcattaccactattatatcctagtttaggttcttattaatacttggactgtcagctgtcaactgtgcctaatactgtggtaagttctggggatacatcagagcagaagatagaggtttgcccttagagaaattagtctgctgataatagcaagtacttatatggaactttctgagtagtagtcacttttataagcttttgctgtataattccttttataagcccatgctataagctcttgtaaactcataatcctcacaataaccttatcaagtaggaattagtatatcctttgtacagatgaggaaactgaggcacagaaagagattatgtaacatgtccagagttacacagctagtgagtgacagcactaggatttgaacctgggtagtctagctccaaaacctatgcttttaaccactcttctgcattgccaaagcagaaagaatttaaaggaataagacatatttacattgtcctcagaatatcttttttgactgtcacagcattggaactgtaatatattctctccattcatttctgtgttcattattttgtaagaattatagtggctccatatgtaagttagagtgctaggccttgttcggcagacaaaaagaatcaacagtcaggagcccggccaaaagagtgcagagtctttaagagggaaagtgagagctattcagaaatgcaaagtagaagtcagtatgagttaacaaaagtaaactagatagaagttcactagtagaaaaagtattcatgagtcaagaaggcttactagaagtgtggaattataattggattttaaataatgttatatttaaatatgtgaatgttatatttaaatatatgggatctagtgggagagaaatagaggtcaaaaaaatattagctatgttatgggagtagggagaaggttagtttagctgaaagggaggcatgtgagaagagaaattgtgagaaataatgtttggacccttaatgccaaactaggaggttgaacttaatttatggtcagtgaagaccccttgaagaatgaagtgacaattttggttcctgtgcagaatacattgcttggagtagggggatattggcattgcagacatgagttttgatttttgcagggagaggttaagactcaggaatatagtactctacactttataaggaaggagttccagttgtagctttggattaagagattggagcaaaggaaaaaataaagtacatacatttaatgtaaaaaggcgtatttgtggttatatacttattctatagtacttttagtatcttttaaccaaacttattccttgagcttgctgggggaaggccttgtgttggatactaaactgacttttttttgactatccagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtaaaatagagtttagaacacatgtttgggaaagtacatgtgtagaagtgtttattacagcattgttgtaaacacttcatgtatttagtcatgccttaaacacaggaaaaattttgatttactgacatgatttgatgttaaaaaaccaaatagaacaatatgtcaggtatgtttccaattattggaatgaaaaaaatacctcaaaaaagtgtttctatgaatatagatacagagtgaaagaccagtcattagtcagtggtgacccttggaggggaggatagtgaagttcagactggtgatttcacactttattttgtgttatagatgctattttatctccctcctttcttcaacatctgtgcatgatttttctaatttaaaaaagatttctgaatagaggtaaaggataactttagttgtagtgggttttttttgttaagattagtagccttttataattttgtaaatttagcaatatgtctttaatggaaaaaaagcagtgtattttaagtcagactttttcttctgaaataatctgtccttggatatgcagtttagtctctctgggttttgatattctttcactgtaaaatgtgaaaactggactgaacccagtggtttcaaaagaatgtctttagttctgaatgaaatataacctgaaagctccatatttaaaataggggattgaagggcaacagacttcacacagcaggcactaaggtgcctcattgaaaaccttggagttctgcagaatgtgactaagtacttaactaatctctagggtgccttccagataatgaagtgtgatttttgtattgtctatgtgtgttgggacctttaaagccgcattccacttcaaaacaaacaccaggtggtgctctaactatttgtttaacgggtcagatagtggtataatgtatttccagccccagaagcaagtgattaaggttatcaattacattaaaacaaaaacaaaacataggctaaaatgaactgaccacttttggaatagaatcctatcatcctgtggtgatactttcagagttacctggctaggtgtggtgcctcacgcctataatcccagcactttgggaggccgagccaggaggatcacttgagcccaggagtttgagactaggctgggtgacatagtgagaccctgtccctacaaaataaaaaaagatttaaaaaaattagccaggtgctatggcatgtgcctatagttccagctacttgggaagctgaagtgggaggattgtttgcattgttgaattgaagtgggtggtctaggctgcagtgagctgtatcactccactgcactccagcctgggcaacagaacgagaccctgtctcaaaaacaaacaaagccaaaaaaaaaaaatccacagagttgtctgttggatgaacaccagtcattatggactagcaggtgacattttgctgatgaatcagtggtttgcgaagaatttcttattgcttaagccttttctcaaccaactttaattaactcctcctctgcaccaaaatgctactgccaaaactagaacaaactagaactaaagcagatgtcagctgaaatggacaaaagcagagtataggtatgatgagagtttaatgcctacatcaagcgaactaaagatttgtttttaaataaatcccattttaagcagtgtatactgtgatacaatgacagttggaaggatcattgtaccaaataatgtttgctgtttatgtataaataaatgggaattaaggcgctactagcaatatctaaacattctatgaagtgtttaattgagcattttcaaataagtaaaattttaaaaatgcgaaaggacatacagtgaaaattctctctcccacctctgtccacagcaaccaaattccttttttcagaggtagcagattaacactgtttatatgcatttaatttttagagtagtattgtatgccttgctgcaattaactgttagcttacattaaaacatacagtatgaaaattgtacaattaatatgtgacatcatttaaactattaataactgatctaattctagatcagtgctgtccaaaagaattacgatagaagccacatgtagtttttctatttagcagcattagaaaaatgtttaagaaaaggtaaaattaattttatttagcctaatgtatccaacgtgtactcactattaaaaagttaatttttttggtactgtgtattggaagtctgggatttgacactgatttggaacacttcaaacaacaaacaacatatcacatttcaaacaagccacatttcaggtgctcaatagccacatgtagctagtgattattttaagagcacagctttagataaatatagtcgttatttatagattcccagcatgaattataggctacttttactttttgttgtataatgagtctttgacattgtcagttatttagatcaactactggttataatttgagcagaattaccaacataaaatgtattacttataatttgttaacatagcaatctcttacaatgtgttaatagtccatactaaaattaagaattctgagttgttacttaactcccataaaagggactttggaactgtgaattttattccaaataaatgtagtcttaatatgtttttcagttaaaaggatcaacaagatattgagcatcattaaaaaaaaaccaaaagggataatgttactctttttcatataaagccagtgcctgttacaggaagactatgtgatgttgccagaaatgtaactggtaaggagaagaacgctaaaaatcatcagagatcgggagatattgctgtttgacagcctaaaaaaatgaaaaagcatataattaaaatctttaaaatcatatgccaatataatgaaaagctgagtagcctttattatgtaaatattgaaacatacatagaataatcaactcttcatgtagtcatgtggcttcaacacttaccaatattttggcattcttttttcatcattttttccccactgcaccccttttaatttgctggagtagtttaaatcaaattatgaacagcttattatactcaggtatttcagtatatatgtccaactgataatcttctttttaatataaccaccatgctgttacttaacagtgattctttttatttttaattgtgacagggtgtcactctgttgcccaggttggagtgtactggcttgattacagctcacctgcaacctcaacagtgattcttaatgtcaacgtgtgctagtctgtgtttgaatttccctaattgtttcaagattcgtttgttaaattgacttgttcaaatgaggggcctaacaaggttcacactttgcattgttaatgtgtcttgagtcgttttttctaatagccattagaaaaaacttacatgtttctaaaatcccttacatgtttctaaaatcaaaactatgtgtattatttattactgtgtaactattatcccaaaacatagatacttagacaacaaaagttaattatctcatacagttttagacagatatcccggaatggtttagctgggtgattttggctcagcatctctcatgaggttgcagttaaaaatggctgctggggttatagtcatctgaagcttaaccagagctggaggattcagttctttaccatttggacttctccatggggctgcttgggtgacctcatgacatgacagcttcaccagaatgagtaatcagaagagagtgaggtagaagataaccttttatagcctgtcctcagaaatgtcactgtcatttctgcaatattttcttggtatacaggtcagccctattcagtatgtgagggactaacagggagcagatactcatgtgcttgttgcttatttggtcatttttgtattgtggagttaaatctttctaatttctaagaatataaacgataccaacccattgtcataaatgctatacatgtgcagaagccgttgagggtcatgatagaggttggctactctgtgtaataaataattcccagaagtcttaccattactctttgcttcatcctgttctcttttccccttaattttttttattactttttactttattctgtcattgattctttttgaaaatatacataaaacatagcttatatatagtcatgcactgtataacatttcagtcaacagtggactgcatatatgatggtggtctcataagattataatggaggtgaaaaatttctattgcctagtgatgtgtagccatcataatgtagcacaaggcattacttacgtgtttgtggtgattctggtgtaaacagacttactgccagtcatataaaagtgtagctcacataattatgggtagtacctaatacttgataatgatgataggtgactctcttactcatttgtgaatttactatactatatttttaaatcattagagtgtactcctacttatttaaaaaaaaacaaagctgtagaaccaggctcagataggtccttcagaaggtattccggaagaaggcattgttatcataggagatgagagctccatggatgttcttgaccctgaagaccttccagtgggacaggatatggaggtggaaaatagtgatatcaatgatcctgatgctgtataggcctaggctaatgtgtatgtttgtgtcataatttttttctaaatgtttaaaaaagtaaaaatttaaaattaaaagaatagaaaaatgcttatagaataaggatataaagaataaatatttttgtatagtagcacaatgtactttaagctaaagtattaaaaaagttaaaaaatcaagtttataaagtaaaaacattacagtaagctaaggttaatttattgaagaaatggaattttaaaaaataaatgtagtatagcctaagtgtatagcgtttgtaaacctttagtagtgcacagtaatgtccttggccttcacattcactcaacacaagtacctcacttggagcagcttttaatcctacaagctccagtcatggtaagtgccctaggcaggcataccattttttatcttttttgccatattttcactgtaccttttttatgttttgatatgtttagatacacaaataattaccatgtgttagaattgcctaagtattcagtacaggaacatgctctacaggtttgtagactgctatgtaccatatagcctagctatgtagtaggctatatacatctaggtttgtgtaagtatactatatgattatacagtgacacaattttcagaacctactcttgtcattaagcaatgcatgaccatattttttattactcaaaacattgcttactataaacaatgtctgcattttgctctcttcatatatcctatagatctctcaagtatgtgaagaagttcatcctttttctttttttaaacaattaaacagacttcttaattaattttcagaatactgtgacagtcccatttggacttgaatgaggtgggtttaaagtaagtaccgtaaatcctcacttaacattgttgataggttcttggaaattgtaactttaagtgagatgacgtatgaggaaatcagttctaccataggctaattgatatgagtaagttgagttcctacagcatatctctgatcacaaaaatacccccagacttctagataaagactaaaaacaaatgtgagttatagatacatttaagaaagattaataaaaacaaataagataatgatttatgcagttattccaattcagggttgtgggtggctgaaatctatcccatcagctcagtagcaaagtggggaccaaccctgacaggttgctattccattgcagggtgcattgcaaccacacacacacccatagtcgttcagactgagatcatttagacatgctaagtaacctaacatacacatctttgggatgtgggaggaaattgaagtgcccagagaaaacccacacagacttggggagaatgtgcagactctacacagaacagtaaccccaactgggaataatttttttttccttctcagtgttttaacgaaacaatgtcgaacaaaagatgttatttgaggatctgctgtgtaaaaggaatcttgtgtagagatataataaacctctgaaatttttaactctagggatgtttttcaaaatcaatttatagcagtttatgaaaacatgcaaaaaaaaaaagctttatgaagagttgtaccctataaatttttattgaggggaataactgtggttttgaccaggagttccttactcattgatgaccacagtctactactacgtggaaccttaatctcagccttttttgatgatgcccaagttaatatttatattgttttgttcatgggataatatatgcaaaatgactttataaactaaagctttggagttatgcctgagttccagtgatggttcttagctcttcatggttctgttcttagctattgactgcaggtaagttgcttaatttttctgtatctgagataaggaatactaatatggttgaatttttttaaatgtgtttattgcctgtttgcttatttttttattgtggagttaagccttctaattttcaagaattaagagttcattgttatgtgctatacgtatttattccccttgattatatttctgtacctacttacctttttattttagattctggtcacttctattccgaaagttagttatgaagtacaatccaggattaaggtggcatctaaatttggttaatttctgtgctaccttttatgctattagtctaaatcattaagaaagcatttaagaaacttttgtaagcgtttctttttttttcttgtcatatttgggaataggataaatagcttaaaatagttgagctgatttttatttgtattctttttttattataaagaaacatttgctaggaaataagctggatataaacatagttgtatctcctttagtgctacccagcactaaacacttagacacgtatagggctgagcagctggtataatagagtgggctccgtctcattttctaagcctgtgagtcctagctgcctactgcagctcgatttgagtgggagttgatataatgtctttttttttttctcacttcagcagtaagtatctggtttgctcatagtcttttgattaataggtagtttgaatatttttcaaagaatcagccaacatgtgattattttaaagatttaaataccagatagatattaaaatgcaaggttattgctactagatattacatctagctaaatcaaccattgtgaaataattgagaagtagagataataaagacataaaccaataaatctttgcttgaaaatcacaggtatgggaacagattgtgaggacagaaaaataaaaagtaaaaagaaaaatcataggtaataagtgtctaaagggtttcttcataggaacagtggttgttgaccccaaataggacaaataggactcccatgttcaagaacacatcaccgttgttaaaaaggtctgccattattaaatagtgcaatgaagaaccatttagactttattagagtccacgttattggcaaaagatgttggatattcatagaaaatcaaacttgacaaattccaaaagtgtctttcagctctggaacaaaagatgtcatatagttccttgctaccaaagagtttgttcatatggtaatagaggcccatacctttagagggcaaatacagtgctttaggaaggacttagatgatataaatggtatttgtcccttttctcatttttatttactgattttcaactcacttggcttttaatgaacattagcgttacttatctgttggcagctgggttggaaaacatttgtttttctagactttatgaaatggtagccactggtgttgcacttaatgtttattgccagttagttctctgcagttaatccacagcagaggaatcacacttctaaaatggttcattctcttcttcatagacatttaaagttgaacaaatactttcttgtatattgttactctgtttggatggagagggaatgtatatgtatcttaaaaatatttctctttgccacattaaacatgccttttttccttgtgtgtgtgtgtgtgtgttttcaggtcagatgtaccaacagtaccagcaacaggccggctatggtgcacagcagccgcaggctccacctcagcagcctcaacagtatggtattcagtattcaggtgagcaggtgttgaaagggagttggctcatggttttttgtttctatactcattaaactttaagttcttaattccttgatttgtagtacattgatataataggtattaagtttttattaggggaaacaacatttgttttatttatttttaaatattttacattaatattgtaaatcaacatttcagttttctggtggggagataaaacttacagtagatgattctgcagtaacttgtagtataaaaagtttttaatacaaagctgtcttactaacattatcagtttatctcttaggcgacttagtgcaagttttcccccttccctccacctctccatttatatgtaacacgtaattccagtgtactcttagtacctgtagaaatatgaacagtttactatacatggaaaggtgatgttatttaaataagagctcaattaagctacttagattttaaaatctcttgcaagtatgtaggaataccagaaataggccataaaaataaaatcgtataaaatgtaattcaggcaactaagaacattgtttagttgttttaaataagcatcctgagtattttgtttctattttaccatctgtccactgaagattatatgtatttaagtatgataaatattattaatgtaactttggctataattccagtattttttacagttatgtcagagagtttgtgtccaactcttgttttacagccaaagattgaagtatcagaatttcaactgtaattagaaataatttatgcaggttgaatctagtctaaattctattttatagagttttgtggtatcagctagagcaggagtcagtaaagtatagcccacaggccaaatctggactattgcctgtttttttgaataaagttttattggaacacacttctacttttatattctctactgctacttgggcactagaatggcagagttgagtagttgcaacagaagaccatgtggcccacaaagcctaaactatttactatctggctctttacagaaaagtttgctgactcctgacctagaccataacattctgtcattaattaaaatttgaaatattttgacacaattttatttagattgtatttgctgtagagtgacttaacttgtagctacttgtttttaattgtataaaatacatagaacttaagtttggattatatcaggaggaaggttatttttaggatgcagttcttttaaaaaaatcagtgttacaaactatgttatttatagaaagaatagcagagctgaagagatttagtcatcatttaatctcgggatttcggtcctcactatgctttagaatcacctgggggaggctatgtgtggggccccattcccagagattttgaatttcatttgattgggtgtgggactcaggcgtttgcattttataaatgaggcaactagttttgaaagagattgtgacttgtcaaagcacatacagccattcagtggagggagctggatcagttcagtatttccctgtatcattctgcattctacaacctagactggagttggcagacttactccataaaaggctagatgtcctatgtattaaaaaaaaaactcacataatttccatatttccatttttttgctatttctgatgtccttcacctaaagttatttattattttggagggacggaagggagactatatatatacacacacacacatgatagaagcattgccacattatgttcaagagactggtgggctgctaatgaaatcttcagcctgtagggttattccctcccctaagcaataattaaggatcagattacttccaggcccagttaaaaaaaaacagttcagatttcaggtgccaggatgaaaaggcacttttcttttttctcgcagtgttaaaatgaataggcattttcagtataaagctgaatccatctatttcttcaaaaccttatagtgaaaatttaagttttatgtagaggataggagaacttgtatgacattcagaattttttatgagttggtttcaggtcagtatttagatgctaccatgagttaatgcgttaaagatacttgatttacttattaagaactaagcttgctcttaataaatttagtcagggtcttcactctgagtaaaatttagtcttttcaaattattatctttgtatttctgatcctactagtctattaacttgaatttgattgagagatatggaaatagtcaactaaatactctgcttggagactaagaggtggtggtggtaacattggaccatctttgacactgttggtttgccagtttccctctgaccttttccagttttgttcatggactatgtcataaaggtttctttcatgagtaaattttgaacccaggttcaaggtgagttcagaatatactcaaattcattcaatcctttttttttttaatgcagggttgtacatattttaataattttcttatgtatctggtatttaatgctgacaggattccagtcaatggagaggtttcattgcaagtagctgcaggtgtgtttcatggtagagataaaagttttcagtgaagcagactttcgttgtaaaaaaaattacatcctagtaaataatgaatatagatgttgctttttatggggcaatatggtatgctttttatgtgttatgctgtactgctaagtaaaaattttgagttgtaaaggcaaaaaacatcagataccaaatctaaaaggaatgattttaaagattgtgaaaatggtactttttatttatttgcaaaatttaaagcacctgattagtacaataagatgtatttatagtattatttcatataaaaatgttcattctccgcaatgtgtttttatttgatactgttaagtaggtctcccctgaaaacctggttaatgactatttagctttcccatttttggtcttcctagaaagtataattctttcatttatcatttgagcatctgttctaggaattatgctatgtcaggaatttgctctcagggattatgtcttagagagtttaaaaaattgtagagaatgcctctttgataactacttggtcttgaaatattatgtgatggaatctaccactctgcttgttacatacatatttattaaatttctcaccatttttggtccacctaacagtaagactaattctttggaaaagtagttttactaaaagataagatacatgttatttattttgccttttcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccattagtggtcttgaaattttaatttagtcactaacattatgtgaaaaaaggaacaatttttcagaagtccttattggtgtttggtcttaaaatgaagtataaacattttaactaacttacagatttccattcagagaaaacagtgccatttggtttttgcccttcctttgaaaaaaatgcatttggtaatcgttggtttaaaatgaactttattacttcataggatgaaaggttaatttaggacataaacaaacagtagatataatgggggttggtagagcctgaataaaacttagtgattttccttctcgataaaaggtatagttaacatactgatgaaccattcagaaataacaaacaaaaactcaatcttaaaaaaaaactacatctctttattgcagaatttatacttgtttgaaaaatacaaaatgtagcgttgataagattgaagcatgttgaaaggtaagtacagggaaaggtcctttcagaatgactgcaacagtgcagcaaggattcccattccccgcctaaaggacaatacctttttaatagaaataaatgagttagttagttagatttttattacagattgaattaaacagttagttacaaagacattctctgatacattcattcatagaggtcttaacgtataaatacatagtaaatatcctataaaatggtaggcaatctcatcgtgcattatctttttgtgctcagacttgacttcacattcagtctctacatacagcttgattagaatcataaaaacaatatgaagacgattgcataaagggatagtttgacaaagcatattcagatattgtaacatttatggtgggtaaaaatgtatcttttgaaacaatatattagactccatttttagctgaaatgaaatttactgattcaatctttttaagaatttgtggatgtttaaaggaaatgtatattagcatgaatgtgtaactattaaactcctccgcaaagctattcagctgttgctaaaaaattgaagtttaaatataaaaaattgaagtttaaatataaatgtgaaaattcggaccttttttccccagatatacatgctgaagataatttgatccaataagttaaactaagtagagatttatggaattaactcatcaataggaagagtacacatcaataaaagtaaattttttttaaaaagtatatacctttttgatgttaattttgttataaaagtatctcaaaacatcattacaacagtgtgataaataatatacaaatgatctcttaaaataccatgaatagggagccagcttccccaaaaatgttattctgttaacatcagtatcttgctttcttaaaatgactttgtaaaacctgataaatactctcagcaatcttttctaataataaacatctagtattgctattaattagattgtagacttttatacatagtaaacaaaatagctttaaatgaatgcggcatagtattttcaatgatttttgtttgcaatgatgaaacagaaggtaactttgtgcagcatctaccattttccaggaattgtagtcccacattcataccactgaacataattgatttgggtgtgaccacctatttctccaaattggacaggttcctggcgaactgctctgaaataacctgagagagaaaatagtttcattttaatagctgctgtattatatttttgccctcacagctcatagattgaaggatgtcgttgactagctgaaggctaatcttagtgaagcgaggtaatttagaaaactgagagcaagaagttctggtgttttttcctgaggtgtagtcatggttggctaaaatgggcacctgaaaaattgttgacatttgccgtgtcaagttaggaggggatggttggtagtgagtttcactgcccattatgtgttcaaagaacttagtaggtcatctttcagtattgttggtatttttaagtgcccgtgaacaaaatgtgttactgaaaaatcgaatcaa

SEQ ID NO: 16079 - DNA, 6647 bp, Human
gcataagctgtctttctgtctgtcccctctctctctctctgcctcggctgccaggcagggaagggccccctgtccagtggacacgtgacccacatgaccttacctatcattggagatgactcacactctttaccctgccccttttgctttgtatccaataaataacagcacagccagacattcggggccactaccagtctccgcgcattgctggtagtggtcccccgggcccagctgtcttttcttttatctcttcgtcttgtgtctttatttctacactctctcgtcgccgcacacagggagagacccactgaccctgtggggctggtccctacagtaattttaaagggaagagcaacaaactttcggtttgcagggctgggactgtttacagctgcaaaatttagagaggacatcaatctattattatccacattttacagctggggaaatcaatgctaagagaggaaattcatttgcccagaggtgcaccaccctggcctccaatgtgcaattcatgcaattgtgatttccgacctggtcccaaactaaccctaaagttagcaggccagaacagtgctgctcaaataagtcagcttagtcaaataagtcaggcaaaggtcgtgtctttgcacctggagtcctggccaggctggtaggtccctcctcctgggacaagttcaccctcagaattttcagcaagatcatctcccacagcttgttaattggttcttggttctaagtgatttttttgtttattggtttaagagatgggatcccactctatcacccaggcttgagtgccgtggcacaatcatagctcgctgcagcctcaaactcctgggctcgagtgatcctcctgcctcagcctcccagcctcagcctgggaccacaggcatgtaccaccatgcctggctctaagtggctttaatggggtccttctgagggatgttggagtcagggcctggggggagttccccaggccttctgggaggcctgggctctggacttgacctcgcctactgtctggccctgctgaaaagaaaaaaaaacatggaaatggcagacctaacagaatctgggctgtggtcaggatgtggctgaagaagccacaagaaaaacatgcagtcccctttcagcggtcatgcccagcagttgggtgccgataatgggcctgatttcctgtaggaagccctggctctcttggccacatggacagtgtctgaggctggccctgttattcccctttgcagatgaagaaacaggctcagagagtttacctggtatcctggagtcccaggagcactttttctggaagtaggagcttgtttcctgcaggtgccaagacagagaccgacattgtttgttggctgggtcggtctcccagttttcagctggctccagtctcacctgttgctcacacaccctccatgtctcccatagtcccctcggtggggacagaggcactggatgaagccctgctcgtcaccacagagacacctgaacacaaaaaccagtccctggggtcagacccaggccccgcccccagacccaggccctgccctcactccaccacgcaactgtgcaacctcagtttccccaggtggagaccggaccaacaatgatggcctctgcctcttcaggtcatagtacagatgaatacaggctggcacggcctaggcactcagtaacacacggcagaggcacagggacttaagatggagtgtcccaggcagccacagttggctggcacccagttgggaagggcccaagggcttttaaagcagggtgaaaaaaaaagcccacctcctttctgggaaactgaaactgaaaacctaattaatcctctgcctgtaggtgcctcatgcaagagctgctggtcagagcacttcctggaacttgctattggtcaggacgtttcctatgctaataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtggtaagctcctcaactcctttggatggcctagtactaggcggtgggagggacaagaatctctccccagaaatctgacccagggtgggtctccagggagatgcaggggaggtcctgaaactgctcctgggcccccacatcaagggacctaggttcccctaccagggtttgtgggcccctaacccagtccagggcactggtgtaggggcagggtgttaaaactctccagatcccccaaatcggggacctcagtatccccctgggacttaggtgaatttataaattctttccagggcactggtgtcgggggccttgaaactcctcgtgggcaccagtcctgggggagtagaaatccctattcagggttgaagggggacctcaccagaccctgaaaaagggggcttttgaaattttcacttcatccctaagaaactgaaatattcacctgggtcctgatatgggggatcttgaaactctcgctgggcatgtcacttgggcggggaaatcccactgcattctggatttggtagggccctctaacttttcttgggccattgctcaggcaatctggaaatgtccactaaactttggttatcgatagcctccaagtttccacgtggggtggcctcaaaactcccattttgaggacccacatgcttatgggtggccctgggagagtgtgtggttgtggctgttctttaaggttggagaccatggtgcagagagggttggaagaaaacctgaaaggggtttgcatttaagcccctctgtccccaggacctagggaggaggcccaggtcccaggggcagcagccaaactccccaggccaaaaccccagattctaactcttcttagatggccctaatggcttccctggatgcagagaaggcccaaggacaaaagaaagtggaggagcttgagggtgagaaagggagaagggagagggccggggaggggtgagtcaggtatggaagagggggtgggggcagggagaccagggctggaggttggggtaagggggaggttctgtcccagagtggagcagggccccagcatggccacatgctgacccgccccctgtttctgtcctcccaccctaccaggagagatcactacattaaaccataagcttcaggacgcgtctgcagaggtggagcgactgaggtcagagatagccttcccccgctaccctccacctgccacattcctctcacccccacatccctagcccaagacccaggatctcctttgctcccaaaatccccattgccccaagggataaagtttgagtcccacaaaaggataacttagcccctagggtcacagagccatgggtggccgctgtccattccctccccggtgacttggattggggcggtgcggggggaactcccgggggcggtgggcttacagggagggcggcaggagccaggacgagcagatgcctgatttgcccccatctgtaccgcagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggtcagtgaggagggggcggccccgggagggagaagaaagctggggaaggggggcggggaagcagaggctccgaagtctagagagagaggctgcaggggaagggactgggcgcagaggtgaggggccttggggaaggagggagaatccagtgagaaggatgccctggatcgggggcgggctgatagctgtatggggcggggctatcaatgggggcgggtctatcgatggaggggaggggcttatggatgggtggggcgggtctagcgatgggggcggggcttggggccgggcttggagcggggccagtgcctgctgcctccagtctgccctgagtccctcttctggtcctttaggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacctgactctcgagttcctggagtatcatcgttttagtccccaagcgttggggccgcccctgcaggtgagagtggacaccccgttgacgatgacacctcccttccctgctccaggacgttttcaggagcccacggagttcggggaggcaccaccccagttcttcccagcccttgtctctgctgggatcaacataagaactatgcaccctcatcagggctcaccgtttcccaggtgttgtattctcatctcctccctagagcctctcctgattcctggggatccagtgaggaaactgaggctgtaactgagagtaaccttgtcttgcttcccttcccgcctgcagaaaatgctgggctgggatttaaactgggatctgtacacacacacaggccatgcattgtcagaatgtttccccctgcttcatcccccagattctctctctcttttttttttttttttttttttttgagacggagtttcgctcttgtttcccaggctggagtgcgatggcgcagtctcggctcaccgcaacctccgcctcccgggttcaagcgattctcctgcctcagcctcccaagtagctgggactacaggcatgcgccaccatgcccggctaattttgtatttttagtaaagacggggtttctccatgttggtcaggctagtctcgaactctcgaccccaggtgatctgcctgccttggcctcccaaagtgctgggattacaggcatgagccaccacccccggctctttttttttttttttttgagacagagttttgctctgtcgcccaggctggagtagagtggcacgatcttggctcactgcaacttctgccttccaggttcaagtgattctcctgcctcagcctcccgagtagctgggattacagtactacaccaccacacctggctaatttttgtatttttagtggagacaggggtttcatcatgttggccaggctggcctcaaactcctgacctcaagggatctacccaccttgggctcctaaagtgctgggattacaggcatgagccatcacacctggcccgattccccaaactcttattcattctgcagtacccagctctgggaacccctcccccagagagtctctctgcttctccacaattgagggctgcaatcccgacggacccttcacctaccttattcgatcctcaaagatgccatagtcccttccttctctgttatcttacttcctccaagttctcccggaatcccggccattgtctctgcaactccaactcctgtttgtggtaatggagccaggagtcccttgtcccagatttctgtactatcctaaggtcccacagtccccagcccagacggtcagtgggatttaaaaaaaaaaaaaaccctctggccaggcacagtggctcacgcctgtaatcccagaactttgggaggccgaggcaggtggatcacttgagctcagttcaagaccaacctggccaacatggtgaaccccatctctactaaaaatacaaaaaaatggctgggcgtggtggttcatgcctgtaatcccagcactttgggaggccaaggttgttggatcacaaggtcaagagatccagaccatcctggcgaacacggtgaaaccctgtctctactaaaaatacaaaaaattagcctggcgtggtggcatgcacctgtagtcccagttactcaggaggctgaggcacgagaatcgcttgaacccgagaggcggatgttgcagtgagccgagatcccgccactgcactcctgcctgggcaatagagcgagactctgtctcaaaataaaaaaaattagcggggggtggtgggtcgtgcctatagtcccagctacacaggaggctgaggcaggaaaatcgcttgaacccaggaggtggaggttgcagtgagctgagatcacgctactgcactctagcctgggcgacagagcaagagtctgtctcaaaaataaataaataaataaaaccaggcctccacttccatggttc

SEQ ID NO: 16080 - DNA, 79858 bp, Human
tcagttctgaaaacatatcttgaatctcacaacttctcagagctgcactgctgccaccctagttaaagctaccatcaactctttctcctagactgttccagggccttgcaactagccttgtgctgtagttttgtttcatcacgtccagttctccactctacacctgcaacatagatcagacagctcctggctcaaaatcctctgagggcttctcatcttagaataaactctcggttctggccgggtgcggtggcttacgcctgtagtcccagcactttgggagtccgaggcgggcggatcacttgaactcaggagtttgagaccagcctgggcaacatggtgaactcccatctctatcaaaaatacaaaaacttagccaggcgtggtggttcgcatctgtggtcccagctacttaggacgctgaggagggaggatcgcttgagctcagggtggacgttgcagtgagccaagattgcgccactgcactgcagcctgggtgacagaatgagaccccatccccaccccccccaaaaaagaatgaactcccagttctcatagtggccccagctgcctttccaatcacattccctaccactctccagcaacactgacttcctcgttagtccccaacatgccaggcatagtctctcctcatgtcctttgaacttgcctggaatgttctttccccagatattcatatgagggagtaaaatgagggtgaaaaccagcagatatctaaatagcacccccttcacttagtttatctttctcaaagcccttatcactatgtgaaatgatatattatacttatttgtatgctagtatgaatcttcccggcaagaatgttagtttgctgtctgttcagtaccgtgcatccagagcctggaagagtgcctggcacatagcaggtagtcaataaatgaatgggggcaagcagccaaatcagaatcaggttttcttgctaagcatagaactaacagaaggatcattgaatggattggataatgactggcatcagggtaaggtccccttaacaaacactcctgtcctgaacacctggttagctaacagttttctcatactcttattttcccaaaacacaattgctggatctcagctccaaatcaactcttctaggaaagtgaaaaattgctggatctcagctcccaaatcatatcttccaggcagagctaacattgccccttattcacacctccaccaaaccatctgatccaacagtgacaggtgtcacgaggccttggcatgcactctcttcccccgccagagttctgcgaaagccagggttgcgatttgttgtcagtttattccccgcctctatgagagtgtgagcactgggcaggctcggatgaaataatgcattgagtaggcctctgaaaccaaggcccctcagctggggcaacgtcaggctccagggtgggcaactttgctgcttctgccgaagatagtgatattgagaaaatgtgggtgcaatgaaacgcttattgcagcgcactcggtgcatctgtggacagagggtcaatcgcccctcagagcagcgcaaacaggcgtcccaagcctaggccttcacttgccccagcatccgcaagggtccattaatccttaacattcaaattccgcccactaaaccagtccctccgcgcccaagccgcctcttttccccaaacgacggccgaaagcagccaatcaacagctggaggggtccgcccccttttccctggccgaaatggacaggaaatctcgccaattgacggcatcgccgctgagacctcccccctcccccgtcctccccgtcccagcccggccatcacagccaatgacgggcgggctcgcagcggcgccgagggcggggcgcgggcgcgcaggtgcagcagcgcgcgggccggccaagagggcggggcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgtgagtgggaccgccgtggccgcgggcggggacccttgccggggggcgggggtcaggggcgggacgtggcgcgggaggggcccgcggggtcggacgacacggctggcggatggcgtccctcctctctaccctccccctcccgccgccgccggtggcgactctcccctcggcccgtcacccgtgctcgcgggtgaccgtcctcggcgcggcctccctggagccgccttcgcctgacgcccctcttcctcccgccctcgacgcgcatcccggcccccggccccgcgggcgcccctgtcgccggggttcgcctgtcggggctgcgcgcgctcctgcccttctcggggctttgggccgcggcgccgtcgcgcgcccgcggccccggcctctccctggatcgcgctctccccctccctccctcgcgcgccccctctcccgttactcggcccccccaccggcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaaaaaaaaaaaaagctagatgagtttaataggctgttaccccctccagaacattcctcccatgtggagatgaaacgagaagttcatttctttaacctaaaataaagaacaacagagataaaattgttagttccttattggagcctggtttccattgctaatgtacctgcttgggactctgcatgataaatgacgtgtcctggaacctgaaatcttttataaaggttaatatcagcagaaatcttttaattagctaagagcagcttgttctcaagctgcccgagttatcttggaggagagaatcacaggaaatgtttgatatttctagtaaccagtgttttcagtgcgtggggtaaagcacactcctagactggccagtcccaaagagtgtggcaggacacctgcttgttttccctgccctctgctatggtgacatccttgcagaccagtcttgcgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcgaaagcttgctttgcatgccattgcttaaatactttgatggtatgtatggtatgtgggataactgagtgggagccggaattggggggtgggcagggcatccccacccccacccccacatcaaagggggaatgaccatttcgttagagaataaagcctgagtcttataacttcttcaagcacatgtatgctgggtctcctggcgtgtgaatgtgttcccgctgtgctgtgtggctgttttgcagttactgtagacactgtagtctgggctctcattattgcctctgaagttgacaggaccaagccttagtaaggatgcacttgtcttcctagcccaagagctaggggtgttttatatatatattaactttcttttttagatttcataaactgctctcattttctcttttctttctttctttttttttttttttttttgagacagtctcactctgtcacccatgctggagtgcagtggcacgatctcagctcactgcaacctctgcctcccgggctcaagcagttctctgcctcagcctcccaagtagctgggattacaggcacctgccaccacgcctggctaatttttgtattttttttttttttttttttttttttttagtcgagacggggtttcaccatcttggccacgctggtcttgaactcctgacctcgtgatccacccgcttcagcctcccaaagtgcagggattacaggcgtgagccaccgcacccagcctctggctcttttctttttgacatgaaatcttaagttaattatcttaaactttaagaactagaaggattcttagtccagcaccatcagtttacaaacaaaaaaaacttgtgtccctgagaagttgtgacttttccagggcctcctagccaggataccagtttggtttttattatatagctagccgagtaatactattaacttgacttctgggatttcaaagtattctatgacttgactgtttaagggaattatgaggcctcactgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgcactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgacttaccgtcatgcatttcgttgtctctctatgttattaaaaatgctacaggattgaaattcctcatgtgccagtcattttgaagaatggctgcctagacttggaatttctggtggataccaccacatcactgtccaaaatggctatcccagttcccacaacagtctgagaaagtgccattttcccatatcgtcccagaattggatatacatcttttaaattggtgccgcttggattattactgaggctaaacctcaataatcattgtcatagctcttaatgtattaaagatgttaactctttgtcatgcagatattttcctgttttgtcttacgtcttgattcttgtctttctgatatataaaatttatgttatgatttattcttttgctttcatacttaggaaatccttttttactctttttttttttttttttttttttttttgagacggagtctcgctctgtcgcccaggttggagtgcaatggcgtgatcttggctcactgcaagctccatctcccgggttcattccattctcctgcctcagcctcccgagtagctgggactacaggcgcccgccaccacgcctggctaatttttttgtatttttagtagagacagggtttcaccatgttagccaggctggtctcgatctcctgaccttgtgatccgcccgtctctgcctcccaaagtgctgggattacaggcgtgagccaccgcgccccgccaggaaatcctttcctactcttaacaacagatcaatagtcatctatattttcttcctaaaaaacctgatgatgtattatattcatacatacgtatttaatacatacaaaagggccagatgcggtggctcatgcctgtaatcccagcactttgggaggctgaggcgggtggatcacctgaggtcaagagttcaagaccagcctggccaagatggtgaaatcccgtctctactaaaaatacaaaaattagccaggcgtggtggcgggcacctgtaatctcaactactggggtgactgaggcaggagaatcgcttgaacccaggaggcagaagtttcggtgagccaagatcacgccactgcactcctgcctgggcgatagagtgaggctctgtctcaaaaataaaaaataaaaataataattttatagttaagttgccctgtgtttttcctgtgattaaaaaaaaaaatacctgttttgtatttaactttggggtgggataaggtatagcccacttagtcagttgtgtctaagccacttgatgaaccagtcaatccagtcttcacctttaacaaatgctgatttcttcaagtgagcaaaatatctcttaaactttttcctattttctctataaagttgcttttttctgaattttttctttatgaggcttgatgggcagccctatcagcagacaatcattcattcacccaacaaatatttgagtatctgcttcaagccaggggcagtgctaagccctggaagtggtatcttctccttatccgggagtggggctacagtgttcattccagaagactcaagaaaatagcagatcatcacaaaagtaggttttacataaatgaggaggaatccacagggttgtgtatatgtgtgtgtattttaaattctgacataagttggagctttagggtagactgtgacataagagtagtttgttttccaactcatgtaattgccggctgatttttgtcttgaattatgataatggtaacttctgttgaaacaattctgtattcatcttagcttggttgggatgcaataaaagttttgtactggtaaaaatgataattttcttccatgatgattttgaagcttttctgtaacacctgataaaaatagaggggccaggcatggtggctcatgcctgtagtcccagctactcgggaggatgaggtgagaggatcccatgagcccaggagttttaggctacagtgagccatcatcacaccactgtactcctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgattttttgaatagttagatggacaatacggaattaaaaaggtggtgtaaaaagttatacggggctgggcacagtgactcacgcctgcaatcccagtactttgggaggccgaggtgggtggatcacctgaggtcaggagttcgagaccagcctagccaacatgacgaaacatcatttctactaaaaatacaaaaattagctgggcttggtggtatgcacctgtaatccagctactcgggaggctgaggcagaagaatcgtttgaacccaggaggcagaggttgcagtgagccaagatcgtgccattgcactccagcctgggcgacagagtgagactccatctcagaaaaataataatagaaaaaagttatatggggctgggcatggtggctcatgcctgtaatcccagcagtttgggaggctgaggcagcttgatcacttgaggtcaggaattcgagactagcctggccaacatggtgaaactccgtctccactaaaaatacaaaaattagccaagcgtggtggtgcgtgcctgtagtcccagctacttgggaagctgaggcaggagaatcgcctgaacctgggaggcagaggttgcagtgagccaagatcatgccgttgcactccagcctggacgacaagagcggaactccgtctcaaaaaaaaaaaaaaaagagttatattgtaaagtatctctgctaccctgccccaaacattcatttctttccctggaggcagccactattacctgtttctttaaaaaaaaaaaaaaattgtggccgggcacggtggctcacgcctgtaatcctagcactttgggaggtggaggtgggtggatcatgaggtcaagagatcgagaccatcttggccaacatggtaaaaccccatctctactaaaaatacaaaaaattagccgggcatggtggcgggcacctgtagtcccagctactcgggaggctgaggcaggagaatcgcttgaacctgggaggcagaggttgcagtgaactgagatcacgccgctgcactccagcctggcaacagaatgagactccatctcaaaaaaaaaagcgtgtgtgtacccgtgtgttaaatttttattataaaatatatataacaggctgggcgtggtggctcacgcctgtaatcccagcactttgggaggccgaggcaggctgatcacgaggtcaggagatcgagaccatcctggcgagcacggtgaaacctcgtctttactaaaaatacaaaaaattagccgggcatggtggcgggcgcctgtagtcccagctactctgagagcctgaggcaggagaatggcgtgaacccaggaggcggagcttgcagtgagccgagatcgcgtcactgcactccagcctgggcgacagaccgagactccgtctcaaaaaatatatatcgatatatataacaatttacagttttaatcatcttaactgtacagttcagtggcactgagtacattcacattgttgtacagccattactaccatccatctctacaacctttcgtcttgcaaaactgaaatttcatacctattaaacactaactcccacttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatctacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtactgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggccaggcatgccatggctcacgcctgtaatcccagcactttgggaggccaaggtgggaggatcttttgagcccaggagttcaagaccagcctgagcaacatattgagaccctatctctacaaaaatatcataaaacaaaatagaatcactctggcgattccactatccaaaaaaaaaaaaaactgctgttaatatttggtatgtatctttctagaccaaggcctccaactttggttgagaattcagccgggtctgtgaccttggatgggaaaaacattcactctttattttcactaatgtctctgaaaacccagatttttagctgggcatggtggctcgtgcctgtaatcccagtgctttggaagcccgtggagggcagatcacttgagcccaggagtttgagaccagcctgggcaacatagcaagaccctgtcttttaaaaaaaaaaaaaatccagccgggtgtggtggctcatgcctgtaatcccagcactttgagaggctgaggcaggcagatcacctgaggtcaggagtttgagaccagcctgaccaacatggtgaaatcctgtctctactaaaaatacaaaaatcagccgggcatggtggtgggcgcctgtaatcccagctactccggaggctgaggcaggagaatcacttgaacccggaaggtagaggttgcagtgagccaagatcacaccattgcactccagcctgggcgacagagcgagactctgtctcaaaaaaaaaaaaaaaaatccacattttcttcaatgacaattgtaagcaacagatcatggtagtattagaatagcagtgactgtcaccagtagagatcaaagatactttcatatcatattatagttgttacagatattttgaaatatatatgtccatcactgcttcaaacttaaggtaattattagacccatctctagatctggttatttaatgatttactgaagaagcacatattatttgagaacgaactcttgaaatatgttgttaatttctgtgcattttacacatttcaaaacattcttctgaggaggggtccagaaggccaaaagggtccatggcagaaaaaggttaagaacacctgttctgtactttgtaccatgtggctacaaatataaaaacagacgttaagccgggtatggtgatgcacacctgtagttccacctacttgggaggctgaggtgggaaaatcacttgagcccaggagtttgaggccagcctgggcaacagagcaagaccccatctcttaaaaaccagtcagcacttgactagtcagttagtgggggaaaacacaggtacagtaaaaggagtcaaaattacacttaaacttaggtcatcttattatatcaaacatttattaacatgtttagtgttttgtgtatattatgcaaagtgtaatgcaactaaaactgtttaacacttctcgatatcacataaatttgttggtgcataatagcctaaaagttacttttgctgttggcattttattttattacttacttatttatttatttatttatttattttgagacagagtcacactgtcgccaggctggagtgcagtggtgcgatctcagctcactgcaacctctgcctccctggttcaagcgattctcccgcctcagcctcctgactagctgggactacaggtgcgcgccaccatgcccagctaatttttgtatttttagtagagatagggtttcgccatgttggccaggatggtcttcatctcttgaccttgtgatctgcccacctcggcctcccaaagtgctaggattacaggcatgagccaccacgctgggcctgctgttggcattttaaacatccttctagagtctttcttatttgcctgtaagcacgtacacatgttgttgttgttttgagacaaggtctgtcgcccaagctggagcacagtggtgcaatcacagctcactacagcttcgacctcttgggtgcaagtgatcctcccaatcagcctcccaagtaggtgggactacaggtgtccgctaccatgcccagctaatttttgtattttttttgtagagacggagtttcaccatgttgcccagactggtctcaaactcctttgctcaaacgatccttccgcctcggcctcccaaagtgccgggattacaagtgtgcacctctgtgcctggcccacatattgttttagatgaatgagatcatatatgtacttttgtaacttgctacctttcctcaacaaaatgttgtaaatatccatgtccataaaaatagacgtatatcttcacttttccctaaaatgaaaataacttaacttgcattttcttttttgtttttgtttttgttttgagacaggctcttgctctgttgctcaggctggagtgcagtgatgtcacagctcactacagcctccacctccagtttcaagtattccacctacctcagcctccaagatagctaagactacaggcacatgtcacgacgcctggctaatttttaaaatattttttgcagaaatgggatttcactatgttgcccaggctggcctcaaactgctggcctcaagtgatcttcctgccttggcctcccaaagtgctgggattacagtcgtgagccactgtgcccagcctgcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaatttaacaagtcccagtcttgatttttttcccccttcaaacctattcctcatgttgtctctatttcagtaaacaatatcaacatccacccagttactcagtccaaaattctaggagtcatccttgattctgctctttctttttttttttttttttgagacggagtctcgctctgtcgcccaggccggactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttttttttttttgatacggagtctcattctcgtcatccaggctggagtgcagtggtgcaatcttggctcactgcaacctccgcctcccgggttcaagcaattcttctgccccaacctcctgagtagctgggcctggctaattttttgtatttttagtagagatggggtttcaccatgttggccaggctggtcctgaactcctgaccttgtgatccgcccacctcagcctcccaaagtgctgggattacaggcgtgagccactgcacccgccctgattctgctctttctctcatcatccctgatctgtcagcaagtcctgttaggccaaccacttctcagcatctgcactgccagtatgctagtccaagccacaaaacacctctcagaggtacgcaacaggactttgttgttgttgtgtgtgtgtgtgtttttttttttttacggtagaattattttataacttgaagtgtagggatgaccttccttttaaaattttatttattttcttaattttttattcccatagattttaggggaacaggtggtatttggtgacatgagtaagttctttaatggtgatttctgagattttggtgcacccatcacccgagcagtgtacactgaacccaatttgtagtcttttatccctcaccccctcccaccctttccctcaagtccccaaagtccattgtatcattctgatgcctttgcatcctcatagcttagctcccacttatgagtgagaacatacagtgtttggttttccattcctgagttacttcacttagaataatagtctctagttccatccaggttgctgtgaatgccattaagtcattcctttttatggctgagtagtattcctttgtatatatatgccacaatttctctattcactttctgattgatgggcatttgggctggttctatatttttgtaattgtgaattgtgctgctataagcatgcgtgtgcaagtatcattatgcaacgggacttcggatgacatattgaacaacttcctcactgatatccttgtgaaacgctacatatttcatgggtctgtttgttataccaacactcaattctgaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacatacagtggtgttcccataagattagaatgccatatttttactgtaccttttctatgtttagatatacaaatacttaccattgtgttccagtgatctacagtattcagtatagtaccatgctgtacagttttatagcccaggagcaataggctatataccgtatagcctaggtgtgtagtatgctacaccatctagatttgtgtaagaacactctctgatgttagcacaaataaatcgcccaatgacacatttctcagaacatatccctgttgttgagcgactcatgactgtacaatgggggaacagctcagcctgccttccccaaggaggcaacgccgatgcagggaaccgagggttgaacagaagtgggcaaggtgcagagaggaaaaaggctttccagatggagaagagcatgtgtgaaggccctcagtctggcaagagcttagtcctgtgtggcaggagctgaacgaggggttaggggagagtggcaaagggtccgggccatcagagaggtcaacaggggctggatcatgcaggattttgaatgttaacatcagagcgatagaaaacatgaagggtaaggtggtttgggttttgaatttttatcaaaatattgcaactactcggcaacaagttagatataacaaaagaggtcatcgtaaaaacagcagtctaccccttccccttcccttccctgactcagacatgacagcttttaactgtttctgattttagttcctttgatggttacctccaaaattaaatcatatgcttatacatctttcttgatttgccaactttagggaactgtgttaactccctgaaatgaaagagaatgacttagcttacgttacctccccatgttgaaattcatattcacatttctctgtaattttttttttgagatggagtctcactctgtcgcccaggctggagtgcagtgatgtgatctcggctcactgaaacctctgcctcccgggttcaagcaattctcgtgcctcagcctcctgagtagctgggactacaggcgcacaccagtgcactgggctaatttttgtatttttagtagaggcggggtttcaccatgttggccaggctggtcttaaactcctgacctcaggtgatctgcctgccttggcctcccaaagtgctgggattacaggtgtgagctaccatgccaagcccacatttctctgtaaattttaaacagtattttagtccatatgtcagttcccctctgtttaagataaggatattaataaccctacttttccttccactttccctccttaacttctgcgtcttaaaagctgtacttgaccatacccattcttgcatttgttaacatgtgtgttctgccctgcaaccacagccaagttgtagcttaattctaaagtcgaaaataacattatttacattattacacatgtgagtattgttcttggcgagaccaaataatgaatgtgcccaggattacatttccttctttacagatctggaccactcaaaggagaatgaccaatcaaggtcaaatggattcccttttcttagactctgtcacctgcttaaaatccttgctaggatttaatctacttcatattcaaaccttggcttgcttatatagctctttgttttgcccaccatttctagttgcctttttattttgtttactattcctccttgattatgttgtaaaatgctattagcagtgctgtttatttcgtacgattcggctttttccccactgaagacctttctcttggaaggcctctgcccttctgcaatctgggcaagtatctgctctttgatttaaggttgcatatacagctgtacctggaccttctcctcactgggctcttgggttggagcccgtgtcttaaaacccatatcttcctttcacatggtttactccctcgttttctggactgcatccttaaataatgtgctcagatagagtgcatggggagtaaactgtagtggataccgttgtcacctaccccatatccatttcttctttgcccattcctaacagaatcctgatattattcacctttctaccttattcccaacttcagaaaggatccttaagtcattccacacattgcattcctttggcaactgttactggtcaaggatggacatacgatctaagttggttcactcagactgaagggaaggacttccatggcacgttcagggaagactttctctttttctctcactggagtaagtgagaaaggtgttgctgggggctcttctgtaacctcagactgagggacaaagcctgaggataaagcctgctcaccaaggaaggcggagcagagaaacgggaagaacctgggtcttgatgccgttgcttagctggtgattgcactgtggctggggcctgtcctacctgagctagggactcagataggatggactttcttactgaatgagccagcttcagttttcttttctgttacttgtaaccaaaagcattgtaacagataggtcttctgagtcactgcatgcctgaaatacctttcttctactcttacacttgattggctgagtatagggttccaagttgaaaatcattttttctcctaactttggaggcatctcttctagtatgcagagtaacaaatgcaacaaatgcctgatgccaatcttattatggttcttttgtaggtgcccttcttttctcttccttccctggaagtttttaggatttcgtctccttatttttagtgtcctgaaatctcatgagaatatgtctagagttgtgtcttgttcactcgttgtactgtggtcattcaatctgaatacttttgtcaactcttttttttaaaaaaaaattactaatttacatgctttcattttctctatggggactactgtttaactttggacctcttatattggtcttctgtcttctctcatatttttcatttattgggcggtggggggtgctctgaattttggaagatctcctgcatttattttctttttccttttttctttttttttgaggcagagtcttgctctgtcacccaggctggagtgcagtagcctgatctcggctcactgcaacctctgccttccaggttcaagcaattctgcctctgcctcccacgtagctgggattacagacctgcaccaccacgcccggctaatttttgtatttttaatagagatggggtttcaccatgttgccaggctggtctcgaactcctgacctcaagtgatccgcccgcctcagcctcccaaagtggtgtgagccaccgcacccagcctcctgactttattttctatcccttctgttaaattctttatttcagccaaacctttttttttttttttttaacttactgtgaagcctgtgtgcctactgcctagattagacaattgttaacattttggcgtattttcctggtctgtatagatagggtgcatttttatacctttttgctcaccatttaaaaggaactcacagatgtcacgacatttcacccctaagtacttcagtatacatctcctaaaaataaggacattttccaatataagcacaataccccgatcacatctttaaaagttaacaataattctctaatgttatcaggcacccactttaaattcagatttcctccaaatgtctcttatcgctgttgaggggctccaaagcaattaagatttatacattgcatttgaatatgcttcctttgtctcttatttatttatttattttattttgagacagagtctcgctgtctcccaggctggagtgcagtggtgtgatctcagctcactgcaacctccgccttccaggttcaagcgattctcctgcctcagcctcccaaatagctgggattacaggtacgcaccaccacgcccagctaacttttttgtatttttagtagagacagggtttctactaaaccatgttggccaggctggttttgaactcctgacctcaagtgatctgcccgcctcggcctcccaaagttctaggattataggcgtgagccaccatgcccagcccctttgtctcttttaacaagaacagcctacccacctctccttcacttgtgatactgactttttgaagcagtcagcccaattgtcatctagaagggcccacattttaagatacatatttttagagatggcgtgtcactatgttgcctaggctggccttgaactcctggcctcaagtaatcctcctgcctcagcctcccaggtagctgggactacaggcttgtgccaccacgactagctggcccacattttagatgtctctcttttcttgtgatataatttaacttgtttgtccatatatattacttgtagacaagaagttaggtctacaggcatgttcaggttaaacattttgggcaagaatatttcataggcagtactgtgtacttcatatagcatcagctcaccaggcacttaatggttggttaccctgtggtttgtgatgctacgttttaacacttgattaaagaaggaggtgactgccaaatctccccattgtagacatacagttttcctgtggtaattgatatataatctgtgatgtgatgctttggcaccatacaaatatcctattgcccaacagccatttgcataattattttagcattcattgatccttgcctgaaaccattattacattgggggttgcaaaatgatagtttttttaattgtcacctcttctacatttagtactgtcattcctctgtaatgaattttccctcatcaaataaggaggcattatatttcctcctaaaaagacagtatagatgcttaatctttgcctttattacatttcagagtaaggagttggtagaataatcacctcaaatggtggcaaaatatttgctgttgtgtttccttttctctttcatgtcaatatggactcatagggatttatttattaaatgttttacaattcaaattgggtcaacaagagtcccttcatgttggttcctatattctcctggcataccctcattaattagtctttgagcaatttcttgttttctggcacaagatattccatcccaatatgtgcttttcgtgtcctagaactgattccaaggagctctggttccttatagtggcaacggtatttagaatccaacatgtgggtactaaatgtgctgattcttactggggtaacattatatctaggcactttcagaggacatcgctagaaaatatattcagtttttattttttatttttaatttttttgtagagacaaggtctcactatgttgcccaagctggtttcgaactgagctcaagcgatcctcccacctcagcctcccaaagtgctgggattacatctgtcagggcaaactgctggtaaatattttcacaaaagaaaaataaaaaaaccaaagtgctgggattacagatgtgagccactgtgccctccattttttttttaagtcataaatacataatgatgtcttctatggcaatttaacattacagggttcttccttaactttttttttttttttcttttttttgaggcagggtcttgctctattgcccaggctggagtggtgcagtggtacaatcctaattcactgcagcttcaaatgcctaggcttcaaacaatcctcctccctcagcctcccgagtagctaagactacaggtgcatatcaccatgcccagctaatttttaaaaattttttgtagagatggggggtctcgttgcgttgcccaggctggtctcgaactcctggcctcaagtgatcctcccatctcgatttcccaaagtgctgggattacaggtgtgagccaccatgcctggccaacttttatttgatctgtatatatcttttccttacactgaaaatgttgggtcttactaatgttaacatagttacttatttgctttatcttgtaatagacataaaattacaaaattataataccaatattacgataaatagctgggcatggcggcgctcgcctgtagtcccagctactcaggaagctgaggtggagggactgcttgaacctaagagtttgaagctgcagtgagctgtggttgtgccactgtactcctacccggacaacagagtgagtggggggaaaaaaaagaaataatggaagatccagagaaagccccaaatatttaaaaattaaacaatacactttgcagcttcctcacctctctcagccttcatagaattgaagagagttagggccttgcactagattaggctttgccttaaggaaatgttgtgtttgatttgatcttttatccagaccattaaaacttccttaacgtttattagtaataaggctatttcactttcatatcatttgtgtgttcactggagtagcacttttagtttccttcaagaactttgattcacaacttggctaactttggtacaagaggcctagcttttggcttctcggctttcaacatgcctctcactaagcctgatcatttggtttttggtttaaagagaaagacatatgactcttccttttacttgaatgcttagaggccattgtagggttattaattggcctaatttcagtactgtcttgtccaagggaatagggaggcccaaggagagagagagagatgggggaacagctgattggtggagtagtcagaatatacacatttatcacttaagttttgccatcttttctttttctttttcttttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggccaggctggtctcgaattcctgacctcaagtgatccacccgccttggcctcccaaagtgcggggattacaggcgtaagccactgccgcctggccaagtttgccaccttttttattttttttattttttgagatggagtctcactccatcacccaggctggagtgcagtgatgcaatctcggctcactgcagtctctgcctcctggattcaagcgattctcctgcctcagcctcccgagtagctgggactacaggcatgtgccagcacgcccagcttgttttttgtatttttagtagagacggggtttcaccatgttggccaggctggtctccaactcctgacctcaggtgatctgcccggctcagcctcccaaagtgctgggattacaggcgtgagccaccccgcccggccaagtttgccatcttttatgggtgcagtttgtggtgccgcaaaatgatgatagtagtaacatcagagagcattgatcacagatcaccataacaaatataataatgagaaatttgaaacattgtgaaaattaccaaaatgtgacagagacatgaagtaagcacatgctattggaaaaatggcactggtaaacttgcttgatgcagggttgccacacaccttcaatttgttaaaaactcagtatctgcgaagtacagtaaagcaaagcacaatcaaatgaggtgcgcctgcatattacaaccaagaggcttttcgcagaaacacgagtgtgcttcaacattcaaaaatcagttggtgtaattcaccacattaagataataaaggaggccgggtgcggtggctcacacctgtaatcccagcactttcagaagccgaggtggacagatcacttgaggccaggagtttgagagcagcctggccaacatagtgaaatcctgtctctactaaaaatagaaaaattagccgggcagggtggcacgcacctttagtcccagctattcgggaggctgaggcaggtgaatccttgaaaccaagaggcggaggttgcagtaagctgagatcacgccaatgcattctagcctgggcaacagtgagacccagtatccaaaaaaaaaaaaaaaaaaaaaaaagataataaaggagaaaaaccatatagtctattcaataaatacagaaaacgcatctgacaaaattcagtgccctttcatgataaaaattcagcagattagaaatagaggaagtgcatgtatgaaagagctacagatagattgtacttaattgtgaaatattgaacatgttaccccgaaaatcaggaaaaaggcaaagatgtccactctaaccacttctattcaacattatactagaggtcatagccagtataatgaggcaagaaaaaacataagaggcattaatatttaaaggaagtaaaactgtttctatttgtaggtaatgtcgaaaatgtgaaagaaactatcagaacctgctagaactaaaaagtgaattcagcaaggtctcagggtacgagatcattcaaaaactaatcagaaatgaaatttcaaatgcaatatcgttaggaataatttaataagaaatgtacaagatttacacgctgaaactgaaaatgttgctgaaagaaattaaagacctaaataaatggaatgttgtaccatgttcatcagctgaaagactaagtgtctttacagtgtcagttctcccttcattgaactgtagattcataaccccagtcataactgcagggttttttttgtagaaattgattgtaaaatgtatatggaagctgggcacggtggcttatgcctgtaaaccagcactttgggaggctgaggcagacagatgacttgaggtcaggaatttgagaccagcctggctaacatgacgaaaccccgtctctacaaaaaatacaaaaattagccagacatggtggcacacacctgtaatcccagctacttgggaggctgaggcatgagaatcacttgaacccggaggtggaggttgcagtgagccaagatcatgccactgcacgcccgcctgggcaacagagtgagactttgcctcaaataaataaataaataaaacgtatatggaaatgcaaaggacctagaacatccaaagtaaacttgaaagagaacaaaattaaggggcttatgtgatgtgactttatagtcatttgatttttaacagaggcaccagaacagtccggtgcgggaaaggaaagtcttttagcacgtgccggatgatggcaaatgacatccataccagacaaaaatgaaccttgaccttaccctaaatattagtttcttagagttgccacaaactaggtggcttaaaaccacagaaatttggctgggtgcggtggctgacgcctgtaatcccggcctttgggaggccgagtcgggcagatcacctgaggtcaggagtgcaagactagcctggccaacgtggtgaaactttgtctctactaaaaatacaaaaaacttagtcaggtgtagtggtgcacacatataatcccagctagccaggaggctgaggcaggagaattgcatgaacctgggaggttgcactgagccaagattgcaccactgcactccagcctgggtgacagagtgagactccgtctcaaaacaaaaccacagaaatttgctgtctcataattccagagtctagaagtccaaaatcaactgtcatcagggccatggtctctgtgaaacctgtaggggagtccttccttgcctcttcctagcttccagtggttggcaacctttggcattctttgatttgcagctgcattacttcaatatctgtcttcctcatcacacagcattctccatgtatgtctctgtctttacatggcctccttcttgtaagaacaacagtaatattggattggggcctgccctactccagtgtgacctcaccttaactaattacacctgcaacaacgctgtttccaactaaggtctcagtgtgaggtactgagggttaggacttcaacatatcttttttgggggacatagtccaacccatgacactacttcacaccatacataaaaattaattcatgagagattatagacctaaatgttttaaaagctaaaaatataaagcttctgcaagaaaacataggagaatatctgtgcagtccaaagaataaggttttttttaaacacaatttcactctgttgcccaggctggagtgcagtggtgcgatctcagctcactgcaacctctgcctcccgagttcaagcgattcccatgcctcagccttccaagtagctgggattacaggtgtgcgccaccatgcctggctaatttttgtatttttagtagaggcagggttttgccatgttggccaggctggtctcaaactcctgacctcaagtgatctgcctgcctcggcctcccaaagtgctgggattacaggtatgagccaccgtgccaggccaaaaaaagatttattaggatacatgaagcaatagctattaaaagaaaaaataaattggacttcattaaaatttaaaacttttggtcctcaaaagataccattaagaaaatgaaaagacagagctgggcgtggtgaggcttgcctgtagtcactactgggtacttgagaggctgaggcaggaggatcacttgagcccaggagttctaggccaacataggcaatatagtgagacagtgtctcttaaaaaaaaaaagaaaaagaaaaaacaaaagaaaataggctgagagctgtggctcatgcttgtaatcccagcactttgggagtacaaggcagatggattgcttgagctcaggagttcaagaccagcctgggcaacagtgaaatcccatctctacaaaagatacaaaaaattagccaaccatggtggcgtgcacccgtagtccatagtcccagctactcgggaagcagaggcaggaggattgcttgatcccaaggaggtcaaggctgcagtgagctgaggtcgcgccaccgcaccccagcctgggtgactgagtgagaccctgtctcaaagaaaatgaaaagacaagtccaccaagaaaacagttgagaccagtcatagaaaaaatagaaagtcatatctgacaaaggatttgtattcagaagaattcctataactcggtaataaaaagacaacctgatttttaaagggtgaaaatattttaatggatacttttttttttttttttgagacagagtctcactgtgtcacctaggctggagtgcagtggtgccatcatacatagctcactgcagactcgaactcctgggctcaagtggtcttcctgcctcagcctcctgcgtagctaggactacaagcacgtgccactatgcctggctaatttttaaattttttgtagacatgggctggtgtgtgtctgtgttgtctaggctggtcttgaactcctgggctcaagtgatcctcccacctctgccccccaaagtgctgggccaccacgcctggtgtggtgtcaccagagatgagccaccatgccctgcctgatacttttcttttatcatctgtttatttcttgtttatgggtgtttctgttctgattttatgactattctgtattctaagatttctctgagaatattatttgtttcctctaaggacagacttggtctctcttccatggggctggttcttgagccgccagggatggggggaggacctgggtagctgctgcgctgccccttctctgctgtggtggagtggcccgttgcctgcggggtctgtctctgaagggtggtttggagaagttctgtggaggcgaggcaggggtcagctcttgccccatggaccctcagagactgggaaaaggtaggcatcacctgggctgctgccagccacatcaagagcctttggggtgggtggggtgggggccggggaagggaaggttctagctgttgatttagaaaagacccattgatttcttgcctgagggaagaagtggcaccttgccactccaagtttgctctgctcaccagccccaacagcatcagcctcacctgggagcttattgaaggtgccctgccccaaagcttgtgggtcgggatctggcagtcagcagcccccaggtgttgcacacatgacagcactgcttgcccctcctctcgtctggtctggtctggtctggtctggtctggtctgagagcttctttggggctctgacaggtatacaggctctcatctgctctacagctctcttgtagtacattcctctctgttccattagtcaacatgttcttgcctacttccagcatctagaaatttgctgagtgtatcttatccgttcagaggtcctctcctgctattgcctctgttagaaatttcttccctttcatatgtctgtacttcggtttctttgaggtttgaagggtcaagtggcaattacatgtaggcagttggccatcctctggtgaaggctttaaagcccaggaataacaagatccattatgtctaaaactagcaaaaaccctacctgtcacatggtgaactgaattagaggtgatggggacagaagccagattggagtgagtggaaggtgagggagtggagattgggtatagacaactctctttaagaagttttgttgtgatggtgaccagaaaaataggagtggggtagagggggatgagggtgtttttcacgtgggtgaatatgagagcatgtttacatccttctgggaatggcccaggagagaggggagcgtgagaaggaggaaatggggacctggaggagcagactccttgtgtggaggggggaagcggcatctagagctgttgcaggaggtgggctttgagtaaatgcttcctctttggtaaagacggggaacgggaacggtagaagttgcacggaccctttgttaaagctcagaagctgagcgagaattagagcttaagtttatggagtagtcagaataaagtacccctaactgtattcttgcacagtgcaggaagccaggggtctgaaatcaagatgttgcagggctccattccccccagagcctctagcatggatccttccttgcctcttccagcttttggtggctgcctggcagtcctagactttccttggcttgcagttgcattgctccattctctgcttgtgtcttcacatggccttctctgtgtccccgtattcttctctggatgcttgtcactgtattaggcccaccctaaatccaggatgatctcatatcaagatccttcacttaattacagaagcaaagaccttccaaataaggtcagagccacagggtctgggggttaagacatacacctaactattcggggctaccatcgaacccctgtagaagcctgtccatttccaggatagcagagcccaaggaagggccagaagtccccccaaaacagttgtttgcattcaccagattctaagctataagcagatgggcagtggcagtcggtcctaatccatataccattggcaacaatagtttagttcactgtagacataatgagatgcttatcttctgctaagtagtcctcatggtaacagccatattactcctggctttgagtgacagcgctgtgctcttgtctggtgcccatatacttcagcagctggaaacaagacagtgctcatgattcaccggaaagtttctgtagttaaaatcaagtgatcccttgagtctattctaatatttgtctgtaccatgttctgtgacgagacatggaaacaaaacattaagaagtgaaagtatctttgattatgctcttgaagacaactttttgtttgtttgttttgtttgagacggagtttcactcttgttgcccagcctggagtgcaatggtgtgatctcggctcactgcaacctccgcattcccgggttcaagcgattctcctgcctcagcctcccaagtagccaggattacaggcatgcaccaccacgcctggctaattttttttattttagtagagacggggtttcaccatgctagtcagactggtctcaaactcctgacctcaggtgatccgcctgcctctgcctcccaaagtgccgggattacaggtgtgagccaccgtgcctggccgaagacaactttttaaagatgcatatgctctgggctgggtgtggtggctcacacctgtaatcccagcactttgggaggccaaggcgggcagatcacctgaggtcaggggttcaagaccagcctggccaacatggtgaaacaccgtctctactaaaagtataaaaattagccgggtgtggtggcgggtgcctgtaatcacagctactcaggaggctgaggcaggagaatcgcttgaaccccagaggcggaggttgcagtgaattgagactgtgccactgcactccagcctgggcgacagagtgagacttggtctcaataaataaaataaaataaagatgcatatatgctctgaaggctggctacattttattttttctcaaacaacttttacagtggatagtgctgtaaaagttgtttagctctggtcattttatcttttttgtgatctgcaaaaggagatccttttccttttcactgcctctaatacccaactccaatactcctttgacctcacaggcacttagaatccatcagtggctccatcttttctcagacttcacctccttcgtatccttattcctctcctttgtagcttcagtgccagtcagacgtcgttactccctggcacactacctcagcccttcggcactttcttgctttgttatattcagtcgacaaagccccagcctcatgaaattcagtcatgtctgccccatgcctgctccgtcctgaagctgaatgtgactccttcattgattccccctttaagttcatgtctaccccaggtaaacttcttgccgccaagcccacctgcatactgcagttccccggtctctcctagcccctcccaccctcctcatcagctgtcacacctccttgcagctgatatcttagttcccagagagcacagaagcaagctcaagagagtgtctacaggccagcgtctactccttcgctctgcctccctcatgctgtcacggagcgcctgtcccaggccctcactcctgttctaaggcatctctccagtcctctactgcactctcccccatcagagattcctccctcgcctgccctagaaacttgttgctacttctcccaccttgacaaaagctgctcccaaccccccacctgtctagcatctctgttttcctttaccagcaagactccagtccctgtctccacaccctcttcaaccttctccagttgttcctttgctgccacagctctgccaagctgctccatgaggtctccagtgatgaccttcatgttgttaaatctgggagctgcttgtcacttcttttcccagagctgtcgtcgtcagttaaccccaatacccatacgagacaatcctttccctcccttgagtctctgcactgatgtgcaccttctcagtgcaaaccacagcttttgtctctttctagctgaatacatgactgactgtgcttatcttagctgtcacccctgctggagcagaagctccacaggacaggattgtctccttgattcacagatgtagctcaagctcctagaacagtgcctggtgtctgtgggtcctcaggaagtcctaggtgagtgtgtgaatgtctgtcctcctcggtcttttctgtttcgcatgtgatgttggaaggcctcaggttcaggcttttcttctccaccctcactcccgaagtgattccgtccagcctcatggctcccaaatttatgtctccaggctgactgggtcacgggaactccttatcctccctagaccttctctttccctggtcttctcctttccagtaaacagcaactccaactcctgctcctcaggccagaaacctggcgctggttacctcatttgttcacaaatactgttactccacctgcaagatggatacaaaatctcatgagttcccctgcctccacggcccccaccctggtccaggtgtccagcttccctgcctctgcccttgccccctggttctttgtttagtcctgcaatattgtgctcttctgttcagaaccctccagtgggtccctgcttgctcagagtcacagcccaacaggatcacctctcttgccactctcccaccactcatgcactgcggcctcactggcctcctggctcctccctggaccctccaagtatgcccctgcctcaaggccttgacctctcctctgccctctgtcccaggtatcacacatgtctgctcaagtgtcaccttcccaatgtggccttccccgagcacacccatgtctgtaagtcaggcagcctgcctctgccccaccagttccccctgcctagcataggacttgtcaccatctgccacaagctgtgttactgcttggttttgtttgtgctctcccactcccttcccctccctccctctccccacccctatagaatctgagtcccatgaggacagagatttttttttttgcctcttcctcaatatatccccagtgcctagaatcatgcatattttaatttattgagtgaattaacaaataaattctgcagtgggacattgctctaaggttttgtcttataagagggacagaagaacatgcagcctgctctgctgttggctccttagcttctccatggctaacaggaacaatattgtttatgagataatcaaagccatagtcatgagttagaaggtacatataaaggcaaatatgtggagattgagttactttggcgggggcggaggggtgtgtagttatctgaaaacatggaacaaatcaatgagagtctaaatagcacccacatatttgcccctcttttaaaacatacctcctttatgagtgtagaatttaacagcacagtttcccagtgcagctttgcgaaacaagagaaatgaattttaaaggctgtcaggtgcctttgcaatctgtggcttagtatttgtgtaacaacatttgtgttttgccaacagatgtactgcttaaagtacccatgagaatggcctctgtggttttctactttctcggatggaaccttaggaactgattattgagaagaggctgatactgcccacctcagctcccaggcaggcttcagggccttggttactactcctttgggccctcactgacccttgcagacgtcttttgcaacctctgtagccagaagagacaactgctttctggcatgttgctctttccctaatggctttatgagcttcttgaacaccaaagcatgtgtgacttcctcacgccttcccctgtatagtatagcacccctaactgtatgtgtaaggagaaggagtgagcaattgatggcgtccccctggatctccaagggaatgggaaggggcagggtttctggattcagtcatgtggaatctggtcgttggtgtctaaatgtgcctgttacttgtgcccaatgtccaggttcaccaggaggcttagcctgctcatttccctgctagtagctatattttgggagagcattttttatgctctaattgaactttgtgggtctcagcaatttgaacaatgttttgtttttcttctggtcaggttacaaaggaaagaaaaggaatctggtgttgtaggaggtggtgtgttgtgtaattacttgttttttttttttaagtttttttatatttttgcaacaaggcaagttttctttgaataaataatgctgggagcttatcacatagaaggcatatgtgttgtactcagtacattctgaattatctgggtttatttttatctcttgaattcacttataaacaattcaaaggctgcttttttagctaacagaaataggaagagaatctcagaatctgttttgtcattttttcaatgggttgagttatagtgattatgctaactcggtggaaaagcagtgtagtgagtaaaccccacatacggcatatcatgaacattttgttgcttttttggcttctgaccatcttcatacctttttttgtgttaaaagtctccccattgtgtatatcttagtaagaggcaggtggaccctagtttctacctaagaaaacctgaagatggggttgggggcctgtggtgtacttccttctcatgctgtccatgaccactgcagtggctttgtaaggatccaggacccagggcccctcagtgggtgtcttccatttctcaagattgcctcttggttgtgagatgacggttgctgctctagtcattgcatccactcctccaggtaggaagaaagaggtcataggggaaaggcaaaatggcacttgacatcttaacttctaggcccattcaatatttccatttccatcttcacacccatcatcttgtcctagggaacaaacagcaccagcagctcagtagctataacagcaattattatttctcacacatgggtctgggtcagctgcaagatgggattcagatctgttctcaagcctgtcgttccaggacccaggagggagaagcagctgccaggggaagtctcttcgtaggcggaggtcaggagtccaagaggagtgagcagagtcacagaagcctcttaaagcctcttcttcccccatcccatcaacacgtgagcaagcccagagtcagtgggtgggaggtgtgctccgcccatagtcagtagaacaagagcaagcttgaaagagaacgatgaacaggagtgcactcggccactgtctccttagccataacgtagtcccatggtctgctgggaagcggggaataactctccttagctgagcgcagggtctcattagtaaggcagatggagaacatggatgttgggggacaactggcagtgcctgccacaggggaatggatatattccctccccttgctctctggaaactaggggatggcgatgaagcctaggtttggccaaacccattctgccttcagggactttgactcttgagggacagtgagggattagtcatggtggtggcagttgagtcacaaaaccagcagtggtggctaatgtccagtgatgacatgcaacagtgcccagggtgggtgtcccaaccagcaggtccctgcagtataaccttggctgtgtttgcagtggtgcagcctctattcctgctgcttttctgagcctagttctctagttctctctccatttccagatctgctgcccaagaactcctttgtgattgaatttaaccagagttgatttctgttgcttgaaactcaggaccttgatgcagtgtgcagggtctgggcaaggtaaaaacacactttcatgatttcgcctcaagtatagtagatgagcttaggctttttgagccaggtagccttgggattaattctcagctcttgcacctagcaggtgacctcagcaatcaagtcacttgccctccttgagcctcagtgttgccctcagttaaacattgctctcgtgtgttgctgagcattcagtgagattgtatataaagtgatcattgtgaaggtattgggacataatttgggaaagcgtcctggtctaagcttttgattggctctccatcatttgggtaatgggatagtgatttaggagtatcatagcagctcaaggggcccttctggaaagggtatgaggaaggtcagggacaagtctgaaatgaatcatcctaggcttaatgcctgtgactgggcagtgggtacaattatctcaggctagtcagtagtcatttattgtgagaatacatgggcagattttttaatttccttctcagtctagacttgaatgcaaacagttcttattgctaacttaccactagtcaccactaatgaacaaagactatgaacaggaaattcataaaagaagagatacagatggccaatgaagataggaaaagagttctgcctgctggtaatcaaagagatgcaaacgagaacaaaaatgatgccttttcacctaccaaatttgtcaagattaaaaagaaagcaaagagccagcgtcagctgatgttcatacctgcacctgctcggtagcttgctaatgttctgcctgctccacacgccaggccagcctccacggcgcagccaggtgaggcctttccttgtatacaggcacgtttggattcactgttgcataagtgagacatgtgcatgcttcacaattcaggaagtgcaaactccagagtgatgcaaggtctgagtgtccctgctgccctggtctcccagctgcctaggcctctcttcagggaacggctgcatccagggtcttgtctgtgtcttttgaggtgttctatgtacacgcagacacatctaaacctatttttattttccctgcacctgcttgggctactgtaagctgttaaatttttttttctaggaatttgtccattttgtctgactagcataaagttgttcatgttatagtttatacatttgcaacatctgtaattatgtctgctttttcattcctagtgtttgttgtttacttgtaccttctcccgtttttccttgtcttggtaaaagctcattaggttcattggtcttacaagaagcagacatgtaggcattattgccctgtattactctgtgtctcttttctagttcattaaattctgcttttgcttttatctttattattttttctatggtcttagagtacattctctgtgttttgttgttgttgttgttgttgtttgttttttgttttgagagagagagtcttgctctgtcgcccaggctggagtgcagtagtgcaatctcagctcactgcaacctccacctcctgggttcaagtgattctcgtgcctcaacctcccgagtagctgagatttacaggcatttgccccacacccggcaaattttttgtatttttagtagagatggggttttggcatgttgaccaggcgggtctcgaactgctgacgccaggtgctccacccgccttggcctcccaaagtgctgggattacaggcatgagccaccacgcctggccctaacttcttaagttataaatttggttcattgatttttctacccttttttcaaatgtaaacatttaaggctaaccctctggaactacttcaactgtatctagcaagttctgatagtattgtcactttaagttagcccaaagatattttaaattttctttgtttcttcctttgactcacatattattttaaaatgtgtttttcaatttccaagcacatggctttgggtttgttttttttttttcctagttgctctagaaaaaaaaattgactgcatgaggtggctcatgcctgtaatcccagcactttgggaggccgaggcgggcagatcacctgaggtcaggagttcgagaccagcctggccaacatgccaaaacctcgtctctactaaaaatacaaaattagccgggcatggtggcacacacctgtagttccagctactcgggaggctgaggcaggagaatcacttgaaccgggaggcagtggtcacagtgagccaagattgtgccagtgtactccagcctgggcaacaagagcaatactccgtctcaaaaaaaaaaaagaaaaaaagaaaaaatcaacttctaactaaatggcactgtgatcaaagaacttggtctgtgtgacaccagttcttgcagttggttgagaagtgctccatgacacattatccacaaccagtggacagaatatgtcaccaccaagcatgggtgcaggattctacatatattcattacctctgtcttatccgtttgttgtgaaagtattttctcttcttactgtcattttgtttacttgatttatcaactgatggaatacgtgttaaaacctactgtggtgatggacacatcagtttctccacagagtttggtcattttcattttattatttattttgaggccacattttcagttttagatacagtttcacattcctggtgtattgaaccctttggtattatgaagcgaccatactaatatgttatttttttttaaattattatttattttatttatttttctttcttttttttttttttgagacagggtctccctctgtcacccagtctggagtgcagtggtgcaatctcagctcactgcaacctccgcctcctgggctcaagtggtcctcccacctcagcctcctgagtagctgggattacaggcttgcaccagcgcgcctggctaagtttttgtatttttagtagagacagggttttgccatgttgcccagactggtctcaaactcctgggctcaagcagttcaccagccttggcctctaaaagtgttgggattacaggtgtgagccaccacgcccggccatcccagttttttattttcctcctttctgtgtctttatgcatcagtgaggtggagcttttgaaaatgtcagatagctagattttttttttttgagacggagttttgctcttgttgcccaggctggagtgcaatggcgtgatctcggctcactgcaacctccacctcccaggttcaaaacaattctcctgccgcagcctcctgagtagctgggactacaggcacgtgccaccacacccggctaattttgtatttttagtagagatgtggtttcaccatgttggccaggctggtctcaaactcctcacctcagctgatcacccgcctcagcctcccaaagtgttggaattacagacgtgagccaccatgcccagctgatagctagattttttttttttttttttttttgagacggagtcttgctctgtcgcccaggctggagtgcggtggcgcgatctcggctcactgcaagctccgccccccgggttcatgccattctcctgcttcagcctccagagtagctgggactacaggtgcccgccaccacgcgtggctgattttttttttttttttttttttgtatttttagtagagacggggtttcaccgtgtcagccaggatggtctcgatctcctgacctcgtgatccgcccgcctcagcctcccaaagtgctgggattacaggcgtgagccaccgcacccggcctcgagattttttaaaaaatccattgtctgtttcgtcctttaacatctatttgatttctgatgtatttagattcatttatagcatatttgtgcattctatttttccatattttctgttcttttaaattttccttctcctttcttgccttctcttagacttttaaaaaaattgtagtaaaatacacatcacctaaaatttaccatttttaaatgtacagttcagtggcattaaatacaaattggaggccaggcatggtggctcatgcctggaatcccagcactttgagaggctgaggtgggaggattgcttgaacctggaggtcgaggttgcagtgaggtgtgatcacactactgctatagcccaggcaacagagtgagaacctatctaaaaaaacaaacaaacaaacaaacaaacagattggcatcacacagtgtgtgtgctgctgtgctgtgctgttatcatttaacattaaaacataaacatcagcactgttatggactgaatgtttgtgtcccccaaaattccagtgttgaagctcaaacctccaatgtgatgttatttggagatggggtatttgagaggtggttaggtttagatgaaatcaggagggagggtgggtttcgcatgatgagattagtgtccttataacaagagacagcagagagcttgctttctccaccatgtgagtatgcaatgagaaggcagccatctccaagtcagaaagagagccctcaccaggggctgaatgtgctgacaccttgatcttggacttctagcctccagaactgtgagaaatttcagttgaataggccccccagtctgtactattttgttatagcttgagcagactaatacacccatgttatgaaaagctataaacatccctttaaaggccacctaacgcgtcgtattacctcatgcatcttctctgctgagctttccaaaagagtggcttaggctgggcctggtggctcatgcctgtaatcccagcactttgggaggccaaggcaggtggatcacctgaggtcaggagttcaagaccagcctgaccaacatggagaaatcccgtccctactaaaaatacaaaattagctgggcgtggtggcgcatgcctgtaatcccagctacttgggaggctgagccaggagaatcacttgaacctgggagatggagggtgcagtgagccgagatcgtgccattgcattccagcccggccaacaagagcgaaactccatctcaaaaaaaaagagtggctggccgggcgcagtggctcacgcctgtaatccccgcactgtgggaggccgaggtgggtggatcacgaggtcaggagttcaaaaccagcctggccgagatggtgaaaccccgtctctactaaaaatagaaaaactagccaggcgcagtggcaggcgcctgtaatcccagctacttgggtggctgaggcaggagaatcgcttgaacctggggggcggaggttgcagtgagccaagatggtgccactgcactccagcctgggtgacacagtgagaccccgtctcaaaaaaaaaaaaaaaaaaaaaaaaagtggcgtatgttcccggtctccacctctcattcgccagcccctgtgaccaaacccctgggattagatctccatcgggtccctcccctcaccctaacctcacatgcagtggttcctgagaagctgctgtttatctgatcacgggatccagcaggatctgagggctcattcactgaatctgtactacccaacaaggcaggcttgtccttacccacacttttcaggtgaaaacttaatcagattcaagcgtttatcttagtggcctcttcgtggtgtgtgatttccttcttgcagctctttactggctaaaactcttcactgggagttaaaccaggtgtggtccttgaccctcatcattttgtcccatctcctatgctgggctctgtatccttgtctccaagcagtctcgtgtgacagggaagttacctattattgtatggtcccctcttcttgtcacctctggtgtggcacttgttccatttcttgttcaatgaatgtgatttgtgaatgtgccacatctgtgggaggaaggcagttcgcagcaagagttgtagttcccttgctttgccctgagggccaggactttacactagatttttttgttgcattcctgcactcataaagtacacgtaaacttagaggtggtgtgttaaatgctagaacttaaaactgagttcagctaggctcaagtgccccacaatttttgtcccaccagacaatttcatgaatatctacagattgttccctcaatatacctcaatattgaggcatattgatttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagctgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttggggggaaaaaaaaagaaaaaggcttgtggggcgtgtgtgcattttagtcagattttactgtgcaaaacatttgagagatttctgccctctttctcccttccattcttctcaacccactgggcgccctaccacccctgtctccttcaagataaggtagatcagaagaccaaatagacaaatgccatgtccactgttttctgtcacagttgatagccataccagtcacccaagctggaaacccaacaggcccctgcccttcactgcccacatccaagggagccaccaagtcccacaaattgttcctttaactgtttgtccctcttttgtcttctgtcatcccttctaccgctgtcctggttcaatccctcatcttgctctgggactcccatgataacttatgatctttcctccacctctctatcttccacacaatccctatcatcaatctcattcccctgctttaaacccaagagtggcaccctgtgtttgagtgacatcagggcccctcatgtggctcctgcttctctttgtggccccttctgttgctgctgcttttcttatggacatagccctcagcagtccaggactgcttgtagttcctcccaggtaccatgtttcttgcactcctggcctttgtcattggctcccctgcccaagtccccttctcttctcctttccttcccctgtggccttgccttgtcgtgcttatccttgaagaccctgtcaggtatctcttccccaaagagccctgcctaaccaccgcccccctcccccccgcgacacacacacctgggttaggccctgcctctccacgcctgtgcctcctgccaagtcctcagaggtctctgatcccatgtgcctccaggcatggcatagggggactgtgacacagcctctcggcccacagacccctgattgtgggcttgctcactgccccagtcagtcctcttattgaggattccgtgccagttcctgactccagcacacacacgcatgtaggccgccctcctagtgcctggctccttccctgtctcttctgccactcattcccatggtcgtatcctggagttggtcatctctggaactccacccacggagttctaacttagctctgcctatgatgaggacttactgtcttcccagcttgcagtgtcaaccactgtttgatgcccctgggactccattggtcttccctcctcttgtgaactgtgcccatcaccagacgaacttgttttagaatttaccatcgtaactgagctcccttcagcgcatacctccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggcccacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaaccatcaccacatgcatcttcaatagcttttcatcagtccttgtctgcataaatcagctagagttggtttctattgattgccaccaataatcttgacagatatgtctgatcttccttctctgcactgactcctctttctctgtctcctctgctgattctttctcctcatcacaactccaaatagcagggggagggttgtttacacttatattcagcacgccctcacgcactcgcctggctcttcagacctctcccctgaactccagattcatacatccagctgccctttaggcctctagaaagctaaatacctcagtatcaaaaacatgagaaacggaagccagagtcctggatctctcgccctttcgctgtcccggtgcccatgcccttcagggatggcacctagaccagctccctgcatccctgcctagactctgcagtagtctcacgtggcagacccggaggtcactctcctctctggatgccctgcggacactccggttagcctcagctgcaagagcctcctcacccaaggtcacgccatttccaggacagcaccctggtgactgagcgaggtaagggtacaaggcccttatagggccttctctttgacttcttcccacctccctttatggatgtcagttcctgatgaacatcttacacctcaaaccgtgacccaacatctgcttctgcagagcccccctgtggcatcttgtgccctcctgccccactccctctactctatatcttcccatagttagaatgggctttttttttttttttttgagataaggtctccctttgtcacccaggctggaatgcaatggcacagtcacgactcactgcagcctcaacctcctgggctcaagcagtcctcccacctcagcctcccaagtagctgagactacaggtatgcaccaccacacctggctaatttttatattttttgtagagactggggtctccctatgttgcccgggctggtctcgaactcccaggctcaagcaatcctcccgccttggcctcccaaaatgcaggattacaggcgtgtaccagtgtgcccagcctcagatgggctctttgaaaaatgtttattagatcaggttactcccttgagaaaaaccctctcagaataaaacccgaagtccattacttgaaagcagagccagcttcatgggcctttgtaactgcccatgggcttgctggaacccaggcttggtttaatactctactctcaccatctcaaaattcttaatttttgaacaagaggccctgcattttcattttgcaccaggctccacaaattgtgtaactgggcctgcctcagcagccacatggaacatgatccctccttgcctatttgagctcattctctaccattctctcccttgctcacctggctcccactgctcttgctcttcctggaacttgccataatgttgctagagtcagagccttggctcttgctgctcctcattggctggacccctctttacttgacctgctccctcaccactcacttccttcagatctgtgttcagatttcgtcttctcagagaggcttttggcccctgtccatctctctgaatttacctctgacctctcccccaccaccactgcgctaagctgcctcagaactttgtagacattctgtctggtcttctgatgtttcccccttggaagaatcccaaggtgcctgaagaatgctttctttatccttgaagttgagtaggttgactagagtctggcttgctattgagcattctttatcaaattgtcctgggaacatggtgtattctttcagtctgcagatgtagtcgttgctgtttcaggtcagctctcttatggatctttgacagcatcttctgttccatttgttgagttctgtacttcagggacacaaattcctcatgttggattgtctttgtctctcttccaatgctattagctttgccgtaattggtttagcttttgtctttttcatctgcattcactttgtctaatttgattttcagctatgtatattctgtttctggctgtttttcaatgtatttattagtttcataatgatgtgttttggtctgcagtttgtttctctaggttggaaatttgtcttttcatcttattctgttttatcatcccatctttgaactcttttattgggaacatgttcttatgaagttgtggggaatttttttcccttccttgtgtattctcttcttggtgggagactttgcctttctcgtgccatctccctccctgggcctcttttttttcttctggccataatatgtttgcctagttaccatgtcacttcttttcgtcttggctcaggcttggatggctctgcatagtcgttctgtttgctttgagacagtggaggaattcttggctctctcttcccagtttcttggcatcttctcttgctgttttcccctctgagctatcgcgtgcaggcttgttatcttgtatccggagagaatttgcacgctggagggagctgcagccatgtagtcttcagccctatctggattcttctctttgttctaagaactgtgttggatgtcttactaaggctcactctagctgcacgagggatgtgtgtgccatttccatggggatagggggcacctcagtctctgggtggttccataatctgtgtatacctaagagcagttgcttcccacagagctgggctggctcactgggcactttgccatttctcctgcacctcccagctggagtttctgggtctaaaaggaaaaagtgaaggactcccacttggttgcttctctccagcttactgactgcaaattcccagggcgttgcccgctccctagggtggtttctgggggacggggcaggagcctggctttgctgctgctttgtcctctggagtcttttctcagactgctttgaattacacccctttcctttgtgtgctgaaatcttcccttcacactctccttccctgcctttcttttgtgtcttatcttactaggactggaagagggcagttgtgcaggaggtctgcatctaattccctaatccatgtgagagtgctcctgttgtgtgctttgtgacatgatggtgagaaatactccctagagcagtggctaccagaaggaagccatcccccccctgcacacacacacacacacacacacacacacacacacacacacacacactccttctggctgtcctcagatgcctattctaggtaaatgtcagattccaaagaaaatccagttgagatcttttttctttttttgagacgagagtcttgctgtgttgcccaggctggagtgcagtggcacaatctcggctcactgtaacctccgcctcctgggttcaagcgattctcctgcctcagcctcccaagtagctgggactacaggcgcgcaccaccacaccaggctaaaatttttttgtatttttagtagagacagggtttcactgtgttggccaggctggtctcgaactcctgacctcgtgttctgcccgcctcagcctcccagagtgctgggattacaggcttgagccatcgcgcccggcctccagttgggatcttgactggaatgactggtgttcaatcattatagtttccacctaatttgtatttgtacacaggacagttactaatttgttggtacttgtttgatccccagtccctagagttgtttatggggtggagcttcagtccctgctgcttcccctgtggcagcagctggagtcagggtggggacccagggtgctgctggcagattcttgagacaggtagaatctcctctatattggtgtctctctctgtcccagcagtgcccaggaaaacctggccagcctgtcactgacctctccacctagggcactggtggttcaggtccttctatttgccaccggcaaaccgtacttctgccagtctggctcttaggcccagtttctctgatcttgcagattttcttgggctctgctacggaatcctcatacctccggcaggtccctcctttgcccatgtgtttaactgtggtggaatcgtgtgagagctgcttctctcgcatggatcccagccacaccacattctacagcggttcctctgaaggcattgatagagatatttcctcctgttttgcatttcgttggtcatttcagtagaatcagggtgaaataaacatgggggctcagatgtcagcattacgaaccaagtacgtcaggcaggctgatgtggactgacctacactagtgagacgcaagatgacgaaaacaagggcactcactccaagttactgatgagatgtttggatcaaatgagccagtccttaagcagagttctctagtaaaagagatctcctttctgccctttcttgttccccaaaatgtgttgccttcatggtgaaaatttattttggcagattttctcttctttgataaaagcagccaacactttgttaaaagtctgtgaaacttatttacatgaagtatgtaaaggtaagaaaaaaacattatcaacaagaaatggagaaagccagcagctgaggacagaaaagtcatgcacagtgtcagtgtctatggaaacaggccacttggaccttgaggactaggtatttggaattggaggtgagcttggcctggtgagtctctaaccacttgtgtgtaggatcagtgtgagaaccctgctagaatatagtggcagagatgcaaggggaaatcattggagaagttaccagggaatgatgagctaatctgaaaaaaatacatgtttctaagttgggcgtggtagctcatctgtagtcccagctacttgagagcctgaggcaggaggatcgcttgagcccagcctgggcagcacagcgagaccctatctccctaaaaaaaactttttcgttgtttagttttgggatttttttttttcctggtcttttttccccctttttgtgaataacgggatctcactatgttgcccaggcagatctcgaactcctgggcccaagcaatcctcctgcctctgccttcctaagattacaggtatgagccactgtgttaagcaaaaaaacttttttaaatgaaaatcattttttaaaagacaggctttccaggggagggtattattccacttatatgaagtgtcaacagtaggcagatttgtggagacaaatagattagtggttaccaggggctgagaggagtgggagtggggagcaactgcttaatgggtaaagggttgtctttggaactagagagtagtgatggtcgcatgacattgtgaatgtactaaatgctattaatgataaattttatgttatgtgtattttaccacaattaaaaaaaaaagatcaaatgtcctcagaatagccaacaaccttccacttggctaaatgcctactcattaaacttcttgaactaaattcctttctgattgtcatggttattgtgtcctgggcttcagagtttcacattcaggttggcttggtccagtctgtcatgtatcactataggtccccacattggcctcttcctcagacggacagcccatctatctgccggggctctgtgccacagccagatagacttgctctgagacagctgtgtgggctctgagcactggccaggcatcacaaaacctatctttatgatttagaataattggtggtcagctgctgttttaatgttgttgttttttttaatttagatataattcacataccatgaaatttactcatttaaagtgtacaattcattcttcagtataattcataggctcacagaaaaaattgtttaaaaataaaatgtgcaattcagtgtcttttagtacattcacagagttgtgcaaccatcgcctctgtgtcattccagaacactttcagcacccaaaagaaaccccagacacaggagcagtcacctcttattacccgcagcccctggcaacaactcatccacttcctgtctctatggatttgcctattctggacatttcctataaatggaattatgcactatttggccttttgtgtctggcctctttcactgagcgtaatgtcctcaaggttcatctgcattgtagcatgtgtcagaatttctttcctttttgaggctgaatgatattatatcctatagataatgaggttttgattatccacccatcccttgggaatgcatatttgggttgcccccaccatttggctgttgtaaactgtgctgccatgaacactggtgtacggatatctgtttggttactggttttggttttttgtttgtttgttttggttttttgagacaaggtcttgctctgtcgcccaggctggattacagtggcacgatctctgctcactgcaacctccacctcccaggttcaagcaattctcctgcctcagtctcctgagtagctgggactacaggtagcactcaccaccatgcccggctaaatttttttgtatttttagtagagacaaggtttcgccatattggccaggctggtctcaaactcctgacctcaggtgatccacccacctcagcctcccaaagtgctgggattacagacgtgagccaccgcacccggcatagttgtggctttttgagagtgtatggctaggagtaaaattgccaggtcatatggtaactccatgtttaacatttgagaaactgccaaactgttctccacagcaggaattttttaacctgtatgtggtgggcttgtgtttcggttttcattttacacatctataaagatgagatttgctgtatggcactggttgcctgtatttggggagggttctgcttttggttggcaagaactgcattttatttaagcttagcaaaacataactggtttctcgcatcttctcaaaagtggaggattaagaaatggactgcgaattcagagcagggcagctgaacctcaggctccacccttgtagccttcaagctgaacctcattctctcttgctccctggagaccactgagacactctgcctgtgccagtttgatttctcacatttttaaagggccaaagcttgtgtctcaaagtgctatagcctttattgattcatgcagagaagcctccttgattccgtaattctgcagctaatactggaagtagaaagaattggaaacaccatctggatgacactttagggtggaagcagccagtacaagggggggctcattatttcctctggtcccagactgttcacctggagctgtagccaccaccctgcccttaggttaactgcctcgagtggtagtttagctctttgtgctgtgccgagggataactggaagtgaaaggtgctgagaaatgccatctcctgaaagtggcgagcatgagtgaatttacgaaaggttgggatattgctggggctctggaagtttctctggagctcactccaggggacagggagggggctggattccaattcaagtgaaaaatacctttcatctgccttgttcacctggcttttttgcctttttgtaaaatctgaaaacctcagggattgagtagtctttccttaactgcagttgcctgtctggccacacctgccagctgttgcttgtacccctgtaatttgcacggccttccgggcctttctcacaagatcactgcaggtcacattcatgaggaaaatgcaggcagttcctgccatcagacccctcaggatgtcatggtttggcctgaaaacaagattcctgcaactctaattttcctttgctagatcaaatgaaggatttgatctaatgtttgcattctagcagcaaaatcattgaatattttatttcttaagagccttacttcatattttgtaggtattttaagattttgtaaaggcctttctgcttcaacgtgtgatgtgtgcattcttagaaaaagatcttgtgttctgtaaatcacacaataaaaacatgagttcgtgcaggaaaaactggggcggggtggatcactccaaacttgtgtggtgtggtaactggagctcactgatgaaaccatgaacagttctggctgaaagaaccccacagtacactgaggtctgttggcatcgccgccagcaccgccccggtccctttgtgcgcgccaccacacctggctaattttttatttttagtagagagggggtttcaccatgttggtcaggatggcctcgaactgacctcgtgatccgcccacctcagcctcccaaagtgctgggattacaggtgtgagcctccgtgcccagccttcagctttttttcttaatgtctttgtgtaatatgaaggcattctctttaattgttaaaaagcttgcctaccactgcttcaaaatattactgtcagttggcatagcttctgattatattgatgtcatctcccttcttttaaacatgttaccatattggcactgtatttcccctagcccattgatcacttgagagttagtcatagtcctcgtgctgtttcactcctaaacgtttaagcatgcctttcctaagagcagacagtacagttaagacactcaggaagtttagcaatgagctaacacagaaccttacatttctccacataccccataaatgccttttttagagcctttgagcctggaatgcagagtccaggactgtgtgttgtattcgattgtgtcatcccttcagtctcctttatcagaaatgttcccccacccccttgttttctctcatcatcttgagtccagaccgtggttgcatggcacgccctctctggactcttcctgctgtctcctcacggtaagcttcagtctcctactcgtgatgctggttcatctcagcagcactgaggggcctgagctcagtttggtcgtgtgttaaggtggtgcctgccagatttctccacagaaaagggccccgtacttttatttgctcttcagcctgtgtattccttcctttcttgccagcttgtgggtggcttctctagcagcttctgtaagatactcagtttggcagttgtagttgtttcagcaggagaggtgtctgcatacctgaccaccacatggctagaagtcgatccatcctctggcgtaaccatcctccatgctactgtccctggggcactgaggccctcctcagtgacttcctccacctcatcttccgccatctccaagccaccagtgtccaacggactactgatatgtcccaaactcatcatttgtttattcaccaattcagagcccacctttttttcagcactgagctagcctctccttgctagaagcttacggtcgaaggtctccagccatcagaagaagcacgtggagcgctgcgtccgtgttgtggttattcatccagcatgtgttgagtaagggttgcacctgtgcctggcattatgcattgagcggggagatgggggttggcacgcacagtggggtgttctaagtacactgagggctcgggtgccctggctcatagagcagggagggaggcaggagcagggaaggtgtctcagaagtgccatctttttttttttttttttgggaagtggaatcttgttctatcgcctggtctggagtgcaatggcactatctcaactcactgcagcctccgcctcccaggttcaagcgattctcatgcctcagtccccgagtagctgggaccacaggcgcacaccaccacacccggcaaatattttgtatttttagtagaggcggagttttgccatgttggccaggctggtcttaaactcctggcctcaagtgatctgctcacctcggcctcctaaggtgttgggattacaggcatgagccactgcgcccggtctagaagtgccatcctaactgaacctgaaagatgaaagttctccagatgaacctgaaagttctccaaatgaaaaggtgggagggggtgacagggttaggcccagagcctctggtgacacagggtgggcatcattggtcactttttcctcgagggaggggcgtcacacgggtgatagggtgggagctataaccatgttgatagtgccgcctctgcccatctggcctggcatgccctgagccctctgtcccacctgtggaactcataagccctgacagcccactcactcctgattcattatccacacccctgtgcttccgctgtgcctggagcaagctttcttcagggggaagggaggctggaactatgttgtagttacctatttgtcctcccttccaaactgtgagttcttggaggtggaaggatgctgcaggatctggctcaggacgaaggcagttggtgaacagacacgtgtgtttttgactcacggtgatctcagacaagttcctctgtctagtcgaacttctttttttccatctgtaacactcaggagttgaataggtggtttttctgaggatacttcaactgtaaaatgtatgaacttgtgaactagctatttagttctcctcataatcaagattgtgtgtgtgtggggggttctgattagagggaggatgaagagaggtgtatggggttttttttgttttgttttctgtttgtttgtttgtttttgagatggagtctcactctgtcacccaggctggagtgcagtggcacgatttcggttcactgcaacctctgcctcctgggttcaagtgattctcctgcctcagcctcctgagtaactgggattacaggcatgcaccaccatgcccagctaatttttgtatttttaatagagatggggttttcgccatgttggccaggctggtctcgaactcctgacctcaggtgatccacctgcctcggcctcccaaagtgctgggattataggcatgagccaccacacctggcaggtttctttgaaaaagtttgtgtttcggcaaacaccataaaccccctgggggacagccttggggagtcacctggcaccctagcccagcctccctcccttgggtcctgcagtgaaggcttagtgagggtgtgcaaatgcccaggtcaccctgggactgggcaggccctctgggctaagggtaaactcatttggaatacctgttttctatcattgttttttatttgttaaatttaaagggtacaagtgcagttttgttgcgtggatatattgtatagtagtgaagtctgagctttcagtgtaaccatcacctgaatagtggacattgtacccgttaagtaatgtctcatccctcaccccctcccacccttcccagtctctccagtgtctgccattcctcactctgtccatgtgcacatgctattcagctcctgcttctaagtgagaacgtacggtatttgactttctgtgtctgagctgtgtcactgaagacaatggactccagctccatccacgttttttatcatttttacctgcactccacacccagcacaatccaggcttctttgtgggttttttgaaatttgtctttaattataaaagtagcagccagcaaattaacaaacacccatgtgcctttcattgcacagaattgaaaatcatcatactatatttgcttcaagtaatttccattagaaagaactagaatattacagtagagttaaagaccctttatttcccatcttcagtgctcttaaaagttcatttagggccaggcatggtggctcacacctataatcccagcactttgagaggcccaggtgggtggatcacctgaggtcaggagttcaagaccagcctggccaacatggcgaaaccccatctctactaaaaatacaaaaattagctgggcgtggtggtgcgcatctgtaatctcagctactcgggaggctgaggcaggagaatcgcttgaactcaggagggaggcagagcctgtatgcagtaagccgagattgcgccaccacaccccagcatgggtgacagagcaagactccgtctcaaaaaaaaaaaaaaaaaagttcattcattgtacacttagaaatagttaaaaaggtaaactttgttttgtgtgtgtgtatatatatatatatatatatatatatatatatatatatgtatttttttttgagacatatatgtgtctggtttgttcgcccaggcaggagtgcagtggcatgatcaacggctcactgcagcctcaacttcctaggctcaagtgatcctcctgcctcagcctcccgagtagctaggattacaggcacacaccaccatgcccagctaattttttttttttttttttttttttgtagagacagggttttgctatgttgcccaggctggtctcaaactcctgagctcaagcgatccacctgcctcacctcccaaagtgctgggattacaagtgtaagccaccacacctgacctgttttgtatattttaccacaataaaaagcctttaaaaccccaagcagacagttcattttcattcaggcccaactcagaatctgatcacagcggggtttcccccctttctagcgagtagctgaagaactgttttctctccttgatggtataactgtctctgtgggtgttgctcccctgccgctccagtggttttgtttttgtttttgtttttttgagacggagtcttgcgatctcagctcactgcgacctctgcctcctgggttcaggcgattcttctccctcagccttccatgtagctgggacttacaggcacctgccaccacgcccggctcatttttgtatttttagtagagacggagtttcaccatgttggccaggttgggctcgaactccagacctcaggtgatccacctgcctcagcctcccacagtgctgggattacaggtgagagccactgcacccagccggcccctcagtcttttccttctcaatcagtggcaccaccatcttcccaggctttggacatggtccctgactcacccttgcccctcacccccacactaatccacctgcgagctctgttgcttcaccacctagaccagccccaaatcctcaactgcccccaccctgggccacacctggaccactgctagaggcctctcatgggccctccctgtttttctcttgcactccccgggctttctggcacaagatgccccagaagcagaatcacatatctctcctgggagccaatctagtgtgtttactgcccctggagtgttattgttggccttagaatatgtcccactacaggtttgcagagcactgtagtcaaaagtcatttgaaataaatcttttctctgtggtatattgtcaatttgatatagaattaaatttgtttcttttcttttttcttttctttttttttttttttaagagacagggtcttggccaggcgtggtgtctcatgcctgtaatcccggcactttgggaagccaaggtgggtggatcgcctgaggtcaggaattcaagaccaacctggccagcatggtgaaaccccgtctctgctaaaaatacaaaaattagccgggcgtgatggcaggtacctgtaatcccagctactcgggaagctgaggcaggagaaggcttgaactcaggagtcggaggttgcagtgagccaagatcacgccatggcactctagcaagactctgtctcaaaaaaaaaaaaagagagagagagagacagggtcttgctctgtcactcaggctggagtgcagtgatgtagtcatggctcactgcagcctcatactcctgacctcaggtgatcgacccgcctcggcctcccaaagtgctgggatcgtaggctgaagccaccatgcctggcccgaactcatttgtttttatttgcattaagtgtaataaggttttgttacttttagtttgaattttattttgggtaatataaacatttacatgattcagaagtcagaattacactgaggcatgttcagctaggcctcactcctgtgcctgtacccttacctttttccccctaccccatgcagggaatcaatttcattagttcctggtgtgtccttccttaatacccccccttctttctttggtagaatgcagtagatatgtttgcgctttgctccctttgcttcacagtggatcctggaaatgactccatcgcagttcttagagctcttgtttagtccctttggatctgcacagtactccagtgtgtgggcgcaccataagtttattcagcaagtgccctggtgatagggatcgggggtattggaagcctttggctggtaaaaataatgttgtagcaaataacatcatgcatatgttctttgagatttctggaggtgtctctttagcatagatttctagaaggcattccttacgtcacgtttaggtttatagtttgacctcatggtgattaaggtatttgggaaatgcaaatgagagtttcgaagaagccagatctttcccattagttcactgtttttctctgacattaggaccgtccgggttctagggagcagccctggcgttaggcagtgccatgatggattgtgtagaagtagcgattcccatctgtctgctttcttggcccactctgctggtggctccccttccctccctcctttatggggagctggggagctgcctaggggtccattctcaaaggctgatctctggtgggcaacaggccacacctagctttccagggttcttcgtcatttcccattgagagctgtaagactcagagacttgaaaaggaagctctggctgggcacggtggctcacgcctgtaatcccagcactttgggaggctgaggcgggttgatcacctgaggtcaggagttcgagaccagcctgcccaacatggtgaaaccccgtctccactaaacatacaaaaattagcctggcgtggtagcacacgcctgtgatcccagctactccggaggctgaggcaggagaataacttgaacccggcaggcggaggttgcgatgagccgatattatgccatcggcaacagagcgagactccatctcaaaaaaaaaacaaaaaacaaaacaaggcgagctctgtgctgggacagattagggacccctctttacagcaagaaagactgctctgtgggttgtaggatgcctttgtgtatgcagtggctctaggtgactctggcagccacactctgggccctaaacttctggaggaagatacaggatagggaggaactcaggggtgagtcatggtggggacaagacattccctcactctaagaccttgtcactagattggaacatctcttgcctccctacacctgacctgatggttctggagagatacgtccttgcagcttctgagtcccagcactaagcagcctttggtaacttccctacatcatttgagttctggtttcctaaggatgcttgccagtgagtgccatggtgccctcattgcacagtctgtgcagtgtagacaagaggggaagtctcttggggtagaccagccgcaaggcggtgactagcactgatgtgaaccacatgggacaggggagttgtggggctgagaacacggagggtgggagtagtcatgctcttttccagaatgaactgctaacgaagggactcgcaggtggctgctgcttctttccaagctgcccctgttgttgcagaggctctggagtcctaggaggtttcacggtggcatactcgacagagtactagagcatcatggccagatagtgatgctggggtgtggggcctcacggtggccatttctgacgagaccccaccgggccaaagtgatgtgtagagaaggagctgcttcggtcaccagaaaagaacggggaagcctcccacactagaataggtagggtgctcttctccaccggcaggaaggggatgtatggctctgcctggaccacacctttttccttgctcttccctccgcatctgctgtggccgaggccattcctcatcagggaacatgtgttagaggctcacgccacctgggaccacttgtcttatcacccccaggaccctaggcggtagtttcctgtggcctgagttagctgatatttatatagtgccattgtgccttttctcctgtgatgctcacagtaaggatgcctagatggggttacctgttgtcaagataaggaaactgaagcacagaatgctgaggtcatttgctgggttcatgtttggaaagcggcaaaggatttcagtgcaggttggctggctccaaacctgtgtgtgctttccatgacactgtactgtgtgcctcattgagcctcattctagaaaaccaaaaacacacccaaggcccggccttcacaaaggagacccctcccccatttggctccctttccagcagtcgacggcctcttgtcagccatcgagcccagagtcccttgaagtgcgactcatgctggggtggtatgctcaggagccgcagtgtttccgctcagaggaaagggctctgattctcctgcagtgctaggagacttgtgggtggccacagtgcaggtcaggcacaccggccagcaccacccacagcccaaattcctaaagaaatatttgggtcccagcttggcccgagtctctgttgtcctggggaaggacatcaagatctgagtgtatgatggcctggggccttgcatgtggtgggggtccaagcctgcctctgctcacttgttctgcagactggcatgttctctgtgatacttacatacttgtttaacacttcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaagtaagtaagagcaactcctatctctacagggcagggagggcagggacaaggatccctcatggagcaggaaaatgtatgtgcccagggtggggtcggggggaacataaacaatgaacactgagaccaggtgtgcttgaaatgaccgtgtacagaggtcgctgccctgagtgggaagttctcaaggtagcaggccctctatcctctccacacctcaagtctttatctggggatggaatagctgcggaagcagaggaacttgcagagctaggggttcagaggggtgaagaagcatgtttcagttctgccttttaaatgatcccaaaaaggttagcagttttcaaatgacatttgcagacagcctcatttaattccatgagaagggtgagcaaaggattatcttgttgaaactgattcctggagagactgagcaccgtacctgagttcaaacttgggaatgttctagatggtgactcaggcccaggcaccaaccagcagaatgggcctcagcctgacaacccttctgtaccaggcctgactctttggttgctgaactttggagaggcctgggggggtcagcggcaggcagacgagtgagtggctttggtgacaggtcctcaggggcagccaggcagtgtgactctcgttcaatagtaacgtttgtcagagcgttgtcaccaccatccgctctgccctatctctgacattgctatggagagcctctaattgttccttgtgtctttctgtttgtccccacagtccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagcccgggaggccgatcgccgctcgcggaacccgccgggacccgggccctccccggcgcggggcgcccccgtgtgacccagcgcgcggccgcggcgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagcca

SEQ ID NO: 16081 - DNA, 33885 bp, Human
tgcaggtaaagagctttgaaggtgccaagggccatgagtagcttgggaggtcatctaggttctcccagcactgtggagtcaaggagtcctgaaggccggtcccaggcctgggcagggctgggtggggcagactgagacagggcaggggacaggaacgggatgacttattgaggtctctgacaggcctggcagaccagcagggcactacaactcttttcccagtagtaattatacttggcctgaaaaagctttagaattattcccacgttgagtgggcacacagtgtcctgagacatccttggccctctgagatccaggaaactgctctagatgccaaagttatagagacagtaggaaagtgcatgggtggagaggccctcagccccagcaggaggcaataggctgcctctctgagggctggatgcagtgggaggggaggggatctgaagggagaggaggcaaggaggaaaggaagcaaactttacccaactcttcagcggcccagctgggtgtctgcgatgtccacatatggctgagagctccaagtctgggacacagagatgccagcatgcaggacacgagatactgccttgttttctcctcctttcccctgcctttccccctgccccttccccattccccatccaaactctcctgctggccaggggtgtggaaacagttggatgtctttggccactctagctggagttctgccctatgtgatcttggctgagtcacttaatgacaataacccagtttgtgtggagtcacaaatggtgttcacatcataacgtcaccagactctccagccacacccattgtacacgcattatctcattcaatcctcatgacaactctggaagtgaaatcatgttagtgcacccattttgcagatgaggacactgaggcttagggagatggtgtgtgaccttcccaatgtcatatgtctaataaatggcaggaatggaattcaaaccatggtttactaaactccaaagctggagcccttctacagtctcaggatctagaacagggattattactatctctgctgttgacatgaggaaactgtggttcagggaggtcaagtgacctgccaaagcttgtacacatggaaagtagtagaaccaggatgcaaacacatttctttaccaccaacaccaatatctattttgccaacaaaacaatgagggggcctgagtaaataatctcaacggttaactccaccctccaattgagatactttttttttttttttttttttgagacagggtctggctctctgtcacccaggctggaatgcagtggtgcaatctgagctcactgcagcctctgcctcctgggttcaagccatcctcccacctcagcttcccaagtagctaggactacaggcacatgccaccatgcccagctaatttttgtattttttgtagaaacagggttttgccatattgccaaggctgttctcaaactcctgggctcaagcagtcctcctgcctcagcctcctaaagtgagccaccacacccagcagctgagacactttttaattctgggctagggcaaagagaagttggaaggaaaatgggtgaaaataaagaagttctcagttatactgcagcttgttcatgcctcctgcctcgggatgccgcagtggctgccccagccctgccctttcagcctcagcccttccctcagtgaaggagagaaaaagtgatttaacaaagtgaggactgtcagcccttggagcttggacctttgagatctcacactgccccacccagtagcttccccttccagtagcgtggcaccaccttctgacccacccctcagtgtgtccaccagtgagagtggttcctaagggagagtgtgaagcacacgtaggcagtgtcttacaccacacctgctgagtccaaaccatgggaggctcctctcctagaccctgcatcctgaaagctgcgtacctgagagcctgcggtctggctgcagggacacacccaaggggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaaggtaaaggtgggcaccccagggtcccccagcccagcagcctgggtggtgggtcagaggaagatgtacaggaagaggcgcagaggcacaggcagtggcaagagcgcggctctgtcccttcttcccccagtctccgctggaatgttcctaccctgccgactgccccagaccgcgctcaaatgtggcttaaatccagggtctttcaatgcttagaggactgggatgaggaaggaagttggatgggaggcaggaaggggaggccataaatcaaaaacatcaacagtcctggggtgcaggcagggagagcgttcgtgctttcccagcctcggatatgtctggcaccttactgaggcttccacaacactaagtccacacctcctgcccactgacctaagtgttaatgctcgtctttagatgaaactacggaggtctcgagaggtgacatgacttgcccaaggtcacacggggcgctggtggtgaaaccctgggctggaggttccccaaagccctgctctcttccttccacccactgtgctcagtgctggccagggtggtgacgtgtttgtcgggggtggtcggtggagaatcttggaggagaaaagccagctgggctttcggagtccagcagtgagcagcgccctgcggggcgggggcgggtaatggaacctgagcccatctgagtctgctctaatctgttcctaaactcttttctttgatttattgcttttgtagaaaagttcatgtgagcaaaaattcaagcttgtttttgctaagcttagaggcattctccttcagggcagtaggggacatggtgtggaggtaccccttggtattattccctgtctgttgaggttctgtcgggtgtgacttgcctgggtcttaaacatctttgagtgggagaagcaggtttgattgagtgctaacagcctgtgaaaggaaggtgattaatgctatccatttaacccctgcaaccctgaaaggcagagaaggaaacaggtttggaaagtttcagagctcgaaatcacagagctgggattggaacccagacttcccctgactccaaaagctgttgctctgtggggagtgaaggatctctgagtaccgtgttgaaattcagacctgttttggtggctgaggtgaatattaaacattaaccaccaccacaaacaacaaacattcaccaccaccgcaaacaccattgcaactcacaacattgcagaatcttgaatgtggaaatcagcccttgattctttcgaaagcctccacatcctttccagatggcacagaaagggccctcctacaatcccccggcacccacactgacccctcctgccgtgcttatcacatggtgtcatcactgtccacttatgtatctgcctctcccttgggactttgtgctgcagagggcaggagctgtgtcttgaatctttgtgccattgactttctcgtgctgtgacgtagcacctgcctggctcagaacaggcactcaataactgttgagtgactgattggatgaatgaatgagatgagtacgtttggagaagcagaaggaagagggatggtggggcaggtggtggtgatgggggctcagcatgttcggccacagcatttcctggcctgtggggccagcatggctgccttccatccatgctttccagcactggaactggtgttctgcttggaacagcaggaggtcagacagcctcatcgtgcctccagagccaggggacccccatgccagaatgctcgggtcctttcttgttttaaaacccacaatagtcgggcatggtggctcacgcctgtaaccccagcactttgggaggccgaggcaggcggatcacgatgtcaggagatcgagaccatcctggctaacacggtgaaactccatctctactaaaaatacaaaaaaaaatagccgggcgtggtggtgggtgcctgtagtcccagctactcgggaggctgaggcaggagaatggtgtgaacctgggaggcggagcttgcagagagccgagatcgtgccactgcactccagcctgggcgacagagcgagactctgtctcaaaaacaaacaaacaaaaaaaaacaaacccacaataaaggaggcacactttcactcataagtgacacctgggagctccttccagtgaagtccacacctctgtcaccctcatactgatcattcaacagatatttgctgaacatcaactctgttccaggtaaggtgccaggtgctggggatatcacagtgaacagggatgacacaatccctgcccccatggcagtcccctcatattgcataggtgatgactgaaggctcgagcctcatccagtggaaggaaggaatggaggagataaacaggactgtggcccatttgcattgcagggaaagacctggtgtcaccagagaaagggttgtgtgatggggatttagagagtgaaatggaggcttcagagtcagaggttcctgggttggaaggctggtgtttatcaactgtgtgactctgggtgagacccttcacctttctgagtgtcagctcatacattttatttatttatgggtttttttttgttttttttttttgagatggagtctcactctgtcacccaggctggagtgcagtggcgcgatctcggctcactgcaatctccgacgcccaggttcaagcgattctcctgcctcagcctcagagtagctgggattacaggcacccgctacacacctggctaatttttgtacttttagtagagacagggtttcatcatgttggctaatctggtctcgaactctgaggtgatccacccgcctcagcctcccaaagtgctgggattacaggcatgagccaccgcacccagccagctcacacattttaagccagggatcataaaacccacctttcaggatgactgtgaacagaaccagattcagctggtatgctggtatgcctggcacgacacggcatggcaggcagcattcactctgatcggttggtgcctgcgctgagtatgtagaatttcacccctggttgtgaggctttaaatgagtaaatgcttataaagcattcagcgcattttctgcctcgtaataagaaggtcacaaatgatagctgcttctgctaccactattaatgctatcattattcttattatctggaggcagattgtggaggacttttggaggccaaacagagacactaagatttgaagaggtaggaagtagggagccaaggaatgttattaagaagaagagtaacataaaagtggtgtgtgatgacatttagtgtgacaggtgctcagcaagggcggggacagaggaacagtgtcagggtacagtatctgctccactcactgacctgtctgcagtgtcagcacacttcctggcctatcactgggcctctgtaaggtttgttgaacacatgaatgaaaggcttctactaggactgggacaggtagaatgaagagaaaggaatgatccgagagatattgtgtgggacacatggaccgggcctggcatgggcagtgttacaaataaaggctgggtgcggtggctcatgccagtaatcccagtgctttgggaggatgaggctggaggatcccttgagtccaggagttcgagaccagcctggacaacatggcaagacgtcgtgtctacaaaaagtacaaaaatgagctggatgtggtggcgtgcatctgtggtcccagacacttgggaagctgagatggagggatcacttgagccccaggagttcgaggctgcagtgagctgtaatcacaccactgtacatcagctgggcgacagaatgagaccctgtctcaaaaaataaaaaacaaaataagaaataaagtaaaggcacatggctttaggatcgccagccaggtggcccaggtgaatgatgatgaggcactgactgaggtgaggcattgaaggcatggctggactgtgtgctggggacgtgctgggcagggaccagcagcagtattcgaagctacaatggagtgagctcactaaggacttcatttagatgacctcctgtaatatcacagccacctcatgatgggggacaatgagtttcacatgcactaatcagagtacttcctatggtcaacgtcagaaagcaaccagaaccagagcgggcaagggtagtgcttgtctcagggtagctggatccaggaacacaaacatcaccacatccttctttatccttctgggtgcaggtctctttctcttgtcctgcaggtgggctttttctgggcatcagggaacatgagtgcaagcagtctctggtttccattcttttgtttttgtttttgttttaaaggcagggtctctctgctgcccatgctggaagtacagtggcgcgagcctagttcactgcagtctcaaacccctgagttcaagctatcctcctgtcttagcctcccaagtagctgggactacaggtatgtaccaccatgcccagctaatcttttttatttttatagcgatgaggtcttgctacgttgcccaggttggtctcgaactcctgacctcaaatgatcctcccaccttggcctcacacagtactgggattacaggcatgagccactgcacctggcctgtttatcattcacacattactgaagtaggaagtgaggccaggtgcagaatagggggtggatgcagtaagttggggcttggagcagggggcacctggacacccagaggaagcctggtgtggtttcatggggtgaagcagagctgatcaggaggcagaaacggcacagctgagtttagacactgtgagtttacagcttatggcagaacaggtctgcccaggtctgtgactttctccagctaaacacaagaccggcacaggtgaaggcttccccctccaaggcagctggtgtcccatccaattcaaaagcaggcctggctgcaaagacggccttgctatcgagacttcataatgatcatcattttctctctgttactcccaaccctggccagggccttgtgcccctcacagatgggccacccaggatggtgattaacaactacagcaattaggttttcatgatgcacctcgggctggtaacattcgtgactgcttgtggggagagccgagggagaggtacagaaagaggagctcactggtgaggaaagagctgctaagggaaaaaaaaaagtgaggacacaaagaggagagtggagatggcacagaaggaggattgagaaagcaaagaaaatgggccaggcgcggtggctcatgactgtaatcccggtgcttttggaggccgagctgggcggatcacctgagatcaggagttcgagaccagcctggccaacatggtaaaaccccatctctactaaaaatacaaaaaattagccaggtatggtggtaggtgcctgtaatcccagctattcaggaggctgaagcaggagaatcgcttgaacctgggaggtggaggttgcagtgagccgagatcacaccactgcactccagcctgggcgacagagcgagacgccatctcaaaaaaaaaaaaaagaaagaaagataaaagaaaagaaagaaagcaaagaaaatggtccacggaaacggagtcagctccgggccttgcacatggctgaggctcagccggtgttcgtgcagcgccgggtgggtgatgggcagggaagagaaggaccacctgtaaccctaggggcactgcacgaggtgtccctgggctcgtggggagtatgcatctggcgatgagaccacgacagtgccagaaagggtcccaggatggtgcccagacacaagacttcttggctgtagtttctgccaactctgctggcacaacccaagggatgggagggtttatcttcttcagctcatgaccttaggacagtggtctctctccctctttcctcctcctttcctctccgtctgccatttagggaaaaagccactttactcaaccagctggggtgaattctgagaggaacacaccacattttagaagacacttgaggatgtcttggttaagtaaccactgaatccagcctaccttggcttaattcttaaatctgagtcttccattttccctcaaaccaccccctgctgttctgattctgtccctggtctccctttctctgcctggatgcattttcctagaagcatttcttggtgcctgacaccagcccctctcttcagcagctgatggaccccaggccccatccccccaacaccacagcatctctggtctaggtaagagcaagcttctctaacctgggtcttcagcttacagcccagctcccatcacgccccgtttcccgctgtttccccctgccaaggaacttcagttagtcctctccactgtcactcaaaagtggctcattttgtgaccagcctaggcaacagggtgaaaccccatctctacaaaaaatacagaaattagccaggcgtggtggcacatgcctagagtcccagctactcgggaggctgaggcagaaggatggcctgagccccggtggtggagattgcaatgagccgtgagcacgccactgcactccagcccagcccgggcaacagagcaagactctctcaaaaaaaaaaaaaaaaaaaaggccaggcacggtggctcatacctgtaatctcactcagcactttgggaggctgaggtgggtggatcacctgaggtcaggagttcaagaccagcctggccaatatggtgaaacctcgtctctattaaaaatacaaaaattagccaggcgtggtggcaggcgcctgtaatcccagctgctcaggaggctgaggcaggagaatcgcttgaacctgggaggcggaggttgcagtgagctgagatcgcaccattgcactccagcctgggtaacaagagtgaaactccatctcgaaaaaaaaaattgtctcattacataggcaagctttactacagtccctcgactaaatagctgagttcgaatataattcatacctgaaatggtgcatttgcagtgggaggaggttaggaacatggagagagtgtcgtatttcttcaagtatatggacagaacattcctcacgtgattctcaaacgtggtcccagaactgcagcctcagcagctcctgggaacttgtgaaaatttgaaatttttgagctccaacccagcccagacctattgaatcagaaactccaggaaagaggcttacaagtgtgttttaagaagccctctactcaggaggcaaaggcaggaggattgcttgagtccaggagttcaaattccagctgggcaactaataacaagaccctgtctctaaaaaatataaaaataaataaatttaaaaagagaagccctccaaaacattctgatgcccacttgcttgagtgtgagaatactgctttaatcttgctaggatccctcagaaaagagagtgggtgcagtgctttctggcattattcttttctctgggtggctgggcccaaatagcctcattgtgagcttctttccctgttgatgtcttttttttttttttttttttttgagacaggatctcactctgttgcccagtctggagttcactggcacaatctcagctcactgcagcctcgaccttcctggctcaggcgatcctcccaccttagcctcccaagtagctgagatcacaggcatgcaccaccatgcctagctaatttttaaaattttttgtagagactgggttttgacatgttgcccaggctagtctcgaactcctggactcaaacaatgcacccacctcagcctctaaaagtactgggattacaggcgtgagccaccacactcagtcttgctgatgtcttaataacatctgaccgcagccctgccttaagcaccaaaccacctcaaaacatggccttccttcctgcaaggccatagagaataagaagagtctggccgggcgccgtggctcacatctgtaatcccagcactttgggaggccaaggcaggtggatcatgaggtcagaagatcaagaccatcctggctaacatggtgaaaccccatctctaataaaaatacaaaaaaaattagccgggtgtggtatgcaatcacagctacttgggaggctgaggcaggagaatggcgtgaacctgggaggcggagcttgcagtgagccaggatcgtgacactgcactccaggctgggcgacagagcgagactccgtctcaaaaagaaaaaagaagagtccatcgtatctcacaggccaggatgcatgttttggcctcctgccaccagccttcacttttaccttctgtaaaatggtgttctaacagtatttaccttacccaacagttaaaaggattaactgaccttatgcaggtaaagcactccacagagtgcctggcctatgagtgcccagtaaaagaaagcaattagtaatactggcactatgatcgtagtattatttggtcctatcttattattatggatttctaacttagcaccatcccaatctctctcatgtatgttttgaagtaagcaaaggcaatagcagaaacagaattggtttgcctggtcagaagacagcctgctttctgggctgagagaagcaaaacaaaattgcacagcatttcaggatgcagtacgtgggcaaaggcttccttcctttttttttatttgccttttttttttttttgagctagaaaattcaaggaaattgcttgaatttgttacaggctccaaatacagttattcctctgcgtcttaagcatctagcactgaagtggaaaattccactctttcaataatggttagccatcttagctcaggccatgctgtggtttgaaggtttgccccctccaaaatgcataagcgtactttggagggcttctcttttcaaatttattatttatatacacttttagagacagggtctcgctatgtttaattgccaatgcaacagtgttgggaggtgggacctaataagaggtgtttaggtcatgagggctctgcccggtgagtggatgaataccgctataaaaagggcttacagtatggattctctctctttcactctcctgccacatgaggaatagtgttcctcccctccagaggatgcaatgttcaaggcgccatcttggaagctgagactgggtcctcactagacaccaacttgccaacagcttgaccttggacttccaagccttcagaattatgacaaataaatttctgtcctttataaattacctagtctgggatattacgttacagcagcacaaaacggactaaaacaggctgctataacaaaataccatagactagtggtttaaacagcagacatttatttctcacagttctggaggctgggaagtccaagattcagttcttggcgagggccctctttctgacttggccattttctcactatgccctgacaggatggagagagagagtttaagagtctcttcttcttcttataatagcactaatcccatcatgggggctgccccctcacgacctaatctaaacctggttatctcacaaatgccccacctcctaatagtatagcgttgagggttaggacttcaacagaagaattttagggagacacaaacattcaatccataagagaaactgagagccccatgacttcactgttccaggcccaggacataccacaacacatgttagagacaaaatctctgccctcagaaagtttgtaatataataggaggaattagataataaagacatttatttcaggagactgttaagtgctatgaagaaaattaaagcaggagaaatggatacagagagttggaggcagtagtgggaggaagccattttagataggtgatcggagaaagcgtctctgagaaggtgacatttgagcagagccctgagtagggtgaatagtgcgcaaaagggaaagagagttccaggcaatgggaacagcttgtgcaaaggccctgtggcaggagcatactggtgccctgaggggagcagctggaaggacaacaggtctagagaacaaaaggagatgcgagccaagaggtagcaccagatcacatatgaccttggcaccagatcacatatgaccttgtagtcataagaaggatttcaggccaggcgtggtggctcacacctgtaatcccagcactttgggaggctgaggcgggtggatcacaaggtcaggagttcaagaccagcctgaccaatatggtgaaaccccatctctaccaaaaatacaaaaattagccgggcgtggtggcacgcacctgtagtcctacctacttgggaggctgaggcaggagaatcgcctgaacccaggaggcagaggttgcagtgagccgaaattacgccactgcactccagcctgggcgacagagctaagtccgtctccaatataaaataaaataaaataaaataaaataaaataaaataaaataaaataaaataaaataaaacaaaataaaataaaataaaaataaaggatttcaaagtgcctgaaggacagggacaggaccactgtcataccttgttgagaaggtgcagagggtcacatagccctactgccaccaaagccttgatttttatgcaattgataacagcagcagctaacagctgccgaccatttcctctgtgccaggctttgtgttaagtgctttacacgagtgatctcaatttattctcacaacaggactatgagggagattctatcattagcgatttacaaatgaagccagtgagcctcaaagaggttcagtccctttccccaattctcagagccagttgggcaaagagtcccagggcagaatgaaacctaatggaacctctttctacagggtgctgtttgagtagtggggcatgtgagtgtgccccctgccacaaccatctttctttctcattaactggcctattacatgttttacacaaagtaaaggaagatttctgtctctgaggcctttctgaacttccagagcagacacatgtgaccatcctgagagactgggtcttctgcaagtgtggaaatgtgctttaacggcatgtcagcaaaacccaagatctgcatgcatcacttttgatgggaaaagtgtcagactttagtcagggatcgggcagggaagctggaagggcggggctgggagagtcactaggctgggagtgaggctggcagggactgtaatctgggagagaggcagaaaccaagtgtagggatgtcagtgaaggtgggagtggtgagcagatatggcaggtgagagtggtgtttaaagaaagtcattttcaggggctgggcatcttagctcacacctgtaatcccaagattttgggaggccgagctgggcggatcacttgaggtcaggagttcaagaccagcctgaacaacatggtgaaaccccatcttcactaaaaattaaaaaattagccaggcatggtgatgcacacctgtaatcccagctattagggaggctgagatgagaatcacttgaacccaggaggtggagattgcagtgagctgagattgtgccactacactccaacctgcatgacagagtgagactctgtctcaaaaaaaaaaaaaaagaaaagagaagaaaaagaaagtcatttcaggtgaggatcaggaacctggctggggagacaaggtggggagcaagaggcattattcatttatacattcaactttcattgactcagcagagagactgagcaataaggggccagttatctcagctataataactaacatttaaataaacaaaagctctcagggttgcaacttcctgattgtaccctgccccatattccaactgtattaactgatctctgtatggtttcaaatgataaaaatacacatgaactattttagacaaaaggaggatgtatggattcctataactaaaccgtgggaagacctggagtgtagccagacctcaggggcaactggcactggccagactcctttctttccatctctcttctctcatccattcttctgagtgtccatttcagcctctctcattggtctcttccataatgaatggaaacatggcggcccacactcagtgtctcaagagagaaactgaagttcccacacagagatgaactctgattggccagtttgagtcaggtgttcatctttatgcccatagcaaggtcataggagacaagatggcagctcccatttgaactacatgctggggaataaagtaagagtcattcctcaggggaaaaaatgtaagaggtgttaagttgtcaaaacagtagatgctcactatagtctaccctttggtgctcagtatacaagcctgttttcttccccaaagtagaattccaaaccagcccccatctaacaccatacagccatcccatgcaccactgtgaccacattcaccctcaccctgacaagggacctgcagctgtggcacccagtagtgtctaatgacatccgtcaactctggacatgaatgcctgcgatcctgagaacgagttaaatgactaatcactcctaacatgccaatgtaaataatgaagggaccagaaaatatgtgaggaaaaatatacaagaagataatgaccaaataattcccaaatgtgatcaacacggaacaaaatactgcataatcacaatgaagacttggacttataaaaggaggtgtaggctgggcaccgtggctcacacctataatcccagcaccttgagaggccaaggtaggtggatcacttgagcccaagagtttgagactggcctgggcaaccccatctctacaaaaaaatacaaaaaattagccaggtgtggtgatgtatacctgtggtaccaactacttggtaggttaggatgagaagatcagtggagcccaagactttgaggttacagtgagctatgatcatgccactgcacaccagcctgggcaacagagtaagatcctgtcaaaaagaaaggagaggggagaggaggagaaaggaggggaggggaggggaggggaggggagggaaggctaagttgatgaaatcaataagtatacagtgactcaaacaagatgtggtggcttatttccctcatctaacagaccaggggcgggctggagtccacagcataggagatgtgtttctctgtcctgcaaagttgtcctggagaccagattccttctgtctagatgtcccaccatccctagagttgtgtcctcatctgcatgttcaaactgacacacatcatcacacccacatcatggttttttttttttcgttgtgttttgaaatggagtctcactctgtcgcccaggctggagcgcagtggcatgatctcggctcactgcaacctctgcctcccaggttcaagcaattcttctgcctcagactactgagtagctgggactacaggtggctgccaccatgccaggctaatttttgtatttttagtagacagggtttcaccatattggccaggctgatctcaaactcctgaccttgtgatccgcccgctttggcctcccaaagtgctgggattataggcttgagccaccatgcccagcctcatcatgtgtttttataggccaggcttgtggcttctttggcgatccaattctatcaaaagttggaaacatcctgatctatttgcttccaattatttccatacagaaatgccacacccagagatcccttctggacatggttctgaagcctgccaactctggcattttcctaactggctcccatgcctggcccattcctgctgccccatcttaatgctggctattgtggtgcctgaaacaacaggctgtgtgggcagatgacacatcacatctttgccacagggctgattcccattgccagggagagaaatttcagtggtgggtaccacggcctgccttcctggttattgcaggtggagctttaccaaataacagactaggaggagtcaccatctggccatcttgcctcatctgtgttttctcctttgcgttgctcaaccactaagccaatgtcacatactttagattttttttgttcaagttgcatctcaccttcagcacaaatgtctgtattagacataggttatgctactataacaaacagattccaagatgcagtgatataaacatggtggaattctctttttctctcacacaacaattcagagtaggccccaggcaaacgggcaactctgccccatgagttgaccaggtttccaaattccttctctctccttgctgctcctccattcccttggccacgcagtcaaaagtgtcccaccccatcacctccaccttccagtctgtggaaggagaaaagaatggaagtaacaggcaagcaacctccttaccaaaagtatgatccagaaatttcccacatcactttgggccacatcccattggccagaactgcatcatgtggccacactgtgctgcaagggagtctgggaattacagtccctagctgagcggccatgctggaatgggaggcacttgtattacttaaaggaagaaataggaaatgaatactggggaacaactcctatctccgcctcagggaaaaaggcaatttacaaacagtgatacagatggaataccacatcttgctggtcaggggaaaacccagctcccatagtgatttgttcgtagactcacttccctgaatatggggactttcttagccaatctggttatgccaacatcttgcctcctaggagcagccttggcttattgtcccccagcaacaaccctgagagagccaacaggaaggactcccttactgagagctgggccatcttaggagcccacatcccactggaggcccgaggattgttttaagtcttgtgaaatcacaggcaactcgcacaaagctcgaggtgttttttttgttttttgttaattgatttcgttgttagttggttttgacagtgtgtttgttttgcaacacaactgacacagaaccctggctgaactctgacagccagtacctaacccccaaaattttgtccaggctcaaacttggaatcaggatctgtcttagtccattcaggctgctataacagaataccatagactgggtagcttgtaaataacagaaatgtattgctcacagttctggagactggaaagtccagggttcaaggcactggcagattcagtgagggcctgcttagtcatagacggtgactccttgctatgtcctcatgcggcagatggggcaaggcagttctctggttttataagtgcatgactcccattcctaggcttggtccccttcattccattctcattatctaatcattcctccaaaggccccacttcctaataccatcactttgggggctaggatttcaacatatgaatttgatgggacacattcagaccatggggctcttagatctcttagatgcaggtgtgggggctctacttatttttgtaagcctcgggatctaccctggccttgacctctgcaggggtgatggagctgcctaatctgcctgttgtgctgccctgctcccaggctgtgcttcatcatggaggcattgggtaaattaagacagtgccaggttcttgggaagggccactaccatgggccaaagaatctaccagtgccccaggtcgaattgccctaattgccctgtccttctccccaccttgtttggagtaaccagttccttcctgctttggaatggggcaaacttcttactcaacacacgcaacaggaagtgtctctgccagacataccactggactctgctctcttctcagggtgcaacatagaaaatgcctgctacccgctgggcatctgtgctgaacggaccgctatccagaaggccgtctcagaagggtacaaggatttcagggcaattgctatcgccaggtgagtgggaaagccaggttgcaacaatattcattcatctctttagccaacatcttccttacacatattattcattcattcattcatctgacatatgtttattgtggacttcctatgtgccaggcactgtacagggccctgggatgagtgctgaggataaggagataaataagaaatggagtttgccctcagtgagcctgcaaagcaggtaaataagcaaggcaactctcatacaagggccagtatgcccctgttccagcaacacaacgtgatacagactcctgtcctacaagatataacagaaaggcagcattgaaacataaagcggggggaacctgagccaggcgcggtggctcacgcctgtaatcccagcactttgggaggccaagatgggcagatcacgaggtcaggagatcgaaaccatcctggctaacacagtgaaaccccgtctctactaaaaatacaaaaaaattagctgagcgtggtggcggatgcttgtagtcccagctacttgggaggctgaggcaggagaatggtgtgaacctgggaggcagagcttgcagtgagccgagatggcgccactgcactccagcctgggcgacagagcaagactccgtctcaaaaaaaaaaaaaatttttttttgctgatggtggcatgcccatagtcccagctatttgggaggctgaggcaggaggatcacttgagcctgggagttcgaggctggaatgagccatgattatgccattgcactccagcctgggggacagagtgagaccctgtctcaaaaacaacacaaaacaaaaaagcattgagaacagtttggaaaggtcttcaccggcaagtaattatcacagtgttgtaccattggattctcttggcttacttataggttctgtattgtttgaataacaaaaaaggaatactgaaagctgggtttagtgcaaggccagtggggactgcacagaagcaagcccacgtgccttttataagatcctacactttgcctcagtctggccccaaggagacccagcttaatttgtttctgagtaagtaaagcccgaggtgcactcaaggagaagggctccagtatccgatagccttccctgtcaccgaggtgtgtcctggcttccttaaggcttccggaggaataaatgacggttggcgggcgcctgtagtcccagctacttgggaggctgaggcaggaacatggcgtgaacccgggaggtggagctcgcagtgagctgagatcacgcctctgcattccagcctgagtgacagagcgagattccgtctccaaaacaaaaaagcgggagggacctaaaaatcacctgctatagactcccttgccaccacccccattttatagctgatgaaattgaggccccgataagttgaacaactttcctgggagttagtgccagagctgggacaaaacccaggttccagagtctcactgcagggctcattccactacatcatgctgtgccaggagatggaacacttttccctgttctccacaagctgatgctaggatcctgaatgagccactcagcactgctctctccttcatttggcaacactcacctctaggtccaagaaccaggatacaaaaacagtcaggtaaacagtagttatggttcaaactaatcagagtccagccaaggttctggctgaacaagagccccaatcaatgctcctatatgtcccaaacataaatatcctagttggtatggcttactttccacgggagcatgttgaattcttgttggctctggccctagactcagtggtttcaggatccaagcacgtaaattagcccttttactggactccattattgaatgacttaatggtgaattgctcctgtgtgcacctttgcattgtgtatgacagttttcttaacaagttaatgatgcaagaaaaatgacatgggaaatgttgatcccacccagaaggaggctgcatgcctgttggtctttagggacatctgggtgcataggtcacattctgtgaggtaattatctcttcactcatagtggagttaattcctgtggtagagctacagcacctttctggctaaaatacagaaagagagctacaccttttagcacctttctggctaaaatgcagaaatgcaggggtttagtgcaaggccagtggggactgcacagaagcaagcccacgtgccttttataagatcctacactttgcctcagtctggccccaaggagacccagcttaatttgtttctgagtaagtaaagcccgaggtgcactcaaggagaagggctccagtatccgatagccttccctgtcaccgaggtgtgtcctggcttccttaaggcttccggaggaataaaggacgctgtgctgagaacattttgtgcagataggccaagatcaggatgtgaattgcactttatgaaaaaaaagagaaaaggagggaaataactcaatttcaaagctgatccaagaaaataatgatattctagggaaaaagaggccaaagtcaaccaaaggataatgatgccttgctctatttagaattttccaaatgagaggctttttctcttggtcattatcgacttttaaacaaaactaagtatcactagcaatgattagcaaatgtccttatttacacaaaacctgccatttttccagcacccaactgctgtactctaggtattcagctcagtttccctgagcccaagatgcactcattatcgcactcatgatttgttaaattgagagcgtttgtggatttagaggatgaatgagaagtaccagctcccttgttaacatcagatgggtctgagcaacctcagagagaacccctctcaggtctttaaggatggagaccgcactcaggaaaggtccgtgtgtcttactgctcacagacagatgagactgccccactgggtcccagctgtagtgatcagagtcagtaggtttccagcccgtcaagtctgataagtacggcctcagtgtgtgaccaaggtgagcacaaaccacagaaaactgtaaatagccagcaaaaggcaggacagagtgaagggcagggtagagggagaaagggggaagctgtgaagaaacatcctgaggcagccagcaggtgctcagtcttgagtgctctctcttggcaggaacgttgagtaagttagaagcccaggcttcagggtcagtgaaaccagtttccaaatccagccgcattatggaccttgggcatgctgcttagaccctgagcctggcttctcatctgtgaagtggaggagactggtctgttacagggtcttaagaaacgatttctgtaaagttcctgacacagggtatgtaatacattcaaactattatatagttttgttttgttttgttttgttttgttttgtttgagaacaagtctctctgtgccgcccaggctggagtgtagtggcaagatttcggctcactgcaacctccgcctcccaggttcaagcgattctcatgcttcagcctcctgagtaattgagactacaggtgccggccagcacgcctggctaatttttgaatttttagtagagacagggtttcaccacgttgaccaagctggtctcgaacttctggcctcaagtgatctgcccacctcggcctcccaaagtgctgggattataggcatgagcaaccgcattcagcctcaaactattacattgttttaaagttatcattatttcttctgcaagctgcaaaactaccaaaggcagagtgtgtagatttggggttcaaatcctgattctgccacttcactaactctgtggccttgggcaagtcgtttcacctttcatgatctacagcatgcaggtgataagagcgcctgcataccccggccccttacagggttgttgggggattaaatgaactaatccacttaaggtccttagcacagaggctggcacacagaaccactatgtatgtgtaagccattactgttaatgcgctgtctctacatcctcagtgctaggctgcctggaaacactatcctgtgacttttggttgttgaagcctacaccaaatctaccttcccagtggaatgcatgcttgcccaccttgaaatccctgatgcagatcaccttgtccagggagctagccattgggtagtgggccacagatgccacaagattcagaaagaaggccgggcgcagtggctcatgcctataatcccagcactttggaaggccgaggcaggcggatcatgaggtcaggagatcgagaccatcctgcctaacacggtgaaaccccgtctctactaaaaatacaaaaaaaattaaccaggcgtggtggcgggcacctgtagtcccagctactcaggaggctgaggcaggagaatggcgcgaacctgggaggcagagcttgcagtgagccgagatcgcgccactgcactccagcctgggcgacagagcgagactccgtctcaaaaaaaaaaagattcagaaaggaagcggtgagctcagcaggggtcagatcacacagggccttacaggccatgaaaggaaggctgaatttcattcagagcaactctcccatggccctaaccatgcctttgttacggcatttgtgtgaaattttatctccccctccagagggtaagctccaggaattgtccgattggtctttgttgctcctttcccatgcctgcctgacatagagaaggattttggtcgacatgtgtggaatgaagtgaaaaataacccccaaaaagcttaagaggccctggctgcaacagctgtcacccagtaattccaagagttcactcggcatcctgggcaggagtccccaccctcttatgtgcccgtgggtttttcttctgaagctggaagcgtcctcagagaggtccccatcatcccatggaacagaacctttcattgactggacccccacatgtaaaaggtagtaatggtgaggattagagaaaatagcacctcagctgctttattctaatcataatatcatccctatctccacttgacgcatggttggttggttgggtggttgatcagttgcctagctcccctcactagtctataaactcctgagcatagtgaattttgtctgttttgttcactgctgcactcctagcaccaatgacagtgcccagcactgctcagtaaatatttgttggttgaaatgagacaatgcatataaaatgctttgcagaatgcctggcacattctaggcacacattatcttttttttttttattttattttatttttatttttatttatttatttttatttttttttgagatggagtcttgctctgtcacccagactggagtgcagtggcatgatctcggctcactgcaacctctacctcccaggttcaagcaattctctgcctcagcctcccaagtagcagggattacaggcatctgccaccacgcccggctaatttttgtattcttagtagagacagggtttcaccatgttggccaggctggtcttgaactcctgactttgtgatccacccacctcggcctcccaaagtgctgggattacaggcataggcacacattatcttaataacaattgttgttaagatataataagatgaattatgaaatagtacataaatcacatagcatataataaaactgtgtatgataaagtactaaaattatgacagagcttacatacgtaaggaaataaatgtccagcacttagaacaggcagtaacaatatgtatataacattctaaagtttacaaagtcttccatacaccttatctcattttatcttctagcattcttacaaagcagatgacgtatcatccacattttacagcaaataaatgagacttggatgagttaaaatgacttagtcaaagtcacacatagcaaaaggaagagccaactaaaaaccaaaatttaaatcctgtgttctgccaggcatggtggctcatgtctgtaatcccagtactttgggaggctgaggtgcaaagatctcttgagcccagaagttcaagaccagcctgggcaatatagtaagatcctatttctacaacaaatcagaaaatgagtcaagtgcggtggtgcgtgactgcagtcccagctactcaggaggctgaggtaggaggagcctttgaggccaggaggcagaggctgcagtgagccatgattgtgccactgcactgtagcctagacaacagaacaagaccctgtctcaaataaataaataaataaaaatcctatgttcttccagagatatcacaaagctgtgggtccagaagagtaagaaggatggtggctgctggcttcacctgtggtgcaggcttggaattttccatcatcaaaggcacttgtttgttttgttttgttttgttttgaggcggagtctcgctctgtcaccaggctggagtgcagtggcaccatctcggcttactgcaacccccgcctcccgggttcaagtgattctcctgcctcagcctcctgggtagctgggactataggtgtgcaccaccacacccagctaatttttgtatttttagtagcgatggggtcccaccatgttggccaggatggtctcggtctcttgacctcatgatccacccaccttggcctcccaaagtgctgggattataggcgtgagccactgtgcctggccaaagccgcctgttttagggaccaatccttgtcctgctcagagctggaggtctgcctgtaggagcctaaactctcacaggcaatccctggctggtgagcttcttcagtgcaaggagcccatttttctctctgagacacatgcactttattctttcatgcctcagggcctttgcacatactgtttttttgtttgtttgttttttgagacagggtctcactctgtcacccaggctggagtgcggtggcacaatcacagttcactgcaacctccgcctcccaggctcgagtgatcctcccacctcactctcctgagttgctgggactacaggcctgcaccaccacacctggctaattttttgtattttagtagagatgcagtttcgccatgttggccaggatggtctcgaactcctgacctcaggtgatccatccgcctcagcctcccaaagtgctgggattacaggcatgagccaccacgcccagcctgcacatactatttatttccttcgcctacgacacagagaaacccagggcttccgaatagcatctctgcctcttcatcacactgaacctatctcctcacccttaaagtggccattctgacatcttgatgtcaggcctctgagcccaagctaagcggtcttaacccctgtgacctgcacatatacatccagatggcctggagcaactgaagaaccacaagagatgacattccaccattgtgatttgttccttccccaccccaactaaccaatcgatcttgtgacattccacccccccaccaccgacaatgagtctcacgatctccccaccctgcaccgtgtgacccccgcccctgcccacaagaaaacaaccccctttaactgtaattttccattacctacccaaatcctataaaactgccccaccctgatctccctttgctgactctctttgcagactcagcctgcctgcacccaggtgactaaaaagctttattactcacacaaagcctgttggtggggcggggcggggtggctcatgcctggaggccgaggtgggcggatcatgaggtcaggagatcgagaccatcctggctaacatagtgaaaccccgtctctactaaaattacaaaaattagccgggcgtggtggtgcatgcctgtaatcccagctactcgggaggttgaggcaggagaatcgcttgaacccgggaggcggaggtttcagtgagccaagatcacgccactgcactccagcctgggtaacagagcgagactccatctcaaaaaaaaaaaaaaaaaaagcctgttggtggactctctttacacagacgtgcgtgacaccaggctgctctgagaattccatgaattaatgaatgttgagtgcctggtacagagcctggcatacagtagacattcactaaatggtgacttatgaactctacacttcctccaaggaccaggacacatgcctcctcctccataaaatcttccttctcagtccacaggcagggatgagctccctcatactgtgtgttccttctgcaattttttttttttttgagaaggattttcattcttgttgcccaggctggggtgctatggcacggtcttggctcactgcaacctttgcctcccggattcaagcgattcttctgcctcagcctcctgagtagctgggagctacaggcgcccaccaccaagcctgggtaatttttgtatttttagtaaagacggtgttttaccacgttggccaggctggtctcgaactcctgccctcaggtgatccacccacctcggcctcccaaagtgctgggattacaggcgtgagctaccaagcccagctgcattttgtttaacatgataactcagctggttttttacataacagagacaaattctctttgacctttgtattcccgggtgtgggtgatggtaagtgctcagtaaacgtttatggatggcactaatgaaagtcctgcccatggccctgccttgtggcagtgtggaaagccaccacgtggccttctcagccttcaggacacagtggatctgtgaatcaggaactgcctgatggggtatgacccaaatcaggaacagaccgagactcagggcctgaatcttagcaattgtcctcagtccttgggagagactaatttgagtttgattctttgcttccccagtgacatgcaagatgattttatctctccatgtggggcctgcaggcaagtcatgagagaggtaagcagcttctcttgctgtctggaatgcaaatatcttccctgtcgcaggctatgggagccacgccaagttgcaggcatggcaggcatggcaggcgtggagacacagctactgtcctgtttgcttggttggctgacttctaaggcctccctacgcttgcatgagtcactggaaattattccttcatttaacaaatacttaccgagtgagtgtctgctttgtgccaggccctgaggtagctctggggaggcacagggaaaagatgggccaggccctgccctcacagagctcataggctaatgcaggagacagatgataaacaaggagcaaaataaataaacaaacagtggcgtttctgagtcaagagggctatagaggaaaacaaaatgcagaaaaaaaaaaggagtccagtgacaaacgggcaaacaggggacactgcagattggggtcagcaaacaacagcccttgggccaaatccagcctgctgcttgtatttgtaaataaagttttatgggtatacagccatggccattcattcacctattgtccatagccactttgccctgacacagcagaggtgagccattacgacaaaggccacatggcctctaaacctaagatatttactgtctggtccttgacagaaaaaggtttgccaacccctgctttagatatccaggaaggccctctttttgagcatgacatttgagcagaaatataaataatgaggaaaaaaatgagacagacaaaggtcaaaaaaggagattcagaaccagcaagttcagacccttggtgaatttgagaagaggcaagaaggccacgagggctagagagctagggcctggtaggtggaaggaaagcaatgggattgaagtcagaggggtgggcagaggccagatcacatggggcctggccatggaacgaagggtacattttattccaagaataaaggaaactgaagtgtacacttttttttttttgagacggagtctcactctgtcacccaggctggagtgcagtggcagagtctcagctcactgcaacctccgcctcctgggttcaagcaattctcctgcctcagcctcccgagtagctgggactacaggcgccagctaccatgcccggctaatttttgtatttttagtagagactgggtttcaccatgttggccaggatggtcttgaactcctgaccttgttatctgcccacctcggcctcccaaagtgctgggattacaggcgtgagccaccgcgcccagcctggagtgtacacttaaacatggttaaaatggcaaatcttacattatatatattttatcacattatatacattgggaaaaaagggaataaaggtaagccattggatattttcaagaagaaacttgaaggactttttataaaagtcctcttgatggaaggctgcaatttcttcaactctaaaaacaaaacggtaagccaggtatggtggctcagcctgtaatcccagcaattagggaggcagaggcaggaggatcgcttgggtccaggagttcgagacctgcctgggcaacatagcgagaccctgttctccacaaaaaaaaaaaaaaaggaataaaacaaaacaaaaaaatgaaaacgaagggatagtttagatcatgggttcttaatccaggctcaggggaaggttttcatgtttatatgtacgtttggggaaaggggaatgtcagtaactattgtggattctcaaagagatctgtgtcctctagagtcccaaaagattagagaatcccacaggccctgagctccagcataatatcaagagcccctcgaaatacggcatcttgtgggcatgatggcttacacctgtaagccctgcactttgggagactgaggcaggaggatcaccttagcccaggaattcaaaaccagcctgggccacatagtaaaacccggtcccttcaaacaatttaaaaattagcaaggcatagtgtgcacgcctgtggtcctagctgctccagaggctgaggtaggaggatcactagagcctaggaggtcaaggctgcagtgagctgtgatcaagccactgcactcctgcctgggtgacagagcgagatccggtctcaaaaataaatacatacctacagcatcttgtttaatcccctccccaagactgagtgaaatgcatgtcgttattcccatttcccagtgaccactctgaggctcagaggagtaaaatgacttactgaagggccccctgccaggcggtgacatatgggtatccatggcccatcaggctgactctgaagcccgtgctcctcacggctgcctctctgtctttgtggttctgtaagttggacaaaattattttcagccatggaggaaacataatggtactttggcatgtggatgctgcttgtaccgtgggagtttctgcttttggagttgtgttttgggagaaagggggttgttttagctttgtttttgtgccgtggggtttcaaagcatctggggatgcagacacttccatcttcctcctgcttcctgccaggagtgcaaatcagacacatttcccaaatccaaaaacataccaccgggaaagcagtgaatttacacggtggaatttgtctcacttgagaggggcagaaatagctgccctgcacggtggaaatgtcgaaggtcatataaggaagccacaacagggcgccaagtccctggctcccaaggccccgacgtggtccaattgctcagtgctgttttctccaaacagattggatgttggcaaacgagagaaggcaaatgaaaaagctgaaggaggcaggggggaaactgaaaccaaatgcaaatgataagagatgaggcgttggggccagggacctgacacgtaaactcgccctcggctcaacttttgtctgtacctacccttaggcacagcctgtcaagcagaaaaatttccttccttaaaacattaattctaaaaaagccagaagattgagtgtgcccgggaataacttggtgattcagagagaagtgtggaagaacaggaggctgcagacctgagcagtcactggctaccaacataatcaataagaatggcatctattaattgaacacctactatgtgcatagagatgctttacatgaatcatctctgcatctcagaatacctggccagaaagagcttaggtctgttgaccccacctccagggctcttgtcatgacaccgctgctgattaacctcttgcctaccatcctgcattctcccatccctaaaaccattccatggaccaagacactgagtgagccccagaaagttatcattttcccaaggtcacacagcaaacaaacagtgctcctcatagtataggagaaagatcaagagacaaatttttctttgctgactttactctgctaagcctcagtttcctcatcagtaaaatgggcatcatgatagcacctacctcacagggtagattatgaaaccacgcatgtgcagtatctatgtggtgtggtttggctgtgtccccactcaaatctcatcttgaattgtagctcccataattcccacatgtcatgggagggacctggtgggaggcaattgaatcatgggggcgggtctttcccacgctgttctcgtgatagtgaataagtctcatgagatctgatggttttataaatgggggttccctcacacaagtcctctcttgcctgttgccaggtaagacatccctttgctcttccttcctcttccgccatggttgtgaggcttccccagccatgtggaactgtgagtccattaaacctccttttttattttattttatttttttttttttttgagaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaactcctgacctcaggagatccgcctgcctcggcctcccaaaagtgctgggagtacaggcgtgcgccacaacacccggcctaaacctcttttctttataaattacccggtctcaagtatgtctttattagcagcttgagaacagactaatacactgagtatatgtagcaggcttgcagcttctcctggtgtgaggtgtaaaggggatactgaagggaagcgggtgttagttgtcatttgtcatagcagaaggaggttccaggggttagctgttgctcttataaagccctgggtgagtcttgaatggtgcctgttcacgatgtaccatgcactgttcagtttcacagcattctttcgtttcctcctccctgcagcactatgatccaggtacaattatggtcattccccttttacagatgagaaaatcaaggtaaagagaggaacattagacagtggcagagtcagactcagacccagtccgtctcagccccctcagccacgctgtgtctctcacgccagctttgcctcttttccagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaagcgtgtgtcttgctctgtctctatccttgcttgcagctcttaggagggacagcatgatttgtctttataggaagagctggactctttctgttcggagaggaaatgggtaccttggaaccatggaccttatggtgtggagagctgaggttttaggcaacttgccccagcgttctctaaacgggcagctcccctgggctggacctaactgccaataaccatcctagagtgtgtttttgtctcatcatagacctgagcaccaggagactccagagtataaagggtcaagcacggtttgtctagacagtgtaacaaagggttttctcagtagctactgtatgtcaggtaatttgtgtgcatcattttaagtttaacatgctccacagttctgtgaggagggtgtggagatgcccccttttcacagatgagagcactgggctttggagaagttgaataccctgctctaggacaatggcaaacctcagaacagaatccaggccccttaacccccactgtggtccggaaacattgcatgctttttgccatgcactgcgctaaggtgtgtgacatatatgaacccgttcagtcctcatttgtcaaactcaaaggttaattattagtgttctcaatttagaaataagcaactcgaagctcagagtgattgagttgctcacccaaagtcacacagctgatgtggcagaactggaatcagaactagatctgtctgggccgggcaaggtggctcacgcctgtaatcccagcactttgggaggccgaggagggcagatcacctgaggtcaggagtttgagaccagcctggccaacatagtgaaaccctgtctcttctaaaaaatacaaaaatcagccgggcgtggtggcaggtgcctgtaatcccaaccactcaggaggctgaggcaggagagtcatttaaacccaggaggtggaggttgcagtgagccgagattgtgccactgccctccagcctgggtgacagagtgagactccgtctcaaaaacaataacaacaaggattccaaggatttttttccattcccccataactgatgtctcaatttactgattatcttttatatgtcaaatatgctaaatattgcagagaaaaacagcctctgcccttgaactcccagcctgacagattgagagaaagagaggtgtacacaggtctaatgcacaggagtgcacactgtgatccaggcagaaccaagtgtcaggtgggtgtgtcggggagcctgctgctgtctggagtgtgaggacagggagggactgtttctttcatgggtgcattggttatcacacatgcacaaaattaggaaggtcaggactgaataaggaaggagccagggtgggtgctctggagggggatgacagctccaggagccctcccaggaggagttggtcttggggctggctcattgggtggggtaagaatacagcttaggtttcctgttcccagggcaagcaagtacctaggggcacccaagtggacatcaccccttccctggaagccctttccaccctgatccagtgttgccacctgatgagaatggctttgccacaacacactcagacttatctgctggcatcttgggagcatcccagtcattccagcatggctatatgacacacaactccattctgcttttttttttttttttttttttttttttttgagatggagtctcactctgtcacccaggctgaagtgtagtggtgcaatctcggctcactgcaacctctgctgcccgggttcaagtgattctcctgcctgagcctcccaggtagctgggattacaggcacctgccaccgcacctggctaattttcgtagttttagtagagacggggttttaccatcttggccaggctggccttgaacacctgacctcatgatccacccgcctcggcctccctaagtgctaggattacaggtgcgagccaccacgcccggcctgactttctttagaaatggctttggtggct

SEQ ID NO: 16082 - DNA, 6804 bp, Human
acctatatagtaatgtttacagcagctttaatagcaattatggaaaactggaatcactccaaatgccctacaactgcttaatggataaaccattaaggtacatcataaaatggaattactcaacaataaaaaccacacactactgatatatacaacataattgaaccacaaatatatgatgctaaatgacagaaagactaaaaatggttgtacacagtatgatccatttccatgacatttaggaaaaggaaaaactttaagaaaatagatgactatttgcctgaggctgtgactaaacagcggttttacctacaaacgtccacagaaagagtgaagggcagagacaacggagctgtcatagatctggtcgtagttacatgacattatatgttttggaaaactcacaaaattgaacacaaaaccagtgacattttacagcctgtaaattgaatatcaattaaaaatataaaaaaatgatattcattgataaactaatctgtgattttggctaaaatcttggaagaaatttaaagagtttatgatgttgttataatgaaattcctttcatttctatatacttatttgaacaatattttctagttgcttgtattataaaactgaactacagaaatagaattttaactaaatctatcttattgcaccattaagtgaaaatttgtcatggatacacaaattaattgtgaaacaaaattataaatttttaaatggcattataaatattattaatatttataatataattaatctcataatagatgcatttccaaaaaaattcatgtgtaatatttgcctatcactaaataatatattgaagatttgtcagttaatatattaatatcaatgatataaagtatataatttatataacaaatttgcttaaaacaataggttctatataattaatatatgatcataatatagttatatttaaataatatatgatatatagataaatatataatatggaaatatataacttttaattatattttcaccatattattttcaaatgtgtataatatattaacatataatacataatatattaatctataaatactaataatgttttttatcatgaattcattagaaaggtatgctacattgataaaaatattaatcataaaatttacattaagataaaattttaccaaaaagtgaaatgaaagaacaagtttaatttcctctgttttatagttaaaacaagaggaaaaacaatcaaaaccacagaataatagagaaattagttaattggatcattgttagttagcaacaggcaatactagggctaattgaatctaacacttatacccatgttctcattttcttcttcaatatactggaatatttttcacaaaggatctatgtaggaaaaaagtatgaaagaaggtgtttttggcttttgttgctcatttttagaaatcaattatatactttgcattgtctttcaattcaccttatataagaaagatttctactgctaattattttagaattattgacatggataaaatctgctaatcttaatcatgtgttgcaacttctcagcttctttttttttcctttggatacaattgaagttacataacctttaattttcatttttgccttttctggtagaaaattcaaaataaaaggtaaagataaattgctaaagactgcttcagcttgagttgtacctgtttcttcatgtatagatattcaacacaagtgtgggtatgtgtgagtgtcaaaatttgtcaagaagcatatatagtgtcatatttcttatttaagatattttaattagttatcacaataatccttcaaggaaggtattttaacaataagtaaatctcaaaaccttttttgatgttcttctttatgaaatggccttttaagttacattactacgttagccttatactgaaatttaagtatagaccacctcagatttaaagagtaagttgaaaacaaataaacaaataaaaaggatctttcggcagacgccattatcctctgtttctctgctgcaccgacctcgacgccttgcctgtggcccacttgttcactgactataggctactgcagcactggggtgtcagttgttggtcccacccagaacgcttcagttctgctctgcaaggatatataataactgattggtgtgcccatttaataaaagaatatgtaaactgaacagccggaagaaaccttcccgaacactgaaaccaatggtgaatttggtaaacaccctgcagaagatatggaagagtaacaagcatttaaaagatctagaaacactgatgagatggttgaattacgcattctgcttcagaccaagaatgctggggcagtgattggaaaaggaggcaagaatatcaaggctctccgtacagactacaatgccagtgtttcagtcccagacagcagtggccccgagcacatattgagtatcagtgctggtattgacacaattggagaaattctgaagaaaatcatccctaccttggaagagggcctgcagtttccatcacccactgcaaccagccagctgccgctcgaatctgttgctgtggaatgcttaagttaccaacactataaaggaagtgactttgactgcgagttgaggctgttgattcatcagagtctagcaggaggaattattggggtcgaaggtgctaaaatcaaagaacttcgagagaacactcaaaccaccatcaagcttttccaggaatgctgtccttattccactgacaagagttgttcttattggaggaaaacccgatagggttgtagagtgcataaagatcatccttgatcttatatatgagtctcccatcaaaggacgtgcacagccttatgatcccaatttttatgatgaaacctatgattatggtggttttacaattatgtttgatgaccgctgtggacgcccagtgggatttcccatgcggggaagaggtggttttgacagaatgcctcctggtcagggtgggcgtcccatgcctccatctagaagagattatgatgatatgagccctcgtcaaggaccacctccacctcctccaggacaaggtggtgagggtggtagcagagctcggaatcttcctcttcctcctccaccaccacctagagggggagacctcatggcctatgacagaagagggagacctggagactgttaccatggcatggttggtttcagtgctgatgaaacttgggactctgcaatagatacatggagcccatcagaatggcagatggcttatgaaccacagggtggctccagatatgattattcctatgcagggggtcgtggctcatatggtaatcttggtggacttattattactacacaagtaacgattcccaaagatttggctggatctattattggcaaaggtggtctgcagattaaacaaatccgtcatgagtcgggagcttcgatcaaaattgatgagcctttagaaggattggaagattggatcattaccattagagaaacacaggaccagatacagaatgcacagtatttgctgcagaacagtgtgaagcagtgtgcagatgttgaaggagtataatgcaagatatttttttcttttttatagtgtgacgcagtattctggaaagtttttctaagactagtgaagaactacgtcttttttttttttgttatctgcttctgtttaaaaagccaacacgcctctgcttcacaggtgttctgcatttgaggtgtagtgaaatctttgctgttcaccagatgtaatgttttagttccttacaaacagggttgggccagggaagggtgtgcaaaaactaacactgaaattttgaaacagcagcagagtgagtggattttattttttgttattgttggtggtttaaaaaaattccccccatgtaattattgtgaacaccttgctttgtggtcactgtaacacttgggggtgggacagggaggaaaagtaacaatagtccacatgtccctggtatctgttcagagcagtgtgcagaatgtaatgctcttttgtaagaaacgttttatgatttttaaaataaatttagtgaacctatttttggtggtcatttttttaagacagtcattttaaaatggtggctgaattttccaacccacccccaaactaaacactaagtttaattttcagctcctctgttggacatgtaagtgtgtctcttgttggacataggcaaaataacttggcaaacttagttctggtgatttcttgatagtttggaagtctattgctgggaagaaattccatcatacatattcatgcttataataagctggggattttttgtttgtttttgcaaatgcttgcccctacttttcaataattttctatgttagtagctgtgaagaactaaggtggggagcagtactacaagttgagtaatggtatgagtatataccagaattctgattggcagcaagttttattagtcagaataacacttggttatggaagtgactaatgctgaaaaaattgattatttttattagataatttctcacctatagacttaaactgtgaacttgctctagtgtcttattagttaaactttgtaaaatatacatatatttgtttttccattgtatgcaaattgaaagaaaaagatgtaccatttctctgttgtatgttggattatgtaggaaatgtttgtgtacaattaaaaaaaaaaaagatgaaaaaagttcctgtagatgttttgtgtagtatcttggcatctgtattgatagttaaaattcacttccaaataaaacacccatgatgctagatttgatgtgtgcccaatttgaacaagggttgattgacacctgtaaaatttgttgaaacgttcctcttaagggaatacagtaatcttatatagatatatatatatacaaatcttatacatatatataaatcttatatatatatatatatatatatatataaaaagaatctttcactctttaaactataatcaagatttgaagacttgaaagtgagatgaagggaaaataaatgtttttcaacattattttgttttgttgtaaatacaatgcacagattaaaatatgctatcataagaggctgaaatgaaatctgccttttcagttcaaacttgagtttcagaaacagactattttttgaatgttagaagttgatataaaacaaatgtcaaaaagtctctctaaatgtcatgcctattcttttcaaggtaaaattgaattaatttatctcatcaataaactgatgtattttgaactgcaatgatatgtatatataagatatctaaattttcttttgtagaaagaagtataaaaaacattttctgtcatcataaagtgaataattagtatgtatatcaattgttttttaactgctaatttgaataataaaaaagttcctgatatggtttggtttggctctgtgtccccacacaaatctcatgttgaattgtaatccccagtgttggggggagggacctggtggaaggtgattggttcatgagggagtggggggggcaggcagatatcccccttgctgttcccatgacagtgagtgaattctcatgagatttggttgtttaaaagtgtgtagcacttctgccttcactctctctcctgctacatgtgaagacatgcttactttccctttgcccttctgccatgattataagttttctcaggctttcccagccatgcctcctgtacagcctgtggaattgtgagtgaattaaaccttttttctttataaactacccagtctcatgcaggtttttatagcagtgtgagaacaaactaatacagtccccaaaggcaatacgttaattgccttaaggttacatactcctgaacataaaatttgagagtaaatgattatttaaatgcaaaattttaaaaagacttttaaatttcttgttttcatttactgtttgagatattctagaattagcatttttatgtactcaaaacattctaaattaatacatttttagtttctaaccattttaaaaatacatgtaaagtaaaagctgtgtatattagttaaatgcagagtagcttgttttcccctttgcacagttttagtaaaaattatatatcacaggtgccttaattggaaagccgaacaattttgacataaacattgtgcaaaacatccctgggacttaacataattttatttatttaattcttttttataaaataaaattcaaattttagacatttctttctagtgaatttattattctgggggagaaatatgttataccaatataatttacagtgtttagaaagaaacactttttatgtctccataattcaatctaaaatttattatttcaaaagcagatatttttgtaagcaaagcatttgtagaatgtatctaattgccaaggtaagataattacaatacaataaaaagtaagaaaatgatttaaaggtcatccagaacatctcaaaggagctaagaactttacaggtttttcccactcccaactgaaatcaatctctaattgattcacacacttgtgtgcagttgataggaaacagtcattcctatctctattttgtaaatgacaatcctgtcttttttttgcttttatccttctgaacaaactatatgagaatccactatataatttagaccataacttgcatcgtatttttattttaaatatgtacatttacagtgagtaattgtattattatctgattatgaattttcctacagataattctagctgaatttggttttgttatttttttatgtcttacatgcaacctaaatg

SEQ ID NO: 16083 - DNA, 6804 bp, Human; identical to SEQ ID NO: 16082

SEQ ID NO: 16084 - DNA, 10554 bp, Human; identical to SEQ ID NO: 12320

SEQ ID NO: 16085 - DNA, 17462 bp, Human
caattatgtatataaagtttctacataaataaggattttatctgtagtgtgttcctttccagatgttctttgtctttgtatgaattgaatctgctaacataacttttagtttcaggctgctctctttaaatgtatagacttagccaccacacgaagttgtatattgtctatgttaagaatggcgtttgattcgcatagaccctaccatcattaaagaaaatgattaaaaaccatatccaaacatatgcccctagaactgtacccaacttttacggggaaagtatcaagtcagattttcaaaagcagccaagttaaattctttctgttcctcaagactaggctgctctgagaatcagaatgctaattgcatatgcttgcccttaaacctgcttcacgttgaagaatgaagaattaattttcttttctcccatagaaaggtaagattacatcacgtgttgcgactagaaactttaaaccgaattcccagttaagagaaaaagtagtaagatgatcttggctgctcccccggccctcttcccgccctcttctttgttgtcccctgattatgcttgtttagcgctggggcagtcctcaaggattccctaaataaagccaaactgatgaacagtaatagcctgtgtttaaaaaaaaaaaaatcggaacataagaaacctcaggctgtcttcgattactgttctagagaaactttatgtttacacgaataaggaaatgagtttttgttgggggttgaggaggaaggaaagtcatggtgttctgacgtggaaaacttctttaaaaggctgcttagtctttagtttgaaaataaaccaaaaaggtttaggagtcggggaaaggccctaggaaaatccagacagtggtcacgtttgtggacgacgtttagagcttgctatcctgggcacacaagaacccttggactgttcggtgcaaagttggcaaatcctacacggcctgtgccagggtttactttctgcatcaatttcacaggcgtccagcctggctgaggactttttgcggtttttaactggaagggaaataagtcggcatcagcacttagggctgcttaacttttaaaaggtggtagaacgcccagccttacacgctgctgcttaaattctcggtgctcaccaaggctgggctcgtgtggcccaatcctgcaatccccgaggcggtgtttcttaaagagtgggcttgattctggttaaacccattaagaagtcggaccccgggctcgtttcttgttctgtaattatgggtaaagtccaaggatctgcgttttgaagaggtacctaagtagttcatcttccttccccctacaactttttatttttaattagttaaaaatagttttacatttttgatatctcacacacaggttttttctttttttaagcatcccaggaagacaaatggctcagacgccaacccttttatttttattccttgtctttttctaaatctttcaaaacccccacctagagctctagagatgtgtccattatgctctacccacctccgcccccgcccccatgactttaaaatgctttttattccactttttatattgctcagtcgatcctcatgcactgcgcagtctgcaaacttgaaactcaaggcgatccacttcaatcttttcccgagtcaagaaaaaaaggaaaaaaagtagaataaaaagcactcaaataaaatctccgaaacaaaacctgaattcactgcctaaggtcagggcctttcttttgtgtgtcgctttaagcatcggcgcgtgggctgggggcagaccgcgcgtacccgccctctttctggggcgtcggcggagcgtggccaatcaacgggcgcggctatggcagcggaagccggaagcggcgagcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggtgagggagtcggcctgggcgtctccggtgggagcgggggcgccgagggggacgagccaccggggctcgggcggctttgcaggcgtattccgcccgggtcagagcctccggccgggagtggtctcaccgccaccctcccagccccggatccgaggggggcgccaccgagtttgtttatctcagcgcacacgggtcagtgtttttttcttccagccactgcggcaggaagcaagtaggtggaggttttactttcgagttctgtctctgctcctgaggacgaagaggtttttcagaattgtttgttttgattttggttttccccgtttattcatctttggttcgtatttctcgatcttacaagttcgtaggtttgagaaagaacaggaaaaggtgacttctcacaaataacagtgctggagatgacaacttattgaactcttaagttctcagcactatgttatgcacttgacgggcattactttaatcctccactgtgagatacttgttattgcctcattttgtagacgagaaaacgggcatagagggtgagacattggcccaggttcattccgtaaggttggagcctggaattcagatacaggtttgtgtgactgtcttgggctttgaaccactacggagtttccctgaaggaagattatggtgatgattggaagatccatctctggtgccccccgcgcccccgtcccatcctgctccattccacttaagggcctccagcattaatctgtccacagaacatatccaaccctggggataagaacactactaatgcccagaccatgtcttttggagagagtagagaatataggagatggctgtttctgttattgcaaagttttcatgcttccaaatttacttagggttttcaaatcactttggttctttgagggtaaagttaggataaatggtctattaaacctctatgttcctaggtcctccagaccgtgctgagtgcatgttacatacgtttacatttatatgtatgcatttgtatgtgtacgtgtgcatataaagcttaatctactttcacaaaaagaagttcagtataaaaatgaaaatagcttttcgtgttttccttcattaaaaatgaaacaacgaagagcttggcacagacttactgctctcaaaacctgtagaattaaagcttactgactcatgagaacgagaactgtctcatagttaatgttagagaagcagcctggagtggttgttgttagtaatactgtctgtggagcacagtagcgtcgcagtagaagttagaccaatcccacctaagtagtcagagaatcttaaaaagtaaagcccagtaatgtttacttaagggtctgtttctggggaattaaaaaattaaacatggaactgtgccaagttttaaagtttccaaaaacgacaaggtatttaccactgaaatttaggaaaaccacatactaatagtattccattctttacttttctagaacatttttagtagacattaatgcaggtgtgctaaagtagaaatcactgtcccagagtactgtgttggaccatttggaaggagccatgtatctcccattacctatacaatttggtatcattcgattagataggataataagaatatttatttatatgtacttaatttttcaagaaatgtttttttggtgtccataaatctggtcccttggagtgattgaattccgtacttcagagtttagacaataagaggcagatacgtttagagtaacttaaactgatattagatctactttcccccatataataaaaattgagaaaaagtagacttcaggcaaagtattatcaactctttattgtgccttgagtgaactagatagcattttattctttcattctgactttcttaaagtgtttagacatttcttccttgtgcacaactaaaataatttatggagtgcaggtccaaagtagtttttagagggatatttctttttctaaagaacgaaccaaaaagcctcaacaaaacagtgtaaaaggcagagtattgcttatatagaagctcaaaaacagagatatttgtttggcatattttaaatttcggagtaatgcatattcagaggaaaagttaccttatttaagtaaacgaaactattcggactcctcgtggtagggataatatggaaaatgttagaaatatagaactttaaagctgaaagagccttagtcattttgtctaaatgccttccccatttaccaatgaggaattagatcaatagagatagaataacttctaaacaccaatttgtggcagaacagataaaactttaatcattcatgaaaccaaatattagttcacaggattgagacaaaatgcagtgtatttgacttgaccagagaagcaagactcaggttctggttccagctttttctcttttactatagacaaaacatttaacactggacttcttgttactctctttggaaataatatctcttctaacaagctgctgggtttttttgttttcttttttttcctcttgctctttcaccccgtctgaagtgcagtggctcaatctctgctcactgcaacctctgcctccagggttcaagcgattctcctgcctcagcctcccaagtagctgagattataggcgcccaccaccatgcccgactagtttttctatttttggtagagacagcgtttcaccatgttggccaggctggttttgaacccctgacctcaagtggttggtccaccttggcctcccaaagtgctgggattacaggcgtgagccctggcacccggcctcaaactgctattaaaaaaacaaaaacagctatgattgtatacttatataacatgttagttttcttttttttggtttttttgtttgtttgtttttttgagatgaagtctagctcgtgtcccccaggctggagtgcagttgtgcgatctcggctcactacgacctccgcctcctgggttcgagcgattctcctgcctcagcctcccgagtagcttagattacctaaaattacctagaaaaaaatatgaaacagtgtacagtacccagcagtcaggtgtcagtgctcaagatttttattaagagtgacgatctgaagtgcaagcatttactgaaatggaaatgatactgcacaacattttatttgaaaattaacatgttataggccgggcgtactggaggccttacatagtaacccaggggtataaggatataaagttgcattttctcatacaactccacttccttttttacgttaaggtattatattccctaaagagccttgttcttctctatacttaatactgcatcaactccaagaagctcttaattaaaagaagatcatctgggctcttaagttgcattaagttagcaaaaactactgcaaaactgtgacgattcataagattttttttaaattcatttaacagatgttaaaatgaaactgtacttcacagagtcagtgaagtacacagatcttaattcattgtttagtaacttttgtggattgtataatgctttggcttctatttcaagttttcttttttaagggggaaagatactgttgtcattttgagaaaggtagatggcactttttgttttccttgtgtaagagaaacggattgttatgaaagctttgaactttcctggagttcgagagtacactggtcctctaagtgcggtctccaaatcacgatgatcagcgtcacttgttggaacttgttgggaatgcaaattatcaagccccaccccagacctttgtgatctaaaagccctccaggtgattctgatccacactgaagcacgagaaccactgaccttaggaactgttacctgttcctttgcttccgtagagtgaagtaaaaagtgaggaactcagaagaaaccaaattatctctcttttagagtattttttcaggaatctttaccgtatttatcctgtgtaaattgttttctctgactgtatctgtactagacttggcatgttttctcctctttacagttcaatctttgtagagctgttttcttgccaaatttcaaagaaaatattttgttggctgaaatccttgttttcatagatcagttggtttagagccaagttttgcaacacagcctgaatgaaattgctttcaacttttaaaatgtcttgaaattggttgaactaaggaaaaataatcctaagaatttacctttatactatctttccctgttagtcttttcattttacgtttttgattgctagaaatacttgattttggtgtcttttaaaaaaaaatgtatgtattcggctaagtaatttaattgagctaagggctttaaaaggtctttggttattgtatatgtatttaaagattttgacagcccagaattaggtgattataacaactcttgagttaaaataactggtttgtttttaatagtaaaagttgactttattcaagatcctggttggaaacttggtgttaaccatcttgggaagaagggacatttttggaactatgcttggaaacatagaatttaaattttttcctaaatagtggttctttttcatttctgtgtgtaagaatttatttgtttcacagtagcaacacagatgagcttaaaatattttttcttatcctttgcgtttattagttttagcttttttttttttttttttgagatgtagtcttgctcttgttacccaggctggagtgcagtggtgccatcttggctcattgcaacctccgcctcctgggttcaagcaattctcccgcctcgcctcccgagtagctgggattacaggcacctgcaaccacgcctggctaatttttttgtatttttagaagagatggggtttcaccatgttggccaggctggtcttgaactcctgacctcaggtgatctgcccagctcggcctcccaaagtgctgcgattacaggcatgaaccactgcacctggccaattttaactcttctatgtaggtaaattttgggttaactaaggaacatttaccaatttggttaaacttagaaagcatttaagtgttgtaaggaccaagttttttttcctcctcgtatattcctttgaaatgttgattaattctctaccttgggtccatcaaaatatgataaattattgagacttgaaagaacatttgggattaaaatctgaagaccagaaatgtcagcttgtaaatatattggcagatttgacgcaaatactaatcaggccttaaaataggtaaacttaaaacacgtttctctctagagactcaaagagcaccttcagtcgtatctatagaagcaagacaaattgtaaagtcttataaactgaagaatgtaatgttgttatttactatttaggtacttggagcaaaagtataaaaaaagttgctgtttactaactcatttgggtattatcaatcataaaaataggattttctgttaacataggaaatataaatctacataattccttgcatatcatcttgtgttcctttccttgggtaagattattataacttttttaattaaaaaaatttttttttttgaaacagggtctcactctgtcccccagactggagtgcatgtcatgatctctgcttattacagccttggcctcccaggctcgtgatcctcccaccccagcctcccaagtagctaggactacaggcatgcaccacctgtagctcagctaatttttgctttttttttttttttttttttttggaaggacggggtttcaccatgttgcctaggctggtctcgaactcctgggctcaagtgatccacctgccttggcctcgcaaagtgctgggattaaaggcatgggccaccatgcctggcaaaagctttttcttaagtgatacagttttttatatggtttgattaatcattgttctaactttatttattacatttttaagttgtgttttctgctttttttattttaaaaatttatttttataaatacaaagtatatttttactgtttttttgtattgagatgggtctcattatgttacccaggctggtctcaagttcctgggctcagcggagctgcctgcctcgcattcccaaagtgttggaattacaggcatgagcctgatgcccgaccctaacttaactttagaattggcttgcagatatgggacatgagtcaaaatacgtagaattaagacatttagggaacaacgatgggcctaatatatttgagagaactgttttcaaagttagtaactctttctatccgccttcaccttttaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcaggtatgatttaggttattttaagatatacatgaacaatattaagagttgtctggatgatacagaaactatccttgctctcaaggaaattactatgtttgaaagctctaaagttgtattatgcagtagcatttttttcatttagcatgacatggtatatgtaaaccttaaagttaaattttgacacgctgacaaagacaaatatgagacattttataaaatgcttatgtttatagagtgccttctaagtaatactttctctgcaaatggttttcaaatgttactgtaaacctcacaacactgcaaaatagttattttcattttagggctgagggagcaggctcagagaggttttcggtatcattgatactattctccctttgacatggatttattagatatttaaatcatgttaattgcataaatgatagctctttccttttgtccaaattgggggataaaacttgttttgatttagaaagacttctgttttgttcttgtttttgtgacgtaatcttggtttgttgcccaggctggagtgcagtggtgcagttgagctcactgcagcctccgcctcccagggttcaagcaattctcctgcctaagcttcctgagtacctgagactacaggcatgcgcaaccacacctggctaattgttgtatttctagtagagatggggtttcaccatgttggccaggctggtcttgaactcctgacctcacgtgatccacccacctcagccttccaaagtgctgggattacagatttgagccaccgcgcccagcctagaaacatggttgttttattttcagacagggtctcactctgtagcccagggtgaagtacagtagatcgatcacagcccactgtagccttgaattccttggctcaagtgatccttctgcctcggcctccacaacagttagaactacaggctcatgccaccacgactggctgatttttaaatttttttgtagagattgagtaccaaccactatgttgcctagtcttatcttgaactcctggcctcaagcattgtctcacctcagcctcccaaagtgttgggattacatgcatgaaccgtcacaccagagtagaaatacagttgttgacagtttttttcctggtttgtgtctgcatattatgaaatactcttttcagtgcctataaatattttaagtttgaaccttgcggggaaaagaagcagcatgacaaaactacattagaaattacaatgatttattcttagttgaaagaatgttgacttactgcacatttttctctgaattaactttaagaaggctgtaatacctctttcattttattttgagttaaaaatacgtcaatgcttaacttctagccccatgttatagtacattgtgcagcagagagaagaccagatgttgtagaaaatcagccagatgctgcctctcaacttaatgtggatgcttctgggaatttagcaaaggaagcaggtaatgatgactttataaaattttcataaaatattaagtgattgctgagtttttagaaattaaagttttgtagatggttatttgtttttatatatcatgaaaaaccattctaaattccatgaaagagtaatgtcatgtaaacatttaatagatttgtcttctttttttgtagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggtaagacctaatctatttagcccctgattgtttttgaagactttaaaaatcatttatacatacacatatatatgttttaaatttaaaaagtcaatgaatatgaatcattagagaaaaattagaatatagttaataaagaaaataaaaaattctaagagataactactttgtgaatccttcaagacagtttccactatcagtgtttacatattcatctttacacatagaaaacaagtcaggtaatacaagcttttgtaactcattttcaaaaaacagggcagtataatttctcttagagtgagatattctgtttatgtattctgttatatgtatgttactgtgttatatgtgtatgtattttgtttttatgtattctgttatatgtatgttgtatgtattaacattctattatggtgtttcttttttcctgtatgtgagtttgtgtataacacacatctccatatataaaaagtatacactccttagaaaaaatgtaaaattactaagaacaaaagttctcataaatgctgcctcagggagataaacaccaaatatggttaagtgtggaagcatttttatatattttcaaaaaatgtatgcatgttgtttcacaacctgttttttttccctcaacatctttgcattttagtacacatggaacctactctgggatatcttactcctatcagtggctgcgtagtacttaatttaatggtcccctgcactaaaactactgccttagactgtactatggccttgagaagcagccctagtatagaataccttactaatggacatttagttttttaaaaagttttcttgtattataaattattctgttgaaatcatccttgaatacatttgtcttagtttatttcgtgctgctataacagaataccaacaactcagtaatttataaagaacagaaatttatttcacacagttctagaggctgagaagtccaagatcaaggtgagggtctttctggtcctctggaggggaggaatgctgtgttctcacggcagaagagcagaaagggatgtgcttcttccttcaagtccttttataatggcattaatccattcataagagcagagtgctgatgaccacctaaacacctcccaaaatgccccacctcccagcactgttgcttcgtggattaagtttcaacatgaatttttggagaggacaaaaacattcaaaccatagcagtatctaagttctcttgtcatgtaatttaaaagaaaatgtttgatttgcagttaaagtgttaactattgtataccatcagcagggaccattataaaatctaaatattaatgagtggttgtaaaactaatgtgaacactcatatacccttcacatagattcacaaattgttgatgttttgtcacatttgttttatatgtttgcttttgccagacccattgataattagttgaatttcatctccaaatactttacctttcttttatcttctaacaagaagaatgttcttcacataattacagtgcagttatcatacatttggaaacttaacattaatatggtactgtaatcaaatacaaatctatttaggaattttctcatttatgccaaaaatgtcctttattgcttttattttttaatctagcatccagtcaaagactattcattgcattcagttgtcatgataagttttatttttaatgatcatattaatgtaggatttatatatataaaaaaaactagtccaaatgacagaagatacttaacaaatgtggttttgcctttttcttttttttttttttttttttttttttgagacagggtctcagtcgcctgggctggagtgcagtagggtgaacacagctcactatagccttgacctccttggcttaagcaatcctcccaccacgaacggctaatttttttacattttgtagagacgaggtctcactgtgttgtccacgctggtctcgaactcctgggctcaagtagtcctcctgccttggactcccaagtgctggaattacagtcatgagccccaccgcactcagcctttgactgtttttaattttatttttgaggcagggtctcactctgttgcccaggctggagtacagtggtgcagtcatagctcattgcaaccttgaacttcaggctcaagagatccttttgccttactcagcctcccaagtagctgggactacaggcatgtgccaccatgcccagctaattttcattttaattttttgtagagacggagttttgctatgatgcccgggctgatcttgaactcctggcttcaagtgatccttctgccttggcctcccaaagtgctagcattataggcatgagtcactgtgcctggccttgaatatttttacattgcgttgtcacaagtgagctgtgtcattttggtatattttaattaaaaggcaaggtttctactttgatattatttaaatccacacccttgtatcttacatcaaaatttaagaatcagtcagctttaaattatttgcttttattcttctctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggtaagaaggattcctgagtcctgtcttagcgaaggtccgctttgtcttttccatgcttgaactttcacagctgtacttggagtgttactgagtgaaagccaaaagtgcttttttaaaactaggagaccaaacaaaagtagtttacatatacactgtattcatgaagaataaaaatattatgctcttctgtttgaatttatttcttatgtactatagatcccatcatttcttttattgcaaagtgttaggaaacttcaaaataatcatctaaggtcttttaagaagatactctttgggggctgggcgtgatggctcacacctgtaatcccagcacatttgaaaaagttggtattaaatataatatccatacaaagaaagatgagactgatttagtttagaatattaataggatgaccacagttttttaatatatgagaattatattttgtaatatataacatgacaatatttaagaaagtttagctcaacttgaaaaatggttctattaagtttttgttgtagcttgggataattaaaaatactcattaaattgtactgttttcataaaaatttgtaatgcttttttatattcccactaattaagtaaaattggagcctttttttgattttaaaaattcttaaggtttaaattctagaaattgctcttttaagtgttttgctaagagtattggtaggaatttgattttagatatcttgtggagacctttccagaaaaagagggttgccttttagttcctggaccttattttaagtaagctttttggtcaaacctattctactcagctcaaaaagttgaaactattgaatttattgtgtcatcgttcttaggatccatcaattaagggaacctttcactggtctggcaatgaacagatgactaagtatgaaatggcatgtgcaattgcagatgccttcaacctccccagcagtcacttaagacctgtaagtacatggctgtaaaaacctttaggtccattgctatggtatatattattgctgtgttgggtaacttcatttctcagtactaatcaaagtgaactttgcttgtatgctggctgttcatagtgctacttttctctaaattatcatctgtagagaagatcatgagtattgaagtttgtagaaaatgtattattgtcttgatcatgacaggcatttggtttatttttccagggatgatcaaatcagatttcttacactaagagcaaaaataagtagcaaatataaaacctcaaaatggccaggcacaatggctcatgcctgtaatcccaacactttgggaggctgacgcaggaggatcccttgagcccaggaatttgagactagcctgggcaatggagggagatctcatctctgtttaaaaatatatacatatttaaaaaaaggtcagggggaacaaagccctcaaaatatagcctttcacttacttttgatttttttgtgtttatctttctttaaagattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttgatccagaatgttaacttaccaccccatcctagaatgttacagttactgtatctatttgtgggaacggatttgtttttaactaaaaattaatagctatataatcttgttacattatacagttgacccttgaacggtgtgggtttggggtatcaaccttgcacagtctaaaatccactataactctggactccccaaatacttaattagtaaaaacctgctgttgaccagaagccttactgataaacatagtcatttaacatatttctatcttctgtgtattacatactgtattcttaaagtagcctagagaaaagaaaatattattaagaaaatctcaaggaagggaaaatatatttactattcattaagtggaagtagattatcataaagttttttttttttttttttttagacaaggtctcgctctgtcgcataggctggggtacagtggtgcattctcagctcactgcaacctccgcctcctgggttcaagcaattctcctccctcagccactcgagtagctgggattacaggcacccgccaccacgcccagctgagttttgtatttttagtagaaatgaggttttgtcatgttggctaggctggtctcaaactcctgccctcaagcagtccaccctcctcggcctcccaaagtgctggcactacaggcgtgagccactgcacctggcctggatcataatcaagttctttattcttatcttcatgttgagtaggctgaggaaattaactggggaaattttactgatacctgagtcctaccctgggcttactgaaataaattttgggaattgaggcctattaatttatttttaaatgtttcccaggtggttctaaggttgccagtctggcattgcatttggcaaccactaaattaaagcattttgttttatattttaagttactacatttcatatagtgcataattaagtttcggagagtaaaaagtgttgttattctctagccacccgtttttcaactgtggaagaaatggatgtagatcagttccttgcatatgtttctagaggcactctgcatatagaagaatataatcaaaaaactcacgtgtccatactctcaccatccgccctcacaaagaataacatacaattctctgacctttttttcatttggaatttgttgtataatataaagaatgtccttttttttttttttttttttttttttgagacggagtcttgcgctgttgtcaggctggagtgcagcggtgcgatctcggctcgctgcaacctccgactccctggttcaagcgattctcctgcctcagcctcccaagtagctaggattataggcagcgccactacacccagctaatttttgtatgtttagtagagatggggtttcaccatgttggccaggatggtctcgatctcctgacctcgtgagctgcccacctcagtctcccaaagtgctgggattacaggtatgagccaccgtgcctggccaaaaatgtcctttttaaaaaacttcatttaaaaatttcattatttgccatgatagcataaataatgcctgtatttccctttccagattccccagttgtcagcatttagcacatttaccctatcattttcatgcacactacatatgtatactatttttatttcctgaactattgaagagtaggttgaagatacgatgcttcatcacccacttagtatataaacctcagtgtatattttctaaaaataaggatacatgcctatataccctgtaatataatcacaatcaagaaattaccattcaatttcataagatcccattcagatttcatcagttgtt

SEQ ID NO: 16086 - DNA, 32666 bp, Human
cccaagctcctgggcacaacctgcaaagcctgttgtagcacctgccccactgcactgtcagatccttgagaacaggcttcgttttatttctctttatagctcctatgatcagccagaaactcactcattgttacataagtgaataaagtgtttaaaaatcaaaacaatgtttgatctattgagaaaaccagaatatttaaactcatagacttaaactatcaaacatcagagacaagtcaggaccctgctgagccgatggctgcccttttgtaactggcagagggttggccaaatgtgcatggccacaccaatggctcctgtctctgaccttcctttggatttggaattaactgagtcctggagtgagtccctgggctatttctagaaattgccatctttctccggagtggtctccactgacatctgacacacttaaacgatgtggctgctcaagagagcctgtgctaatctattttagagaaaccatcctcagaaatgcatcttccagtgaaagacttatccaaaaatcatggaactggccaatcacaccagccctgctctcacataggctttcttttcaatcacaggggcaccttccaatgtttgccaaagagaaaatgttcatgacctgatttctggcacaagtgtaactgcccaaggggttcaccttccccactgcctagacagagccaacttatcaagacaggggaattgcaacagagaaaaagtaattcacacagagctggctgtgcaggagaccagagttttattattactcaaatcactcttcccaaaactcagggatcagggtttttaaggataatttgttgggtagggggccagtgaatcggaagtgctgattggctggcttagggatgaaatcacagggagttgactctgttctcttatgctgagtcagttactgggtggaggccacagaactggttggtaggtcaaggtgtggccatccggttgttagaaatgtgaaaacctgaaaagacatctcaaaaggccgatcttaggctcacaatagtgacgttgcctttaacagtaactggggaagttgcgaatcttacgacctctggaataatggctgataatatttagaattccagcccctctcattctaacttggtggctgttgggcttttagttgttttacaaaaacagtttagctttgggaaagggctttaatttaaattataaattaaattccttcccaaggctagttcggcctacgcccaggaatgaataaggacaatttagaggttagaagcaagatggaattggttaggtcttatgtcgttcactgacataattttcttagttacaatttttcaagacgatttcacaaggattgtgccacattgacaggtggatctatctttcattggacaagctacttaacatctctgacgctcagtttattcatctttaaatgggaataaaaataataagtacctcacaaagttactgtaaggattaatgagatgaatcgtgtattgggtttagcattatattgtaaaggttttctgaatgtcacatatggtcctttttttacatgttgtcttaaagcaagatttgagggagcagtggaaataggtgccaaattataagataaaaataaggaaacaagaaaaccagggtcaagagggacactgcatcatctcaaagaatcatgagggcttcaccttccttatatcacataccaacttggcccttcatttatttattcattcactcattcagtacttaactctgagcatctcttcagcatggtagcataaacaaatgagtaaaagactttgtgccttatgctagaaagaagagcctggagatgtccaactaaaactcactgcagcaggaactacaagagacagcagagggtgtgcctgccagggcttgcaggggggccgcgtgcggtagcccttgcccttgatgagctgggtttgcagttactttcctgtcctgatgacgtgtctgctttgtgttcacattttagcaatcatctggggggctaaatgtgacaaaccgagaagatggccaagatcaacacccaatactcccacccctccaggacccacctcaaggtaaagacctcagaccgagatctcaatcgcgctgaaaatggcctcagcaggtaagatgggctaagatgggcttttcattttatgcctggctctggtcatttccacagctgatctagactgtgggggaagaatgccttcacgttggccagccacaggtcagagggcaggggaggtattcacagcactgccaacttcatttttcatctcacttaatcctcacaacccccagaaagtagtctgtattcttgttttagagatgtggaaaagcaggcttaaatagtcacttaattgctataaggtaagaaaatgaagactcaaatgcagcagactaaattttactgtaagaacttcctcaaactgacacactctcccatgtattcatcaaaaatgtgttggactcttgctgtgcaccagccactgaactgggtttgcagtctgagctgggcaccaaagatgtagcatgaatcagatgccctgccctcgcttccaggggaagatctggaggcaggccatgcccagggcctgtatagggagtgggcagtgccccttgtcagccaagccatcaaccccatcaatgacatcctgacacaggtaggaaatggaaatctggagccttaagctctacttctaaccctcttcctaacttactagtagacctgggaaaacgcatttaaccactccatgcctcaatttcttcacaatgaaacagcattttttccaagctcctggtataatagtgaggacacccgaagggacctatttactgtacatagagctaaacccttatgtttctttgtttttagttttttcctttttgtttttcgtgacagagtcccaccctgtcacccagactggagtgcagtagtgcaattagtgcaatctcggctcactgggttcaagtgattctcctgcctcagcctctctagtagctggaattacaggcacccaccatcacaccctgctaatttttgtatttttagtagagacagggttttgccatgttggccatgttggtctcgaactcctgacctcaggtgatccacctgcctcagcctcccaaagtgctgggattacaggtgtgagccactgcacccagccatgtttgttaaatgattaatgagatgattgagttgaagcatgagcaactttctttccaatgtttctgttatttttgccctatatatatagaattgaaaacttctccccactatgcagcttaaatgcacactgtctgatggccccaaaatgcagtaacatccctcagtccccacctccctgcactgggccctcgtgcctcatttcttctcattcatttgtgttcatcacttcctctcccaaaggcacatttggttgtttctctgtctacactcttggtcccagctcctcagcaaactctgctaataagtgatggtcaataattttcaaagagattgagtccccattatggcaaacccacacagcccttgaaccccaccttctgagatttcggcaatggaaggaagatcccagagcatcccaacagatatttatttcctccaaccattttaactcggtgctggggccccaggaagtgtgatatggcttcagaggcatcagaaagttccatcctactcaaatacctttctcctaactagccctttgtcaatgcctgcgtcgcaccactggagacttagtcctctaagttaaggcattgctccttatttaaaagaacaaagaacactattaggaccttgaaacgtctgtatgttttaatagtttatttcccatgtgtgagctaataaagccccttgaagggggtttcaaagagagggtcgggcatcagggagaaggagcccaagaatgaggcacagcataacatcacgatcctgggatcctgggcccaagaccttgggagaaggaccagaggctgtcaggatcaggaagattttgaagcagaatggaacttttcctctttgcacccaacttgcctggagtggggcatgacccaagcatgtcatggagcttccagattccctaaaggcagagaaggcagtagtgggatctcagtccggctccttccggtgagatacccactggagtaggcacccagaagaaggcagtcctggtctgcaggctgctgcggctcctgcccacaatgtctgcctgacttgacagcaccgtggtcctgctgactcaccctggttctgctttggccagtgacctccaagcccagcttgacctgtatcctgttgaagcttgcaaggcctcttagaagatgaccatttgcaaaatgaattgctagcttgttaagccatgctaatagcagccactggcctctggcttctggcagactctctgcaggctcactctggaatgcacactgacaagggtcacagcacctctagggatcagccacatggtcaggggctctgaactgacgtcttgagataatgctatttgtcgtctgcatgggtgagaaaaggtcctcccttctccttcctttgcactttctgtgaccagaatgatggtttaacagcacaagcttggggtcagactgcctgggattggacactggctctgcaactgacctgctatgaaaagttgctcagtggctccaagcctcagttttctcatctgcaaaatgaatcagtactaatattgccctcctagggttgtggtgaggttactgcagatgtgaatgcagaggtcctggcacagtccctgctatgtggttaagtgctcaattgactcccactcccggtcttggaaatgattacttcttcctgtggcccttctctggtctcttctccttgacctcagatagccgcatttcctgcctgtgtccaagccctgctgtttcagcctgaccaccagccgaggcttactgaactccactcaggtctcggccccacccttcacatggtaaattgacagattaatacagtatcccgtggaaacaccactgagatttcaaaatgagagacagaaagagtgcttcctttatgaaagagctatgctttatcttacagaggcgagactggctttaacagccagaaattttcagaatgttccttggagtcaccaaggaatgacagtgtgtactcaggatggggtacagcagcctcagggatggaggctgggcccagcccctcccctgcttcccagcccagcccagcatctgtctatccaccgatgaggtctctatgtgagactgatttgaacaaaggactcaggcacataccacgcaaaaatttttaagtttcaaatcactattttggagccaggagaaatagtgtttggacaagtcacacctctttgtcttgaaattccagtccttttagaaagctttatgagacaaatgattgagaattggggtacacgaacgttaatcgctctttatcttcagtgatatcaagaagcctgcactggaaacctgcgtgtgggtatggcccctcgctgagtgcccccaagaggaaggcatagccaagtctctgtcccctgagacttccctgccccaaggtcttttcaccaaattggagggccagtttttaagttattggaattatttttatagtggaaagtcatagggaagaatgaaaacatttcatttgaatgaaaacattttacaccctgaaaataccaaaaataagtctgagttttcatttctacttagatctttttagttggctcaattatttaagaactgtctggcatatctgtgaggataaggcaatagaaacaggctattctctgctgcagagaattgcagctaggactgagggcaacttaaatcccagatccatctcctggcgtagcaattttgaatgagctttggggcacgggggtttgtgtctgacagaagagtggtcttcttgtgttactccctgagcagagcccaaagcaattaccaccaaagaaaaccattttcatcccacttctccaggaccaaaggcttaaaaatgcattggcttcagtcccccaccacatgtggccaatagcagtgggttccaatcattcaagttcctcagggcttaagaagaggaaattaaagtgtcgtattccccagccttgtgctgaaaggtcacctctgtttactctcatgtccccaaaactatcttgctggaaaacatcagatgcttcaccaagtgcaaagttaatttccagttccagttctcatgggagcccctgtcctcgcccagtcacaagaaaccttcaccttaccaacgttaattcctctgtgcaaataaacgtagaacttgagcattacaaggtgaaaattatgttgtctttcaaagcagtctctccattctactagttgttcttgttcttgccaactaccaacatcaggggggcctcttccttggaaggcatcgaccccacatgggatcttagaatagcagcccacacgtgggagggaagctccagggttgtcctggcctggtctgttcattttacagagactgaggtcctgtaaagccattgccccaggcccttccaccagccacaggcagaacagagcctggccccacgactctcattttccattcctgcattagtcgccaaaagcatctcctttttttcggtacctgtgtgtccttggggactccaaatgtcacctcagacatcagttcctctcctctcttcccacctcccctccatctgcctggtaaaatcagtttctgggagaagtaattaatgaagtttactatgtaaacacccccaggcatttaatatgggtaaagctctggagctaaaagaaagacattgatctaatggaatttcaggcattgagaaggaagtggggcaacgcatagggaaaaaatgggcccccccatcaggcccctggaacttgcatcatgtaaggatctccctgttcttcacggccagttgtgcctttctggtaactgaaatccacatgaaattgccaacttttgctttatttgctttgtgaagatcaggaaacttaagcccagagagggtaagtgaccagcccacagaatactcagcctgcaggtgctggagcagggactcaaaccaggacctgccacctttccactctgcctcctccccctgagtgggcatcatagatcccgcccatatgcaacagctctcgctgctgctggttgcaggcctgctttgcaatcctgggtgggttttgccttcctcacccactcaccagctctgatgttatctaattcatttgccgcgaatgcaaataaatctggtctcaggatgtgccctcatgcaattagcaggaaccagactacgctaaaacgctgggccgactgcttggtgcctagagctccctgaggagctgctggtggcggcagaacacctccatccttgggattgcctccagatcttccaggcacacaggctgtgacagggcccccgcccagctgtcagctgccatcaccaccacccccatgccagcttctcgaatccaaggacctctgccacctcctcctgcaaccaacctaggtgcattggaacatgcatcctgcctttatagtatacagaatatgaagcgggcaagggaattgtagcttctggactgcagcagggtctctgacagggtcttttatgtgtacacaaatgagatgagagtgggtttcttatgagtataaggggagaattcaatcaggtggtttgaaaataaagagccatgcctatggtacagccatatggattacagcaatgtctctagtggcatgccacagggctcagtcctcagccatcctattaatttccttttcatctgtgccatatatgaaaatacagggcagcttcatggagtggatgacagcaagttttgaaatgggatggaataacattggaatctcggctgtaccacctggctatgggatctcggtgaagttgcttaacctttctgaactcccatttcctctcttacagggttgttgtgtggatgaaatgataaaatgtatgtggctggcatacagaaaagagccactgaatggcatgtggtttgtgtattttgtttgtgagtaggatggtgttgggaggaaaggtgagtgtgttctctgcataccaatgcttccaaaacatcgagttactcagatcagtgggaaggtccaatacttaattccaaaaaaaatcaattgcgcatacacaagccggggtcctctggctggcagcagcctgtgttacaggactgctttgggttttcgctgactgtagctggtgaccatcaaaaaccaccagaaacacacaaagcaataaagtcttcccagagtctgcccagtcaagcaagaccccaggaacttgctcacaggagaaggaccatgacaaggaagagacttgaccccaaggaggaattgctgggtgagctgggggttctggcctggaaacccagaagtcacacaggtcctggtcatggaaggtagaagacgaagctacctgactcccggtggttccagcagaaaacagcctcaatgtggggaggctgagagagggaagaatctgtgggcaggtggcgcagtcaagagacagcccaggcagaccggggcatgggagtgagctccctgttgctggaaaaggcagggaggaatctgtagaagaggagaagcaagcagcagcctggccaccgtgatgcaaggactctgacttctaatcaatcaccagggagagactgaagcttttccctggtattaattcttgcctccttgttaagaaggctaattgggttggaacaggtcatgtgatagaattaatttgtcttgcctgggctcctcaagactcatagactgaagtgcaaatccctagaggctaatgcctggctggcttttaatcaggctgatcaaacttcagccccaggaggtttaaaagaaaggaaaatattcccagacgcattcctagtcttattccaggcaattcaaccagactctgctggtgtgactggtggttgtatggagttacgggcacctgtcctttctggggtcacactttccacaatgggttgcacaaggggagtcaccacaccttacctctgccttgcaggagagagagcctagagtttggcaaaagggacgaggggaagtggagtctcatttgaaagcactgtacaaattatttgaactgcatgtggagagctaggccagttctgtgcaatattccagggcctccgtgttaaccagcgggttcccaggaagcctgccagacaagcccacaaacagctgcccaggcagtgtggctgcagcacacgcagtgggaagggaggctcagaaagacccctaaggagcgggtattcaatctagcctcagaagatgaaattcagtaggcgagaagtgttggaaccaaaatcctcgttctggagtcattttatggaagcagctgctttggcttgaaatggcaagccccgggacctctccccacccagtgctttgatgagggccaggccagcatgtactgccaccttcccgtcctttcacctagccctggacagtagctaccttccttgctgtaaaggaaaggccacgtttataccaaaatccagaatctatctgcaggaggcaaagggaagtggggagcccctgggatgaggatctgtgagggtggctttccctgctaagcagaacatctgactgtctcactcctggctgtgtccaggaggtagatgggcttgaaatcaattctgcttgctgcatatctgatttcctagagcccactcgtcaagtgaggagacatcgtcagtgctgcagccggggatcgccatggagaccagaggactggctgactccgggcagggctccttcaccggccaggggatcgccaggtaactgaccagcctcagtccctaccttggcctgggggacactgttgcagaaagaaggtagtgacctctcaggaaaaagtgctagatgggggtggagttgaagatttggaaaagaaagggtcaggagcagagcagcctgaaaactatcagcgagtaatttcctcttgggtcagatgttctgagctcagaaaagtctaaggaaaactgcctttatctgaaattgcttaataaaagctgacattgaggtacttgctcaggtttggaagaattcagaaaaaaagccaaccggagaaggtggtaagagcagccagccgtgggagacctttgattgggtggacacagtggtgtgctgaggatggtggtgatgagtctgaaatggctctggcagggtctcccgggtgctcgtctggaccccagggcaggtaggtgtccttgcaaaagcatttgtttgcaagattagtgagactccaagctctgcttccccctgatgacatccgtactccagcttcaacagctgctccatcctgaggaagtcatttcaccttttcaaatctcatctagaaatgcatctaacagtgcctaccccacaggtggcttgaaagctgcttcagagccaagcaccgactcacggcaggtgctcaacaaacaccaggctcattatttccttccaccacgtggttttttccaatgccagagtcttacatagtcacatgttctaaactttttacttaagattatcacaaaagaaattcacatatctatttattcttcatgcttttcattatgaaggatgctactccaccattgtttatttaactagtccattgtagctgggcatgtaagtgatgttcagtgtttgcattttactaataaagagctgtcttaaggttctttgatgataaaggaagaaagagaacacctttaaatcagctctgtagggctgatacagggtgtgttgtaagcttgcaacacaagctatctcagggaaacagagccagtggggctcgcaggaggggacctggggaggtagtcaccttccccctcccattttctcatggagtttcatggtctttgtgcttctttctgcatgtcccctccattctggctctctctgttccaatatcagctggcacaaggctgaaaacagcctttgccatgtgaccatgagttgaaacacccaaccctgtcttcgagtggctctcagttcagaggcctgagtggctctctgtgcgtcagttgtctgtcctagtcccattgtctgaggctggaggagggagtatgaccttggttccaccctcttggcagaggaagtgtgtggttacaggaattgtctgcggcagagagactgggcttggcagatacctccaaatatgtctgcggcagcagctgtaagcatctgcctacagagatattttcttagtcaatgtattgccttaggctaaggtcataagtgtgtgattagggtcaaggtatgtgacaattcatagcttagttccaggttgttcagtactgactctggctcgggacaccccgtccaggggagggcactgcagatgccaaatcagggaaaccagaagccaagaaacagaatggagtctctgggcctgttccccactgttcccctctggcagagacaccagcaacagcaggcagggtggagggaaggcccctctcaggcccgtgtgtctcagatgagctctagggactggcactgtggtcgcaggtgttggagctcacggcaagctccaggcagggccgggctccgggagagggcccagggcaagttgcaaaggaacctcccaggcctggggagaaaactctagtttgtacaagaacacaccaataagataaaagctgggaaaagactccaggttgtgcctggacgcctgttcctttaagccttgctgtatcagatctcaagaacttctaaataaataaataaataaccttgctctcaatgttgtcatcctttgaaacccacattgctttactcttcctgcacttggcagtcataacaaagagctctccattgggcaaaaggagtgagctaatcccccatttgaaggatcatgccttaggcagagtccaagtgctgcaaggacaaatggtaataaagagagtgtccctttccggggaagcctgcccctgactgcagggtggagggagaaggggataaacggtccccatggggcagagatgcaaacttagaccacagggcccccagcacccgtaccctgctggtcatcattgcttctgccccatcccttgagacagacagagagggagggagaaagagagagagggaaagactggggtttgggggtgtggggggcttttcctctccctctggctcagtgcttgtgtcaccttccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaaggtaaggaacggaaaagaagaaggggcctctggtgcctgctggggccaggcaggaagcctgtgctttgctccatcctgtttggatgcagcacaggtggcctggaacgtcatccccatgagctgttccttgaagaaagtgtttgcccttgggggagcactacatgctcttacagcctctgcggagtccaagaggccttgcaggagggagaaaacccttgaaccagagcccccagcctcatttgaccactcaccttatcctacacaggggtcctgttagggtcccctggaaatcatgttctcagaaactcatcgggggatgctggccttacctatctctcttcaccaaggacccccgtcctagactccactatgacccatcttgctcaaaagcagggtcttttatagcaggagccttgggggggtgtctaaatggtatccacaagtttatgtgtaggcacgcgtgcatttttctgggaagagagtctacaggttggtcagaattttcaaggggagccatccatgtcccagatcaggttgagaaataccaggtggggaaggggacaatggtgagagtagagcgaggtggggagagtgcttgctttctggagggaaaatctgcagaactggggcctctctgcatcttgcttcgcccccaccctaactgggagataaacctgcaatcagactggtagccccttacacacagacacagggctgctgcctcccctcctgacttgttcatgagaagtctccccagcaggtggtctgcagagagacccctgggccagcacaggttgaatcaattgtcactgagcagtagagggtctctttaggacacttaggtctgtctggaagggaggagaggtaagacgttgaggggaagctgacctcccctcggcctcccaaacaggtggattctcacccagaacctattttctggggggtgggaaaaggggatcaaataagcatgatggctgcagaacagacagtccctatataatttgctagagaaaaagctatctgtatgtcaatgaggagaagatgggttcaggtttggagcttctcaaatggtcatatgagggtttctggtgtgtgaaggtgatgaagtctcaggggaaacccagtggctctttcgggaacgtccattttcattccatatttgtatggggagtggcagtgggtatttgtatgtaatagatgatgcaggggatggcgaacggcacgggcatttttaagatggaatatgagagttcaaggccatgtcttgccagtgactgctttaggagacccggggaaaggtgtgagaatccctgactgagatgggaaggccagagttttcacacgagcttggactgcaaacgcttgggtttcctgggctgggggaaggaggctggggaaggcctgggcgctggcccagacaagtgcagggaggtcccaggttcccaggactgggcatccagtatcctcgagggacaccatgagacagaaagataaggaggcaggcagataagaaagaggacaaagtggagaaagaggaagagggaggggggaaaaagaagtttctcagcaagccagccagactggtctaattccttttgggcaagcaaagacttccttatttaaattgatcaaattaccttcctacatccttagagatgaatgttagactctctgtccatttcccgatgggaccagacaaatggagggttgagctaggaccatatccagggcaggccccgaccacctcacagacatctgatggatcactcgcgggcagggtcagcatgggaagatggatgcgatggtgcggatagtgttggtcaatcagcaagtcttcctgggggtgaggattttgaatttttctggaggcaaagtctccactgcaaagccaagtatatacacagacaggtcctagttctcctgtgtgggcttggctttgtggggttacgggcacagaggcatggtgaacacagccactgcatcccccacggagctgaaccttccctccttcacaatcccacggcggttccagttcctgggagattttcagatgagcagaaccaatctagaaacaagcggttatggccatatcttagacggagagagggagatttgggcaggatgagctgaagtcatcataatggcatttatttggctggacatcaagcatcgtggaagaggtgccccgggagtcaggtgggggtgtcgcctgcctcaggctccagttcccgtggtctcctatgaggggtctgcagtgccctgcgaggccgcatggcttttttaacccagccatgttgaaaatgtgttctggcggtcagagataataccttttcctatagaacatcatgaagtactgcaaaattcaactttaaataaatatccagtttgtgcaaaaccagcccctaccttcaaccagattctcacatagatcaggggtgtcaggccctggagtcgtaaaatttggggagataggagaggacaagaggaggagaaactgaaaacagcaacaatcccacctatgctcaattacttgccctgctaattggaagaggccttcgcagctgagggagcaagtcgctgttgctgctgcaggctgcgtccatcctggggcagaaggtgcaagacctcctccaccacagaggcatggaagcactgagggcagaggccacgcagggtccatttctgtgcccctcttagtgcctggcacgtggccccatccagggtggaatggaaggaaattgagtggaatttgaggcagggaagctggaaggagtcaaacggctgaatcttttcttcagaagcctcagtttagccatgttcactctctcttcccccaaggcttttacccgaggtaactaatcacaaagcattttggccttgacaataccaccccgtattcttcaagctgtgagtgcaaaggctggaagcagtgggatagggattggggggtggggcatggtaatcccctggtgaaatggccccaaggaatggaaacagagttcagacccttgatgttctctctaccttcccgcagcgcctggcccctggccaaatgcaacactaacaccagcaacaacacggaggaggagtaagtacccacacacccagcagagccctccccaagcccggtgccctccaccccatagaagccccagcttggcctctctccttagtgctcctgctccccactcccagagcaccagtagaatattttagaatcctgttcccttcgttggaattccatccctgtggacagaagtcggggagggatgagatctgtgtgacttcttggggaagtcgtctgatctcttcgcctctcatttttctcatccataaagcaaaggaattggatcagataaatgctttaagctttagcactctataccacgatatatctgagggtgcagaaccggagttccttgacagagcactggagattctccttaatgatgaaaaggcattttcttattctacaacctcaggctcttgagtgccagtgaaatgcccttgtttttgctgctgttgttattgttgtttgtttgtttgtttttgagatggtgtcttgctctgtcacccaggctggagtgcagtggcgccatcttgactcgttgcaagctccgcctcccgggttcacgccattctcctgcttcagcttcccgagtagctgggactacaggcgcccgccaccacacccggctagtttttttgtatttttagtagagagggggggtttcaccgtgttagccaggatggtctcgacctcctgacctcgtgatccacccgcctcggcctccaaagtgctaggattacaggcatgagccactgcgcctcgcctgaagttcccgtgttttaaggccaatttgggccaattttgggggcgtaatcagagcagtggaaaaaggcaatttaaatatgtccagagaatagcctcttcaaagggtgacctgctataattcctttttccatcaccagatactaaggtggcagattagggacaacgtggcactattcaggaggggaagtcttagttgcagattagggaaaaaatacctatatcagtgagaaatgccgatttcttgacttccaacagacagagaaatgtgccaagggtttttcttgttatttctctctttgttcctcagctagaacttttttctattttctccatgaaggaagcatgtcttttgtttgcataaatttggacatcaaatccagagacccaaatgccagccataacgaaaaatgagatgattttatctacaaagcaatagctatagtgatatgtgtttgacttaaagccaaacctgacactaaacacccttgcagctgcagtatcaagtctttcaggcagggaacggctccagatactgaaaccatggacagaggtcctgggggtttctaggcatctttgtcctggggctggggtgtgggcaaggatgtgggtggatagcgtgggctgcacccggctcttcaatctttcaataaatgggctcacttcactggtccactttgaagccaaggaccaagggacaaaactgggaactatcccaaaatgaggacacacacaaaataattatttatgaacaccttccccgactcttcactccatttctgtcattttcatatggtctcatttgtcctgaataatttttccctcccccatcaaactgttcccagccaaaaccagcagcattttgcagttctgtgtagggttcttttggggcagtgctgggtggatttggggatgcagccgatggtgctgggtctttcctaggctctcagcagtttggtacccagacaggccaaggcccgtaatccagggccacaaatcttgcacaaggcaagctgagtccggcgtaaactgcagggcaaagctcacccaaaaagcttgagggcagcgccgtctgctggtgacttgacgttaagactccagtgcctgaaaagagaccagggttcacatcaccctggaggacagaggaggggtaactttccttgctcttttcatttaatgattttaataaccttttattctaattcactttattgaaatactcttgctgaaaacttggaaaacaagaaaagcacacaggggcatacacacacaaaaactgcacttcatgctaaccatggaattccactatcagagatagccccacttaacatgttgacaaatatacttccaacttcttcctaggcatatatattgaatacttagattgatacaatatattttatatatacatatacttgttaagagcatctgtttcccaactcagttgcctcagagctttgtgaccttggacaagtgtattagtccattctcacattgctagaaagaaatgcctgagactcggtaatttatcagaaaagtggtttaattggcttgaggtactgcaagctatacaggaagcatagcagcttctgcttctggggaggcctcaggaagctttcaatcatggtggaaggcaaagggggagcaaggagtctcaaacggcaggagcaggaggaaggtggggtaggtgccgtaaacaaccagatctcaagaaaactcactcactgtctcaagcaaagcaccaaggaattggtgccaaaccatgagaaatccaccaccatgacagggacacagattcaaaccacataagctggttacctaacttctctgtgtatctgtttcctggcttataaaataaggattgtaatagggtcttattacatggtgggagtgaagactgaatgtgttactctgtgaaaagtgctcagaacagtgcctggtacatagtaagtgctcaataaatattgacttgtgtggtaggcagaacaatctcccccaaaagatgtctaccatcctaatccttagaacctgtaaacaggttacctcatatggcaaagggaacttcgtaaatgtgattacattcaaggtccttgagataggtaatgatttgacttggctgtgtccccacccaaatctcatcttgaattgtagctcctctaattcccatgtgtcgggacagatctggtgggaggtaattgaatcatgggggtgggtctttcccatgctgtgaataagtctcacgagatctgatggttttgtaaaggggagttcccctgcacagactctttgcgtgccgccacgtaagatgtgactttgctcctcatctgccttccaccatgattgcgaggcctcccaagccatgtggaactgagtccattaaacctctttcctttataaattacccaccctcgggtatgcctttattagcagcatgagaacagactaatacaggtaggttatcctggattatcagggtgggcccactgtaatcacatgagtccttaaaagcagaagagtgggtcagagaaagtaaatggaagaagaagagagtcacagtgtgagggggactcgacccatcactgctggctttgaagatgtaggaaggggacctgagctaaggaagccacagcctcgaaaggtgcagccagcagggaaacagggatctcagccccacaatcgcaagaagctggattctgcgtaagatccaaacgagcaggaatcagagccccgcctagagactctgggggatggcagccctgtcaacaccttgattttagtctggtgagatccacagtagacttctgacctacagatctgcaagataatacatttatgttgtataagtttgcagtaatttgttccggcagaaatagaaaactgatccagctattacggtaaactcttttgtagtctgcttcttaacttagcaaaatattaggaaccgttttcccacgtcactagctcttctgaaacagcgttttaagtggccatgtagaattcaccgttgaggatgagcctgcatggtcgtgtgattcggtggctctccctttttgattgtcatgaataatggcagtgattatttttccacacgtatcgcacacagccttgattatttccataggaagtgttaggtaattgtgaatggatctttttcaatgagtgtttaattagcagaatttatctctcaaccatgccttccttcagcgtgtggaagagagaaatcagaggggcctgaaggggactcgaggggttgtcccttccgcaacctttgtttcttcaactattcaatggggcattactgcctgccttgaagaaatttacatgtattcattagataactttataagagttcctagctcttaaaagacacccaataaagaagaggcagcagtgtgaagtcttatgttgaagaaaaacctgcagtcacaggaccatcctgcggacgctgcctgaaccgtctcgcagcccagcaaagtccgaaggcgtgtctgaactcggccacatttgcgaacctgcgaccacacttatttgccactacatgcgtcacagacccgcctcttcgaatgttgcttcccttctgctcactggctttctcattaaggcccaggttttcacttgatccagagagaggtttcaagaacagcggacaggccacacccttccattcagaacggagagcctggcgtgggatttccaaaactccgagtaactttcccaacttcaatgtgtggatttgggtctatgtcgtactacctcaaaacgtctccagtctctggctgtttgtgacttcccaggagctcatgaaaatagatcagaaattgtagaacattagactgagccactaatttctcaatgtatactcaatggggtggtttacctcacgcttcaggaataataataacaaatcaataaccccatttcatcccaatgcgctggaagcaccccttgccacgccctctcttcaggacgtctccacgacgccacacgccacgccctctctccgggacgcagcagcctgccccttccatttggtaatgtccttgatatatgaagtctgctaaatgtgccccggcatcatccagcagcaaggcagaaaagaacgaagagaaaaaagaagagagaaaagctacctaaaacacgaggaggaagtactgaaggaagctgcctctaaagacggggtgccatggtcccagcaggcctgacccctccctgcagggctccagggctgggtatcttggagcaacgctatcagggggccttagcttcggccctggaggggagagggtgcttggagctgaggaaaagtcggtcccagcaggctgcagaccatgcctcctgagaccatgtgaagcccccatcttgcagaaagaatcctctccaagctccgggaactcaaggggggcttataagtaaagagagttgcttgtctgcagcctccggtgggcagccgggggctgcccctgtgagcctgctcatgtgccccccacccgaagcatttcgtttgccctcacaagtgggccggccacacgtaggctgagggcttctctggggcactggaagatacaatgttcacaaactttcacccaaattcagtggtgatgagagctgtagggaacgtcccaaagcccggtcagtgagtgaccttgcacttgcagcatccaggtgaaggcaggaagtcactggggtctccgatggagcacaggagcactctgcaggcctgggccagcgtgggtcgcatgggatggcagaggggacacatggacccaacaaaaaggcagtctccagtacagcctgtaaacttgaatctgcgggaaattctaagaataaaagttaagcactctaagctatgtatttcattccgtgcgggcccacgtgacaggttattcccaggcttttgatggagaggtgtgatgcaagcccttggaaatgagcctttacatcgtccgcacaaatacagtgagggaggtggagagggttctggagggaatactgtggggctccccaactctgtccagagaggggctgcctcagaactatccaggcaatgcttaaatgcatatttccaggcccagccctggaagaggtgagtgggccctgggaatcagaattttctggaagttccccagactttagcagacctctgtgacattgccatgctgcgttttcattctcagcatcctgaagggtgtggatgttgtcgtgggcacatgggaatgtcatcaccattaccttatagtcgaccgtgacctcctgggactgagctgggagagaaggacctctggagtctaccctacctcctggcctgccttcccctacagggactccccatgtgactcccttgagactaagaggaccctgttgtggacagccacatcttgggcttcagcctgaaattgccctaggctctctaaaaccctccaaagctacagtcttggagcacagtgcgctgtttgtgtatgtgtgggtttccaggaagaagacgaaaaagaaggatgcgatcgtggtggacccgtccagcaacctgtactaccgctggctgaccgccatcgccctgcctgtcttctataactggtatctgcttatttgcaggtaagcgacaggggtggaaggtgcagcggaaagggggaaaccagggcaccaggcccaggagccagagctccacctctccctcgggaggcctgaggcctggacccctcacggccaccacttagttattgtgcctcggtttctccttttaaaaatagaaggttccccaagaggaccatcagagtgctctgaagcatgggtggggaattgagcttcaggtggacagccagggtttcggcactgtggggccccctcaagtgagttgtacgaggaggatgcaggggcggttgcttctctttggagggataagtgggtggttctgaacatgcagcagggtagggaggcaggggcaagctgctactatttttttctttttttttttgagacagagtctcactctgtcacccaggctggagttcagtggcgcgatctcagctaactgcaacctccacctcccgggttaaagcgattctcctgcctcagccacccgagtagctgtgactacatatatgagccaccacgcctggcttttatatatatatatgtattttttttttagtagagacagtgtttcaccatattggctaggctggtcttgaactcctcacctcaaatgatctgcccaccttggcctcccaaagtgctgggattccaggtgtgagccactgctcccggcctctactactcttctaataagcagaagagggattgagggcctctcctaggaaacctgtttgtgaatgcagggacgagatactgctcctcttaggggaagccaggggcctgggcttttctgagcaggcctccagggtggggccaccagagggaacgttcctgagcacgctgtccaccaaggatgcaggacaagctgctgcttgtgggggctggcggggactttggggcatttctgaggaagcctgcaggctgcaagctgcaggacaaggaggagggatgacctgctgctctctctaggtaagcatggggtttgggggcccttcccagcaggcctgctccaggacaccaatgcagggtacactgttggtcttctgagggtacacgggagggcttaggggacttcccaagcaagtgtgcaggacaggtgtgcaaaggcaggtctcttctgagatgtgtgggactgggatgcatgcgagaggagacgatgcctctggggctctccggagccagtatgcaaaatgaggatgcagaggcaagtcctgcctgtccttctgagagtaggcagtaggctttggggcactcctgagcaagcctgcaagacagagagccactgctctgagaggctagttgatgagttttggggcattccagattatgccgcacgtcagggatgccatccacatggaagcagaggctttcgattattcgagcataggctgatctcctgctcttcggagggattgcggggcaggtgaaaactggaagaacttggagcctgtcccagcgagcagacaggatggggtgcttgggcaagctgctgctctctggtgcacgcgggctctggggaggcagggctgggcactgttctccttcaggtgggcaggaggctttggggcgctgagcaagcagcaggtgggcggcaggggcaggctgctgtgcccgtgaggataggaggagagctgggggtgctgcctgtgtgggaaacagcagaaagatggagaaggtagaaaatatttactgtctgttccattgttaatctctcggaaattctcctatttttgttgaactttgaccccagaaagggcaggtctttagcccctttacctgactctgccagtgtggcctggaaaacggtacctcctgggatcttgtagctctctgctgagaggcaatggggccgctctttggggtcaatcccagctcttctcaggagttctgtgactgtgggacagaaaagcttctcagagacatctcatcagaagcgggggtgattacactgaggtagtgacaccgcaggcagggccattcccatattacatgatccagcgtcttccacacagagcccgtgcccacaggtgggtggtccacgctccagaaacacacgcacagccatccatctcccacatggcttctttagggcctgtttcgatgagctgcagtccgagtacctgatgctgtggctggtcctggactactcggcagatgtcctgtatgtcttggatgtgcttgtacgagctcggacaggtgagtgtgccccaggcctggggaggggaccatggcccccacgggagtgttccgggagacccagcatggtggatgggacattacctacccttgaccatgagaggccaggcaggtctggggacctccgacagtgagggtaggtggtgcggcctcaagcccttctacacggaacccttggacaggacgctgagcaggggccaggacacctaagctctgggctctgctcttccaacaagctgtatgaccttgagcaagtcaggctgtctctctgggccttgttcttgtcacctctgagataagcaggccaggccaggtgcagtggctcacatctgtaatcctaggactttgggaggccaaggtggacagattactggaggtcaggagttcgagaccagcctggccaacatggtgaaaccccatctctactaaaaatacaaaaattagctgggcccactggcatgtgcctgtaatcccagctacttgagaggctgaggcaggagaatcgcttgaaccccgggaggtggaggttgcagtgagtggagatcatgccacttcactccaacctgggtgacatagcaacattctgtctcaaaaaaagaaaaaaaaaagaaaagaaaagaaaagaaaaaaaaagaaaagaagtaagcaggccggactgcaatctcgaaggacccctccagctctcactactcgacactggggtaagcaggaaggagagctcagtcaatcttggagtttctcttcttggacagtcagcagatacaggacatgttactccgtggctttcagaggacttttaacatgtggagaatgaaaatctgaaatagggcccaggtgaatgaggacttccttcgaatcatctgtggttggggatgggaaaggatactcaccccttcacatttcttaggtgctgaactgtgtgcccttgggacatctttttctaatctgcacaaagacattgcctaagctggtagaggccctgtttccaagatttttgaactgaaaactgtgccaggccaggcatgggtgcaggcacctgtaatcccagcactttgggaggccaagacagaagggtcatttgaggcaggagttccagactagccagggcaacatagcaagaccttgtctctacaaaaagaaaaaattagctggacgtgttggtgtgtgcctcaggaggctgaggtgagaggattgcttgagcccaggaggtcaagactgtagggagtcatggcctcggtttacagagcaagaccttgtctcaaaaaaaaaaaatgataaaataatgctatgccatagctgttgatgtaaacaccagcagatcacagtagccgacctccgtgtggctccacgtacaatacatttcaagtgcgtcttgcttcttcattagaaccactgcatgagacaagaagctcaggtgtgattacctccatcttgctgatttagaaaccaacatcagagacaccaagtgacttgtccaaagtccacagtcactgcccagccacaccagactggtcctctgtttgcttccacactggtgcctagcgtcataacttagaagacctcagatacacaggctgaggcttgcgtgggtggcctagccagccctggtcacctgccccgctgctgcagtcatgttaaactccacagacacacgagctctgtaagtggcccattgggctgatggtccctggtctcagcccagcttcagtgggatgagacaccccgactcagtcattaaccctgcaccttcttgtgcttgggtagtaccctaagcaaccaagattcagcaggaagctgggagagagggaggcacaggaatcacactccaaggaaaacatcattagaattgagagaagacatcttaaagaagtggggaggaggctggaggcacaggaggctacataatgatcaaggccctcagtaacgcatgtataacaaataatgctaagaagaactgggggctgtgaagtggggtgttctttgttgtgacagcacactagattttcagtttgagcagagtgagacgtcctaccccagtctagcctcggtggcctggacccgcagccctagcatcacctggaacttgctagacttgcccccaacttccgggagccaactctgggttgcaggctggcactctgtgtttcgcacagccctcagggaaattctgatgctcaccgcaattttaaaaggactaattatattattctctctactttcgtgcatgtttgaaaatgtaaaaaacaaaaaagaatgcaggtcatggcctccttaattgatttcacccatcataatgcccctggctctaggtgtccagcccatctccagaccagtcagattctttgggggtgggtcccgaacttcatatattttaaaagccctttgggtaacagtcacgtgcaaccaaggaaagctgtgttcctggaaggtgttttcaaaaggcaggttgtgccccattgctgactggtgaaatcaatttgggaggccatggcctgtgttttttacatttttattattaatattttcaaatgtatgcaaaagcagagagaatagtgttatgaatccccatgtaccctcacccagctccagctgttatcagcattctgcccatcttgtttcatctgttccttttcttgtttcatccgcccttttcttgtttgattttcctgtttttgtttttgctcttttgtttcatccacccttttcttggctggcataagcaaaccccaggcagtaagcactttagcattttgaatagaaaatagaatgtctcaggaagtcaaactcactctgccaaagggaagagttaggcttgggaactgagtcatgcaaaagctgccttccttttctgcccagatagctgtaatttcacatgcttactttatcttacgtaaaatgtagtttgcataatttacttttcctccactcccttcttttcacatgtagattcactgagcgctaatcaaagcctagcaagaatataaccactggcctcattgcctacccaccctttcttttctttcttctctcctctcctgcctgctgcctgctctgtcccctttaagtattgacatcctcaaaaccctctttggaaaaagcacaggccacagatcttactgtgacttgtgtttctttctcctaggtgtaccttcaaccttgataaaaataaacctctaaatcaattgagatctgcctccgtcactttttttttttcaaagactcagagtctcactctgttgcccaggctggagtgtagtggtgcgatcttggctcattgcaccctccacctcctgggttcaagtggttctcgtgcctcagcttcctgagtagctgggattacaggggtgcaccaccacatctggctaatttttgtatttttagtagagacagggtttcaccatgttgcccaggctggtctcaaacccttgacctcaggtgatccacccgcctcggcctctcaaagtactgggattataggcatgagccacggcacccggccctctgtcactttttgatttacaacatgtatctctaattttaaaggatccttttttaaaatatgtatataatttccatttatcttttaaaatttaataatcattctttgttatcatgtaatacccaatttatatttaaatttactcaatcaacctatgttttaaaaaaattcaatagaatagattagaacctcatagaatagaaaatatcagagtgcatttcctgtagtaatggtaagtgttgtttttgaaatcatttctattatatatgtatcactgcatactgtgtagccgtgaggtaaaatatgtttctttgtactatggtcaaaaaaagtcagcctctgtgatgcccaatgacctccatcttcttctttaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggatttaaaaataggaatgactcttgcttcagctcttgccataaaggaagtttcagtcccagagtatgtttctagggcaatggcttccctagaaaggataggtgctgatgtgggggacggcacacattccaagaaagtgacaaagccaagtgctgttaagggcacaaaccaacaagaactctcattcattgctggtgggcatgcaatattgcaatatgcaatatggaagacaatttggtagtttttataaagttaggcatatgctttagcatatgacccagcaatcacaccctaggtatttacctaaaagaatttgaaacttatatgcacataaaaacatgtatataaatgttggtagcagctttattcattattaacaaaaatctggaagcagtaataatatcattcaataagtgaatggatagataaacagtcaggcgaggtggcgtgtgcctataatcccagctactaaggaggctgagaagggaaaatcatttgagtccaacagtttgaggacagcctaggcaacatagcaagaccctgtctctaaaaaaaaaaaaaaaaacgaaagaaataaagaaaaaagtaaaacagtggtatatttatacaatcacctataatcaaatactactcaggaatgaaaatgaatgagcaattgatcaagggaaaaagattccatttgtatgacattctggaaaaggcaaacaataatggtggaaaacagctcagcggttgccaggggttgtcaggaggtgtagaggctgattgcaaaggagatcacgggggaatttttagtgtgatggaactgttttgcatggtgttggggtggtgggtatatgactgtgcattgttcactctcacagaactgtataccacaaagaataaactgtaatgtatgaaattttaaaatatcaacccgaatgtgggcaatataaggatggaaagcagattgtgacaaatgaatctagctatattagaaatatatgacataactttactgaaggacatagggtaaaacaatgacctaagtaatgttaaaaatggtgctttgagtagaaactaaggctaaagatgaaaagatgtgacatgaatactgtactctagttgtaaatttgtttcacacggggatatgcgttactaattcagaattacattatactatggatgaatgcatgaatgagggaataaataaataaatgttttaaaaaatggaagccagatttatcatagtcagaaaaagaagttacaaataagaccacacaagatcagaatgaaccctgtggtactggattgaaatcagacattagaatgaactcacgtttatttatatatccaggtagacagatgcagaaatgattgtaggtgtgtgtgtgtgtgtgtgtgtgtgtgtgtatgtatatatatgttggtatacatagatatatttctaactctgtgtaccaagaaggcttggcagtgatacctattacaaagagcacaccaagcacccagatcttggtttccaaatatctttctccaataaaaggaaccagggctgattctagggctgagacggggaaaatataccatgagcatggagtgtcttgtagtgccggaaagtactcaaaaagcacaatgttggggggcaagtggcgatagggctttctacatacacacacacacacacacacacacacacacacacacacacacaatgatggaagtaaattagagggacatagcaaccaacctgaaagagctcccaatggccaaaactgaagccatttgaaaaacaaaatttttaaatttagtattagactatatcccaaagtataaaagtccatgagtctatgccataaatgaatgattgaataaataaattaatgagggagaaaggacacatattttttacagaaggattccagatcatatatgtagattatttgatactttccaccccaggatgtaaagccttattgatggatcttgcactcagaactggagccaaggatccagcagcctctacactgccatg

SEQ ID NO: 16087 - DNA, 14124 bp, Human
ttccacacaaatcacttttaatactggcaaaacactttttaccatgtgggttttatatatatatatgtttaatggacttattttactttatatatgttgactgataattttttgagtacctactatggatttagcataatactagacactacagggttaaaaaatgggacataatccttctcctgaggaaatttcaatatgcttgttcagacaaaacaaacagaaatgaatgaagcactaaactgtgagagataaaaatttggaagaccagttattgaagagttaataaaatgtgtctgaatagtttttacaaaataatttttaaagtcactgaatgacttagttttgaaataagccactgttaacattttaaaaatattttgttgcaattactttccaaaattacctcgttaatcacaaatagcttatccttacgatccattttagtatctagaaaaagaaaaaaaagaaaaagcaagtaaattaaaggtgatttcaaagttatttcaatcaaaccacatatgctatccagaaaataaagtgtttttacactcttcagtttaaaggagattttattactaattttcaaaacaagagctggaaacaatcgctcaaaaatcttgactctttgtaaatgtaaagaaaataagtaaaatatagtctgtaagaattagaaattatagtgtaagcagtgtttctcaatatttaggtattctaggaatccttttcaaaaatgggaaaattctcacaaaccaaagactgtgttaaaggaaaccagtttcaatgaaaatatctttcactttttaatcttaggtgtcaaagaaaactgactttatgcccgtgtaacaaacctgcacatatactccttgaatctaaaataagttaaaattttaaaaataaaaaacaaaaaacaaaaaaaccccaaagcacctctcaacataagcacaacaacagccatatgatggcgctgccactccactgttccaaacttttttttttttttttttttttttttgagacagggtcttgctccttgcccaggctgaaatgtagtggcgcaatcacggctcatgacagccttgaactcctgggctcaagccatcctcctgcttgagactcctgagtagctgggactgcaggcaagtgaccccctcacttggctaatttactttacttttttcatttttttttttttttattttgtagagacagggtttcaccatgttgcccaggatggtctggaactcctggactcaagtgttccacccacctcggcctcccaaagtgctgggattacaggcatgagctaccatgcccggccatactgttcttgcctgtaaaataacccactgcttaaaaataaataaataacctggcatttagaaataggctctgactccaacttaaaaagtgctttgaattctatcccaggtccatttttcaataaaaacagttaaaaaaaaaaaaaaaaaggcccaaaaagcaacatgtggcagtccttagcacttaggacaaaccatcccacctatctcaggaccttcagaagcattacagtgaaggcattcctggaccttcaagaaatgtttcaataatattaggacacctgttttaaaaagtaaagaatctacctaatgaaatctaaagaatttcttacgaaatgttaactggaaaaattgtggcacttgaaaggataaaaggcattgtgtttttttcgtgagaacactgaacaaatgaagaatatataaaataagtgaaaacataaaaataggtaagtttatagatagaaatttctaaagtatatgatataaaggcacctgctttagaatgaggcatcaacattctcaagtcctgcattaaatgtcttgttctaaaatttattcctctggaagaaaagatgagaatccgttccttatttttccactttccctaaagaaaaagaaaatgttaaaagattttaaaatcttatactgaactgatcttgttttgtgacagggtctcacactgttgcccaggctgaagtgctcacggctcactgcagtttcaagttcctgggctcaagtaagtgatcctcccaccccagcatctacagtagctggagactacaggcatgtgccaccatgtccagctagttttttttttttttttttttgtagagatgggagtctccctatgttgcccaggctggtctccaacacctgggctcaagtggcttggcctcccaaagcgctgggattataggtaagaaccaccgcacctggccctgtttgttttttatgagcttccaagtagctcataaccaagtcaaaccatcctgactcctttaatttcatctctcaccaacattcactgaccacatctgccacccagaaatgccctccttggtttctttgtttttcaacttcaatctctccaattcctccttccaaccctaaaagttctttcttagccctcttatttctgtgctctccatgacagatgtctcataataatttcccacaactcttaatcctttcttattcacactgcacttacttagagtcttatattaactgcaaaactcctaaatggctaaccttcccagacatgagcacctccaatagatatggttgactagctttttcaacagtttactttttttgtttgtttgtttgagatggagtctcactctgtcacccaggctggagtgcagtggcgcgatctcggctcactgcaacctccacctcccgggttcaagcgattctcctgcctcagactcccgagtagctgggattacaggtgcccgccactgcacctggctgatttttttttttttgtagtgttagtagagacggggtttcaccatcttggccaggctggtcttgaactcctgacctagtgatccacccgcctcggcctcccaaagtgctgggattacaggcgtgagccaccacgctggaccatttttaaagtaatacttccatcacatccttacttcccagagttttctaaacaaagttcaaatgacatagctttgacactgaattttaaaatagattttcacgtctacatcattattgccccaaatgaagcctaatgcaatccaatctggctctattttttacatttttcagcatttccctacttcaaagtctttcatcggtttttttttctcccttggagtgttccctctcattttttgaatgtcaaaattctacacttcctctgatatgcagcttacgggctaaatccttcatgattctttatcttattatactagggtaaaaataatctatatctcctgcatttccatagaatgtatcgaagtatggctcagattatagatactacctagctcaagggaagagtgagaacactaacatttactggaagtgtacaagtccagcttatttttcataaaaagtaaatattccctccccctgccccccaatctgcaggtcagaaaagagcacagaatgttgctgttaataacggggctagaatttacacttatctttcattccacagagctcacttctttcttagagcttgccatcacaccacacggggtcatttacttatcacctactccgcgctagagtactatgctaagtgcggaggacgcaaaaattaatgtcaaagataatccttgttcacagtattctgtctagcttaagaagagttcttagttgaatgaaagctaattctaacaacttgtgtgcacttcttttgaataaaaaccatcaacttatttgaattcttaagtttcctcctaaactccaacatttcaggaggaagaggtcacattctagtcatctttgcaatctcaaacccaaaggaagcctaacttggtacagtgcatggcacattcaatgtctgttgaatacaagtaaagctcatactacctagtctatttttcagtatctcttgagttaatgacctggttaacaagtcagagtcacagtcccaagggcaacaactttttaaaggctcccctaacgtacttcaggatccctgactgagagtggctgactatggcagtatatgggcatactaatcactggagaaataatagcgagaaataaccaaggaaaagcactactctccaaaaacattaaaaaaaaaaaacaactgaacaactagtaagaaagaacgctggatctgagcaccctgtaagtcgcttccccgtgggccgggtaaaggttttaaaacccgccgcctccaggaagacggccacgtgcacaaggattagctgcaaactccgtgcccagtctggccgggagaattgctaaaaccgacctaccgttaacacccgggctactctgaaattaagcaaggctgtagtcaagtaagtaacccaagaaaaggcgcacagagccgccgccgcaggtgtagcccggggacatcccctcctaccttgcaaacggggcctgggatccggtccctctcttcttcctccacctcctctgctgtggcgtgccgcttagctggcggctccgcatctatttcgtttctttttggcttcttcgcctgaactgcaaagcctccacgccgtttcctcttggttgccgccatcttgcctcgccgcccgcgctcttggcctcctttccggcgctgccgctcgctcctatttccgatctctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtagggtttccgcactcggggaccccgagactagtaagcgatgctgtcccgcgggcgggctggtgaatggggttgtctgggactcttggaggattatctggacactccgggcccgccccgccatcgcctgttttgttggaggcggggctggtggcgcgggctgcacaaaaccgactccccgcggatttgtagctcctgtttggccgggagataccgtgtcagttgcgtgtcttcattcttcacaacttttcacgttattgtcctcttacggagacgaggaaaccgtagcttagataattttcctccagaattacaaagatagttaagtgacataggtggggttcggcctggtcagccgtgttcagcctcccagcccctttccacctctcagcgcaggtggagctcgccggacctcgccagcactgatgggagttttactgtctaatcccttcaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggtatggaagtaggcgcctttaagcctgtgccatagatactctaaatgtaatttaatgaaatcggaaggtttcagtagacaaaataacttaatagtcataataacttgtcaatagtcataataaataacttaataaataaataatagtcttaagttagagaacaaaacgtcattacttgaattttttttctctcccggtaacaaattcttttcccatcttgttttacagagataatggttagtaatgactaaagtttattaaactaggctattggctaggctacagtcttcttattgtttaacttatttaatcttaacaatagtcctgtaaggtaggttctgttattattcccgttttatatatgtggaaacgaggcacaattttaagtgatttgccaacagtcccacagctggtaagtggctgaattgggataagaacgctgaatatttgtttccagaatatatgctcttttttccactgcgatatgctattactaaagagtatttttttcctttactggttgtaatagaatttttgttcttccaaagtaatatttgtgtggttcagataggattgcaagttcaactaagcgttttttaacacgtaagtgcacagcatgatctcagggatagagaggtaaataagacacggttcttgtcctcatgcaggggcatggtatggtggctcacacctgtatttccagctgctcaggagaccgaggctgaagcacgaagatcgcttgagctcaggcattaaagaccagcctgggtaatcatagtgagacccccgtatcaataaaaaatcataataaaagttgaaactaatgttgctcatgcattatcaagtcattcgtctattttccaagtgaccttagcagtagtgataggcacaaaaacgagacaagggagagtcacagagggatagttttagatccaggaatggagataaggatgcttcaaaggatgtctctaagatgttttgattgctaatcagaaattattctcatgggattagcacagtattgtattttttaaacgtataaagtgaaatctaggaccttatattattagtttttattcttttatgtaacaattttcatttttactcttttcataggctggaatatttcaggagtttaaagttcaggaagagtctgttacttttcgaattaatttaactgtccttttagactgtttatctatttttggatcaagtcctatgccaggtaaactatgatcagtataaagacataaaagtgttatacatagtggtcagaaaaatacaggaagttatttggaacataaacattggttcagaaagctaatgccaattcatttttcagtggccacagtcatgggttctaacatttcacaatgttaattgcaagtgtgtttataattcttttcatatttgtaaaagtatttgcattttttttttaatttacaaggctttgagggattgtaaattcgaactggccaaaagaatactttggacatgtcttaaatatttttagcattgtgaaatgttttaattgcttctttttcctaacttgtccagaattactccgctagttagtggcagagaaaaacaaaagccagttctgactcctagtttactatgttcaaaatttgtttcttttaagccatattttataagttatgtctattttgccaaatgattttgtggtgtttttgagacagagtttctctcttgttgcccaagctgcagtacaatggcacagtctcagctcactgcaacctctgcctcccgggttcaagtgattcttctgcctcagcctcccgagtagctgggattacaggcacgtgccaccacgcccggctaattttttgtatttttagtagagatggggtttcaccatattagccaggctggtctcaaactcctgacctcaggtgatctgcccgcctcagtctctctaagttctgggattacaggcataagccaccgcaaccggttgccgaatgattttctttaaaatatatatttttttatttgttaagggaatttttaagaatggtgaaattgaattgctgtgggtataaaactaaggaatccccagaagaatgattttatttcataggaaagcaacctggagattagctaggaaaaattcaatatagttctccagaaaaatgtattttacgtttccacagacaattccactattattaattatacattttctaatacagtgttctccagctagtttttcacagaagcatctgtcatcttccattcctcactgtggctctcaatccagtaaggagaaggagtttgaatatcctgtcatattcctccttccctctagtggtttgcagagttaaaatttacaccaccattaacaaccctctttttctctcaatttgatttttaaattcgaggaaatataaagaatatctcccagttggaaaagttggaaggatccttgtcatagtgagtacactgacgttacagtacagatgacagcaatccactgttacacacattgaaccttcaaggaatagcataccctgttctgcagcaatttagttacttgctgtgttgatccatatagattctctaccctgaaattgtacatatataaaatcaacaagctatttctgaggtgtgtatgacaacctgaaaatgattccaaagaattatgttacattttgttctggttcccaattttcttgtagttttggaattctctacacacaactgtcatcagggaagatgtcatccctttttatgaggagatacatatatgtgagaaattgggcggaataaattattcttgagaaattttatgtatcatttcgaggagaagctgaacccagaactataaagctaaggccaagtatgacttctttccattgcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggtacttgagagcagtgcagttatagttaatgtggtctgtactccatcttcccacttagacatttgcttaggatgcaaaatttttattatccacatttttagagttttcacaactttagacagcttgtactcttacctcataattttatggatcaagaaacttaagacccaggaagattaactcactatttcatatttaggtggtggtggcatctagatgagaagcccagtcctctaatttataaactggtggtgttttcattgtactactccttactttcatagatcaggttacatcatgaggaaaattgggtttaagtgtttggaaagggtgtttgtattatggtatctttttcaagttagttcaggatgcagaagaagatgttttctacacgtggctcattcattcactaagtatctgttgatcacctaccgtgtgcttattcatcttattaagcattgtgggaagaacagcttaaaaccaaggtgaagccaagaaaatgtgaaacagcaaaccattaagtaccaagatagcacacacagatacctgggaaatgctgtataaggatttagggaggattgctcaaggctggcttcccaagggagggcagttttcagcaggagtacaatgtcaaaaaagctgttcttgatagtttaacacaagtctcttttcaggattagactcagagattctagcaatttagagagaggatctaaatattctctttttgaaatatttcagaatattaaagcccctaaatacatatggaataaaaggaataaggtattctttttgtaactactttagaagaattacaggcccggctgtaaaagtgctgtggcagacacctgtaatcccagcactttgggaggccgaagtgggcagatcacttgaggtcaggagttcaagaccagcctggccaatgtggtgaaaccctgtctctactaaaaatagaaaaattagttgggcgtggtggcacgtgcctataatcccagctacttgggaggctgaggtgggagaatcacttgaacccaggaagtggaggttgcggtgagctgagattgcgccactgcactccagcctgggtgacagagtgagaatctgtctcaaaaaaaaaaaaagaaaagaaaaagaatcacaggcccttgtcatgactttggggagttaaaaatttggctcaaggtctgagaaagttaaccaaaatggaaattggaaaccttactttagcagtggaatgaagtaaaaaattcaggtacttaaaacagtatttcaggggatctcctcagtgatctctctcagcctgggtaacgagatggaccatggtatctttcatctccaggatgggaaacaatttggtggtagggaggtaggagttgaaattttttcctggatatgttaaattttaagtacctgcgacactagggagtggctggatatgtagttatggtgctcaggagatccatttagactggaaatttagatttgggaaccatcatcatggctgggtatggatgagacgggtcagagagagagattatattagaagaaagaaaagatggaccccaggaaaaccacacctggaagatgggaggcagaaatggagcttagggaaaaccaacctggatcttatcgccatgctcatataatacttagcaacgtgctaatcctgcagcaaatgttccaggagttcttgcaaattaaatcagcatgttaacacttataaattgtctacaaataacttctggtattaccaagtgaggaaaaccatgcaatagccttaagagcagtctaagatacagaaaagctgtaattcctaggtgtaggattgggaacagacctaagggttgcagtagacttagatcaaggtcttccatgagtcctcaattctctcgcctgttatatatttctgacttaaggatgaggaaaagtcattttcagagtaggattagggtaatgaaattaaagtgtcccctacccttttccttttacaattgattttcttcaaacccattgattagttgtcctgaactccagtgggagctttattatggtacttgttatcgtgtgttataagcatttgtgtacatgtctgtttcacccactagtatgaatttcttaaggaagtgttttctttatttggatcctaatgtggtttatttttggatgaatgaataaatgaggtaatcattttctataggttatctacttttggaaatgcaggaagttcccaccttgactatcccaaagattctgatttgatggaagcatttcattgtaatcagacccaagtcaacaggtcagttcttaatatagaggttgtcattggtgataaagaggaggttaaataccagatttctgttaaataaaaacactttcaatctgttaattaaaatgcacagcattttataaaaatgaatagtagagtgctggacttactaggggatgtagggttctaacagtgaatgaattttaaaacagaaaatattagcaaattggataagtacttgattttattcttagatttgctactttttatcctttacttgggagttctgagcagtgttcactgtgttgatataacagcgttttattttttcttctacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagtacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttggagacaagatcttgctctgttgcccaggctggagtacagttgtaggattacagttcactccagcctcaatctcctaggctcaagcaatcctcccatctcagcttcccaaatagctacgactacaggtgcatgcctccatgccctgctaatttttgtattttttgtagagatggggttttactatgttccctaggctaatcttgaactcctgagctcaagcaatccacccgcctcggcctcccaaagggctgggattacaggcgtgagctatcatgcctggcctaatgtattttttaaaagttgaatctaaaaagaatttaaaacaaatataaatcagctcagtaaggatggatatttttgtacatttaaaactattattttaggccgggagtggtggctcacacctgtaatcccagcattttgggaagccgaggcagggggatcatctgaggtcaggaagttcgagatcagcc

SEQ ID NO: 16088 - DNA, 14497 bp, Human
atttcacaaaaggaggaaactaagagcacaaaggggctaagaaagttacatgaccaaagctacaaagtggcagcttcaggaaacagcaggttacttctggcctaaaggacctactcaactccttatgggaatagaaaacacagaccatttgttggctgttgagaggagtctttttagcacaaagatgttttataaactttggtaaattgattttatacatctacttattctaaatgctaataaggggaaatgacactgaagtaggagaaaagaccttataaaggtctcatggtagaaagagagcctcccagtgagggattttgtatgttatatattgatggagacattactttatagagtaggccaggagtcctgaactttcaccgttcataattgtcccaggagttttttcacagagctcctgggccaaaacagttctgtttattttagttattaagtagttagagccaagtaacttaataagtatttatgtcctaataactttgccacttgaagattaacagtgcccatggccaggtgcggtggctcacgcctgtaatcctagcactttgggaggctgaggcgggtggatcacgaggtcaggagttcaagaccagcctggccaacttggtaaaaccccatctctactaaaaatacaaaaaaattagccaggcctggtggcgggcacctgtaatcccagctacttgggaggctgaggcagagaattgcttgaacctggcaggcagagattgcagtgagccgagatcacgccactgcactccagcctgggtgacaaagcgagactccatctcaaaaaaaaaaaaaagaaaagaaaaaagaaaaaaaaataaaattacagtgcccaggggggaaaaaacacttttattcattctcacataaccatagttactagtggaatttgtttgcctgttggacactgacagcctttcaaaccttggaatcagcactgtcactttttcatgtcttgttttatattgattttcatactatactttcttttactttttatcacagcagccaccaaaacccagtttcacaaagacacgatattctcgaaaggaatgtagtgtgacttaatgttgaaagtgaattatcttgagctattaaaaatattccaatgcaggccaggctcagtgactcatgcctgtaatcccagcactttgggaggcctaggcaggcggatcacctgaggtcaggagttcaagactagcctggccaatatggcgaaactccatctctactaaaaataaaaaaattagctgggtgtggtggtgcatgcctgtaatcccagctactcgggaggctgaggcagggattatcacttgaacctgggaggtggaggttgtggtgagccaagatcatgcccttgcacttcagcctgggtgacagagtgagattctgtctcaaaaaaaaaaaaatcccaatgcatccctatgagtttgctggcttgctgtggtgccccaggatgcctcaacatacatttagtatttcaggcccaacttgactattcgctctgacatcctagtttagtttctttaatctgcacctcagtttcctccacctcaatactttaatactggatggacatggtggctcacacctataatcccagcactttgagaggctgaggtgggcagattgcctaagtccaggagttcaagaccagcctgggcaacatggtaaaaccccgtctctacaaaaaatacaaatattagccaggtgtggtggcacgcctatagtcccagctactcaggaggctgaggtgggaggatcacttgagtctgggaggcagaggtggcagtgagccaagatcgcaccactgcactgcagcctgggcgacagagcaagaccctgcctcaaaaaaaaaaaaacttcagtattaatgaaggcaaacataatgtgctctgtggctatggaaatgcagttgatgctacttcatttttatgacattggtgttacatttggagatactgtttttcagattggctcgacatcgaaaaatagtggaacctgaagtggtaggagagagtgactcagaagtagaaggagatgcttggcgcatggaacgagaagacagcagtgaagaagaggaggaggaaattgatgatgaggtatgataaaggaacatgggaagtttttttctggatataagaaaaagttcatgccagtgctcatttgttgaagccttaaaaacatgagatcactgctttggcaggactctgatcatgttccttgtttgtggggataggattaaaaatagaatgatactaagttgtatctttttacatttgaatttgttgtgtttgatgagacgaacaaaaagccataggccatttgactgactggcttatatatatgacttgataggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagtaagtatctcacaagccagatctgaatccacttaattaccactttccaggcctggagacaaaagtctgttttctgtcttgctattctgaaatctaaacgctgagtgaaagtgcttttgctagtgctctacccttggcagactagctgctgaggaatatcttggcgttagcagagaacctgagtttgttttcacatctcttttttcagtaatagagcatatatctgtccaaggcctttttttgtttgtttgagacagagtttcgctcttgttgcccaggctggagtgcaatggcatgatctcggctcaccacaacctccacctcctggtttcaagcagttctgcctctgtctcccgagtagctgggattacaggcatgcgccaccacgcctggctaattttgtatttttagtagagagggggtttttccatgttggtcaggctggtctcgaactcccaacctcaggtgatccgtcctcctcagcctcccaaagtgctaggattacaggcatgagccacggcaccaagccaaggccatatatttttaagcacaaaattaaactcaacgagcaaattcctattcctttcctgatggctagaaatcctactgcttagaggccagcaggttctttgctgtccaggcagttctcaaagatgaacatgattttagtcctctaaagacctgggatgatggctgggcacggtggctcacgactgtaatcccagcactttgggaggctgaggtaggtggatcaggaggtcaggagttcaagaccagcctagccaagatggtgaaaccccatctctactaaaaatacaaagaaattaatcaggtgtggtggcagactcttgtaatcccagctactcaggaggctgaggcagagaattgcttgaacccaggaggcggaggttgcagtgagccaagatcacaccactgcactgcagcctaggcgacaagtgagactccgtctcaaaaaaaaaaaaaaaaaaaagacctgggatgactcagcgttttttgctctttgaaaataatagagccaaagattgtttggtttttgtctgatttggatgggactaggtctaggggaacaaagcactccactctaaggactttgggcaattaacaggatctctgtgatgcaggaaggaccgagtgacagttcaagaacgtgaagccgaagcattgaaacagaaggagctggagcaggaagcaaaacgcatggctgaggaaaggcgcaagtacacactcaaggtactggggagtggttgcaaggaatgagtacaagaaatagtgtaatcaggtttgtctgaggagagtaaggaagtccaagctgaattgttctccctatccagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgtgagtaaaaagatgagcctagagttaatgctgctaatggaacaggtttctagcaggatagctctgagactcattacctactgtgagttccattctagccaccttcagagttcttgttgctttgtgagtttcctataattggaatatgagtttcacttgctacagtgaaatcagggaagagaaaaacactttgtcgatgtgtgtccataatagagtgccagccagtgctccctttagtttcctagtagacacaaaaattagtaactgttagtagttatctcttcttgtgtacaacccaacccacaattgagtgacttgaaactataatttattacttttcacaactttggaggttggctgaacagttcctctactgatttcacctgggcttacttatgtagttgcatccagctggaaggttgactgggctggaaacttaaaagggcttcactcacatgttagtagtaggtggtggctatcagttaggatacctcacttatccttcactggattagactggcttccttacatagcagtctcagggcaccattctaagagggcaaggtcttctgacatgtcggttccagaactcatacatcgatcttgccacatactggtcaaagcaagtcacaaggccaacctagctttaagcaggtggagaaacagactccacctctgcagaggaggagcagcaaagtcatactttttgaaaaggggcatacatactgtgaggggaagaatttgtggcacttaaataatctacactgtgttagagcagaatcttttttttttttttttgacatgaagtttcacttttcacccaggctgcagtgaagtgtcacaatctcagctcactgcagcctccgcctgccaggttcaagtgattttcctgcctcagcctcccaagtagctgggattacaggcatgcgccaccatgcctggctaattttcgtatttttagtacagacagggtttcaccatgttggtcaggctggtctcgaactcatgatctcaggttgtccacccaactcggcctcccaaagtgctgggattatggcatgagccatcatgcccggccccagcagaatcatttctgagctgcatcactcattcctgtaaattactaggtatgagagggtaatcccagattacaaaggaaaccatcaatagataactctaggctgggcgtgatggctcacacccataatcccagcactttgggtggctgaggcaggcgaatcacttcaggctgagagttcaagaccagcttggccaacatggtgaaaacctatctctactaaaatacaaaaattagctgggtgtggtggtgtgtgcctgttattcccagctactcgggaggcggaggcaagagaatcgcttgaacccggcaggcagaggttgcggtgagctgagatcgtgccactgcactccagcctaggtgacagagtgagactctatctggaaaaaaaaaaaaaagaaaaaaagaaaacttgcctgagtatgagctacacacagtagataactccatactcagcctgtaattttttgtttttggttttttttttttttttgagacacagtctcactctgtcgcccaggctggagtgcagtggcgcaatcttggctcactacaacctccaccccctgggagtcaagcggttctcctgcctcagcctcctgcgtagctgggactacaggtatatgccaccacgcccagctaatttttgtatttttagtagaggtgggttttcaccatgtcggccaggctggccttgaactcctgacttcaggtgatccacccacctcggcctcccaaagtgctgggattacaggcatgagccaccacgcctggccctcagcctgtagtttctaagatttttatcctggacctgtaggagtaggagtctaagtgccctttaaaattgtacacaaggccgggcgtggtgctcacgcctgtaatcccaacaatttgggaggccgaggtgggcggctcacaaggtcaggagtttgacacccgcctgtccaacatggtgaaaccctgtctgtactaaaaatacaaaaattagtcgggcatggtggcacacacctgtaatcccagctactcaggaggctgaagcaggagaatagcttgaacctgggaggcagaggttgcagtgagccaagatcatgccactgcactccagcctgggcaacagagcaagattccatctcaaaaaaatataaaattgtacacaaaattgtgtgtatgtatgcattttatttggagacaagggatatcactccctctccccaacactggctaaaaagttactgcaatctggctgggcgcagtggctcacgcctataatcccaacactttggaaggccaaggcgggcggatcacgaggtcaggagattgagaccatcctggctaacacggtgaaaccccgtctctactaaaaattcaaaaagattagctgggcatggtggcgggcacctgtagtcccagctaatcgggaggctgaggcaggagaatggcatgaacccaggaggcggagcttgcagtgagccaagatcacaccactgcactccagcctgggcgacagagcaagactccatctcaccaaaaagaaaaaaaaaaaaaaaagttactgcaatctaattaatgatggtaatctttggtttatgacatgcaagcacctatatgattatgatacacttacataaaggaataccagcaaagcctcagacacttattttaaattcactgatttttttttttttttaaagctaagaagaccttttagggaaagagaatttgtaatgttggaaaacccagcagtaatagtatgtctgaacgtcagaagggctagaatcaacttttgaaagttggcaatacctagtctagcaaacataatgaagactaactcacccatttgtttattgagctccttatcttgattcctaataggcaatgactagaattaaagaaggtgactaatacttgaaatgacatgggactgttattttcagataatttggtctttctgaagctgtaacagtaccaataaattgttttgctccctggacaggcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggtaagaagtgaaaagagagtcagaaaattgggcagtaggaataactcagaaactttgaattatttttctcttcaagaatattctggaatgtaatttccacttgccagtggtcagctttctcatttgctttttccttctgaacaatataaactcagagaaaagcatcagcaattggatgacagaagtagcatcaactgttctctcttttggccccaactctcaaaaataggaaatgatgtaatagactttttttttttttttaagagacagagtctcgctgtcacccaggctggggtacggtggtgcgattatagttcactgcaaccttgacgtcctgcgctttacacctgcttcagcctccagagtagctgggactacaggcatgcaacaaccatgcctggctttttttttttttttggttattttttttttaatttttcgtaaagaccaggtttcactatgttgcccaggctggtgttgaccttctggcctcaagcaatcctcccacctcagcctcccaaagtattaggaatacaggcatgagccatcatccccagccttagataaattgaggaaatgaaatagagaagtgatctgtacagatagtggactaattaggtcctccacatgacatagttgtcattctttcatagctgaatgagaagttttggttatgtgaaaaccaaactctgcaaatagctttacattaattcacttttgggtggcagaaagttagttcacttcattctgaactgacagtacccaagagtaactaaccaaaaaaaatggtttattatctaaccattagatggaatgccgtcatctttgtttttcatataaagactaagatcaaaatagcaatctgttaaccctgtatggtttatttcctaatgttaaagcagtttgcaccaaaaactagactagctttttcaagtgccgtgtggcaaattctaaatatccccactgcaactaaattcctgcctttcactgcagatgctgttaaaacttcagtggcggcttccctgccaccctccaaaatcagtttcaggtctatctgattagcaggaagtgtttacttaggtagttttccagcagatgtagcttactattcagtggagattatgaactacttcttgtactgcttcggtcataaagtttgtttgcttaagcagttcgcagctttaataatcaagtttcttagagaagcagttcattgctagttaagatacataagaaaagtgtatgtgaaagtcctttggtgggccaggtacattggctaatgcctgtaatcttaacattttgggaggcaaggccagcagatcagttgagcccaggagttcagcccgggcaacatggcaaaaccccatctctacaaaaaatacaaaaattaggcgtggtggtccgtgcctgtagtgtcacctatcaaggggctgaggtggaaggattgcttcagcccgagaggttgaggctgcagtcagccgtgatcgtgccactgcactgcagcctgggtggctgaccaagactttgtctcaaaataaattgtttttaaaaagtctttcttaaacaagatagtgctatttttaattccttcagcatatgtgtttataaatatgtatcacagcattgtaatattatcactcaggctagagtgcagtggtgcagtcatggctcactgctgcctcattctcctgggctcaagcagtcctcctgcctcagcctcctgagtaattgggactacaggtgtgtgccaccacacctaatttctattttgtagagatgggttttgctatgtagcccaggctggtctcaaactcctgggctcaaactctccttccaccttggcctcccaaagtgctgggattacaggcaagagcaactgcatccagccttactaatgttgtttatttcattgagtaagtaagctttagtgcatatactatgcaaaggtcactgtttagcactgttagcgagaatacataatcactataacataagtaaaagtaaagtactgtaggggttctgacgagagagatgttatatttggtagaagattgaaagggttgacgtaaaggttgtaacatttaagcatttaagatgtataattttgggccgggcgcggtggctcacgcctgtaatcccagcactttgggaggccaaggcaggcggatcatgaggtcaggagattgagaccatcctggctaacatggtgaaaacccatctctactaaaaatacaaaaaattagctaggcgtggtggcgggcgcctgtagtcacagctacttgggaggctgaggcaggagaatggcgtgaacctgggaggcggaacttgcagtgagccgagatcacgccactgcactctagcctgggcgacagagtgagactgtatcaaaaaaaaaaaaattaaatatataatttttttttttgtcacctaggcttgagtgcagtggtgcgatcttggctcactgcaacctccgcctcccgggttcaagcaattctcctgccccagtcccccaagtagctgggaatacaggcgtgtaccaccacgcccaactagtttttgtatttttagtagagacggggtttctccatgttggccaggctggtcttgaactcctgaccttaggcgatgtgcccacctcagtatcccaaagtgctgggattacaggcgtgagctactatgcccggccaagatgtatagactttttgacattcggtgctgggaagacattccaggtggagaccagcaggagtggaggcagaaagcatcagctgtgaagggaagcggcaaagagaactgaaaaggtggattaaggctgtataatatttggccttgattactacacagaggagttgtattcatttatttatttatttatttatttttgagatggaatctcgctctgtcacccaggctggagtgcagtggtgcgatctcagctcactgcaacctccacctcctgagttcaagtgattctcctgccttggcctcctgtgtagctgagattacaggtgcgcgccaccaggcctagtgttttttgtatttttagtagagacagagtttcaccatgttggtcaggtgggtcttgaactcgtgacctcgtgatccgcccgccttggcctcccaaagtgctgggattacgggcgtgagccactgcgcccagcctaggtgttgtattcatttaatagacaaccattgaagtttttgagcaaggcaaagattataatgagttacagtctagaaacatcagtgccatgacagtatgtgagactgatagtagaggaaaactaataacccaggtggtaagagtttgtaagatgtggcaactgattgaatgcacacagaggttactcagttttgaatctaggtaatcgaagagtacgctggtcctactaacagaaaagttaaagagaagaggttgatatggaaaggttaggtattaataaatggttttcactttagacgtgcatttcaagtcccaataaaatatccaacttatgatatatgaaagccagtaaaaaatccaggattgcagatttgagaggcctatgcagagttgaagtcacatgagtaaacaaacacattgagtgcagagaataagccaaccttcaagacacgtctacactcaaggagaaaattaggcatagttgcatgcacctgtagtcccagccactcaggaggctgaggtgagagcatcgtttgatcctgggaggtcaaggcttcagtgagcagtagtgaccccactgcactccagcctggacatcaggacatcagaatgagacgctgtctcagggaaaaaaaaaaaaaaaaaggagaaatacaacaaaggaaaaagaatatcatctcggccgggcgcagtggttcacacctgtaatcccagcactttgggaggccaaggtgggcagatcgcaaggtcgggatatcgagaccatctgggctaacacggtgaaactccgtctctattaaaaatacaaaaaattagccgagtgtggtggcatgcacctgtagcctcagctactcgggaggctgaggcaggagaactgcttgaacctgggagacggaggttgcagtgagccaagatcgcggcagtgcactccagcctgggcaacagagcgagagtccgtctcagaaaaaaaaaaaagaatgtcatctcttcaactagatgtaagctcttgaagaaaggctcaataccctctgctttctctgtatcccttattgtagagtttaataaatttgtggtttgaatatataggaaataaagccacaagattgataagattttttttatacaggatgaggatgaagaagtatacaagagagatttcagcgctcctaccctggaggatcatttcaataaaaccattcttcctaaagtcatgcaggtatggggaaccttaataacatgacagagaaaagtgatgtattgatagctgaggcatggtttgtttggtggtataactcatcatccatccttccctcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggcagaaggtgtttcacattttgataattccctttgatctcagaaacaagctcaggtactagcttggctttaggtagcatctggatttattccatgaccaaatacagatgtttttgagaagaccaaggtcttctcacatcctttaaatgtcccactggaagaatcaaatagtttagtgtcgtacgataaaaatgaatgcaaataattactatgaggtggtaaatacataaagatgaacacaggtacaagtcactgttgtgtgggatacaatctaagaattatcctagagtcagaatgagggtaaggccttgaaactcttggagaaatgtctgtaattgccatttgagtgtccttacagcagactcaggggccgttgcagggttttttttttgtttgtttgtttgttttaaagagacggctctgttgcccaggctagagtgcctcagcctcccgagtagctgggactacaggcgcctgccaccatgcctggctaatttttgtatttttagtagagacggggtttcaccatgttagccaggatggtcttgatcttcacttcgcgatccgcccgcctcagcctcccaaagtgctgagattacaggcgttgagccactgtgcctagctggggccgtcacagttttatagttgaggaaactagttcaacatgtgtgagttggtccaagctgatttttttttttttttttttgagatggagtttcactcttgttgcccagtctggagtgcagtggcgcgatctctgctcactgcaacctcctgggttcaagagattctcctgcctcagcctccctagtagctggaattacaggcgtccaccaccacacccagctaatttttttttgtacttttagtagagatggggtttcaccattttggccaggctcgtctcaaactcctgatcccaggtgatccacctgcctcggcctcccagagtgctgggattataggcatgcgccaccacgcccggccctgattaacctttaaagtaaaattaccttctctctaggataggaaatggcatgtagaatgtattatggcttagaatttgaataccaatcaaaacctttcataggtttttttcgttttgagacagtcttgctctgtcgcccaggctggagtgcagtagcacaatctcagctcactgcagcctcaacctcccaggctcaagcaaatccatctcagcctccagagtatctgggaccacagacaggcacatgccaccatgcctggctttttttttttttaattttagtagagacaaggtcatgctatgttgcccaggctggtctggaaatcctgacctgacacagtcctcccagcccagcctccccaaagtgctggggttacaggcatgagtcaccacacctggcccaacctttgatatcttctagtcttaccatgttctaaccctcaggtacctaaattctttttttggtggtggggggagcgcggtagagacgaaatctcactgtgttgcccaagctggtctcaaactgctgggctcaagtgatcgtcttgcctcagcttcccaaggtgttgggattacaggcatgagccaccatgcctggcccctaaattcttttttgttgttttgtttttgagacagtctcgctctgtcacccaggctggagtacagtggcacaatctcagctcactgcaacttccgcctccctggttcaagcaattcttctgcttcagcctcctgagtagctgggactacaggcatgcaccaccacgcctggctaattttattttttttgtatttttagtagagacagggtttcaccatgttggccaggcttgtcttcaactcctgacctcatgatccgactgcctcagcctcccaaagtgctgggattacaggtgtgagccactgtgcccgggcttttttttttttttt

SEQ ID NO: 16089 - DNA, 175265 bp, Human
  misc_feature (1)...(175265): n = A,T,C or G
ttttattacttactattctttggcattatacattttgtcttttgtttttgtattatgtatctattgtactataagctactcaaaataacttttggaaaataaaaggagtatttgtgagaaataaatatctctcagtattagaatttcaattctaagaagtgatttattaatcatttttacttactaagccctatcgagtactttctgggaagtaatgtagtttatttgttacaggtattctggcatcagactgctggggtttaaactcaccaagttatacacataaatcactagataattatcttgggcaaggtgcttaatatttttgagcctcaggtttctcctgtacagtaatgttatgggggctaaataagtttatatataaacacatgtatgtatgccttactcatcttacagttttatcgttgtttctgattttattacctaaacgatgcctggcataaaataaatactctataaatattagctactactgttactatttactctagttagtataacaatcctcagatagatgtaatcctcacttcacaggtgaggtaactggagccgaagaaggttatttaacctgctcaaggtcataagctggtgagtgtgcagagtgcaaggttcgcacccaggtttgtctgaccacaaaagcctcctgctcagccaccaaatctgccaagactgcttcaatatgacagcatagtgaaatagatgtggctggattgtccagaaaatcatgcttgcatccatctgtacaggttcatttcccagtttttcttttctgttagttataatttaactcgggattacaaatctatgccattagattaacacaattttttggcataggtctcctgtaagtcttgcttctttgagagacacttttaggaagggagagggccaagtttattccgttaacatcaagtgcttctcctgagagaggagtcatccagtggagatgctgtatgtctgtttcataatgcacacggcacatgaaagatacatgggatgatgtttatgctgcttgccagatacttctagttgtccagtgaatgaaccatcatgtgaaacagagaaataatgagtttttaaatagcttattggccatttattgcaaatttaacctttgtggtaccatctctgaccatagacctttggatgcagggcaagctagaggagtttagtgaatgtcctctggcggaatgagtgaatgaatgtactcacaaatgtagaggaaggcattagctacaagagagcttcttgctgttaagaagatgcgggtgagtggaagagagaatgattgcttccaagcctgagcaataattggactttgtcactgtgtcatttttaaaaatacctgtatctcgtccctgacatcctgatctttcacttttaaggaggtcccttcagtgagagcatacacactcacctgcaaatcctgatttccttatcagtagtcagtgcacttttgcctttttgctttcagattcctgctgttttcttatacagtgagtagattagttatctcagatgtgactttagttagagcagcaaatctggttgggtagaccttttcccactcctctaatcccagtagaggagcctgttttctagtggagacccatctttgcacaagttggttatggttggatgtataggaactattttctttcacagagttgattattgttgaactgaaaactgcttttcattccttttctttttaacttaatcaggatattatagatgcaagagatagtactggatgaacaagaactatcaattttgtttaagcaatcacattatatctagaatcaaaggaaggatgcagttcttaatttttgatagatagcccttgatcatattttaattcagccactctaaaaatattatattagttggtttgtgatgaggatggatatttggtggttattattgcattgcttgttgttgagttttggctaatgtaataattagacctttcttctttcagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactggtaagtcctgaggagggaggttgcccacttgtatacacattttgttgtttatagcatgaaatcaaaagtcctagttaccagtgagtcttcaaataccttacccatcataatcttttactgttgaatctatacattagagtagtaagtatattatacatatatacacatattttcatgtgttaaatatctgtaagattgcaatgctctaaaaagtggaacgcaacttagagatggtgatgatttctgaagtgatactttaagaagtgatattgtttttaagtagaaatactaagtggcacacaggatattcattgggaaagattagacaaagtatcccgagacttccacaatggttgagtaagggtataagttaaaacagtggttttcaaagtgtgatccccagactgatagtatcatcatcatcaccatttgaaacttgttaaaatatgcattcttaggccccactccagcctactgaatcacagtacctggggtgagacccaacaatctgtgtcttatccagccctctgtgtgattctgatgcacattaaagtttgagaagcactgaactttcggaagaaggacacatttttttctcttttgcccgtagcattttgtccctacaaaatatcttttttttttttttttgagatgaagtttcactcttgtcaccaggctggagtgcaatggtgcaatctcggctcactgcatcctccacctcctgggttcaagcaattctcctgcctccacctcccgagtagctgggattataggtgccatcatgcctggctaatttttctatttttgtagagatggtgtttcaccacgttggccaggctgctcttgaactcctgacctcaggtgatctgcccgcctcagcctcccaaagtgctgggattacaggcataagccaccactccgggcctttttattttttattttatttttcgtgttttagttttgttatttcttatggtcagatacatattttgtgtaagtatgcttctcttaggccataaaaattaaatattgtcaaaaaattttgtatgggctggacgcggtggctaactcttataatcccagcactttgggaggccgaggtgggtggattacttgagatcaggagtttgagaccagcctggccaacatagtaaaattccatctctactaaaaatacaaaaattagctgggtgtgctggtgggcacctataatcccagctacttcgatggctgaggcaggagaatctcttgaacccaggaggtagagggtgcagtgagctgagactgtgccactgcactccagcctgggtgacagagtgagactccatctcaaaaaaagaaaaaaaaattgtatagtatacagcttctaataccagagactttggatctactctttatggagtttgcttaatttacaggttttcatttttgaagaagctaaaaatattttcctcttaaatattattctgatttagacatagaatagtgttctttttgatataaagggggcatctaaaagtatttcatatatattagtgattgctaatttcttttaaaattattggtcttcaaatgaatatttgaatttgactgttaagaaagagataagctcttttgagtatcagactacacctttctttatcaaaatatcttgaatgattcccattctagagagattgacattatttacattttatttttgtctggcaatgctattttttcttatttgtaattcagaagtattaactatgtttagggtcaggtagaggaggaattggctcgaggaacattaacccaatattggaccagtggtgagtaagtcaagccagagacttactctgtaagttactgaccgataacttcttttgtggaattcagaattaagcgtagtagatatgtaaactctcaaaagaagtgatcaatattttataattaaaaagccactaccatattttcctctagtccttccctcctactttttattaataaaaatgtttcagtctcagatgtttagagaagagttgtactaacatttgccatggtttgcccccatttaagaaaaactgaggaattaatgtcctagttattggaaatctagatattccttcattcttttagcattttttaaagttaaaatgaacaaagactttctcttcaagtgttcataagacaatgaaaggtttgggttcatttaggatttttttcccctaaaaattcattatgttttattttggagaagtcagaaggaccaggaagccgcctagtcccctgactccctgcatctgtccgtctggagagggagtaaaggagtgtggacttgccctcacaaagcggatttagcgtgtggatttagataggtgagcaaaccatcttcataggagtagagatgaagtttatccagacaagggggccatgaggccagttctgtttttttttttctttcagctaacatggctgactagactggtagctgtttcagatttttaatttgaagactatttctgtgttgcagacattttgtaaagaaaagtatttttcctctttgacatttttttcccaaaaaatgtagttgaacttatctttgtattcttgcaaacacacaaatggaacgttgaaaaactgtggccccaaatcagtgaggcaacacattttggtgatccaatttaatgaaatgtttattatacatttacctggtacaggtggtatatatcacatacatgtgaataagacctggtctttgccctccaagggctcagaatataacaggaaaaaatggaaacagatatctaaccaagcataagtacattaaattgttgactaaattaaaggatataacctaggtgtattcaagcaaattaggaagtatccaagtggatatagctaatttaaaaccaaaatgtgttcctatcttctaaatgagtatttccttgacagtgctccttgattattacatttcatctttgagtaaaagaaactattaaatagctggggtcctacctgttgtgaatatgcattgagaacttattgaaagttatggctatggatgataaaacatatgagacatagaatatccaaggtctaggtaagggagtcagacacataaagagataattactataagttttttaagaactgtaatggaggtacctaaaaactggtgtgagaactcagcaaaaggaatgcagagagccaagaaagtattgacagattacatgatattgaattgtatcatgtatgataagtacaattgtactatgtgaaaaagatggggaaggatgatgtgagcagagataacagcacatggaagccactggtattttttgtaaagtggctagttatgttctttgaggtttgctgtgagaaggcagggtttcagaagggtatgagaggtggggtggagatgggaggatgagactgaggctggaaggttagggttaaatattaatctctataaccagcacttactctgataccattctatagggaatgggggttgaagggatctttgagcaggagagttacataatcatgtttgtggctggaatagtgtcctggatgagatgagtaggaagaggtggggaggaattcttaagagtggggtgattaggaaactttcatacttgttcaaggaagccatggcagggtagggggatttaatcctatttttattacaagaccttttataaaatgagtgttcaagttgattttaaaacatctgattagtttgtatttaaaacgttaatatctcttaaagtcttcttgaaaacagtaagatgatttgtgcagggatccaatttacatttctccctgaagttctcatattttcctgttttcctttcacttagcagagaacattccactcatttgtaatgcaaaagcagaccgggagcttaggttttttgaatagaatgatttagaactcatgttctgctctctgggcagaggggataggccagcatcagctgggcaaactgctaatctctctggtttgcctgtttcctgcagtgggggatttgtccctggggcagcagaggattccctcagtgccggggcctgccatttagcatgtcaggcagttgccaggagaaccctctggctttgttcctggatgtgagagtggactggtggccaagtttaaggtcatggcagtccttcccttacagcagctgacgtcaattaggagaattccccttgcctgcactctgaggagagttaagcagggataggaatctggtgtcttctgggacctaaaagatcagtgtttattctcctcatagtgtcatttgtcactatgaagcaatgtggccttagtttatatggagataaaatattttgtctggggcattttgcccacttgtgattttagtggccaaatctttagggcctgtcctgcagccagagacctattttggtacccagcccactgctggcaagtcagcacatttcagtcccagcctgtggcagccacacatcattttgatgtccatatactccttaatttcagcccttggttaaaaaagtgattatattataaaaggtgactgcatgagagccaaagtcctttgatctgttcacctctggtcttgcaaggttgttcttggaaacgctttttacaaatgtgaaaagggagacaggtggagtcagtgtttccaaacttgaccatagatcagaatcacctgtagggcttcacaaaatacagattgctgagttctgcctccagagtttctgatttagtaggtctggagtagggcctgagaatttgagtatctgagttcccagataatgatgatgctctggatctgggaccacactgtgggattcattggtttaagaacctaaactgaagtctcatagcgggtaagctgaagaccttgccttaaacaggcatttatctacatatcctatgcttagctattatactacactattctacttctgcattgtagggttaaagtcttgggcttttgttcccgtgactacaatgttttcctgctcattactgaagaaaacatacaaagaatactgatgcgaagggtcctcaagaagtagaagaaataaattattttgactgttgattataatttattatattttaaataaaaagtgtgtttctataatacaagcaggcaggatgaaacagaatgcttggcatatttgggacatagagtttatgtgtgtagtttttcccagaaaaaaacattcgtagttcttttctttacaagctcttggggagtttactatagaaagttgctactggaacagtgtatcaaacaaaaaatgtaagccaggggctcaaaatcaggtatcagtgagctgagtggtaatgaatacagtattctattaagaatagctgaaccatagtaattcagtatttgtgtgtacgaatcagtaatactctattaacatcaataaacatgtagcgctatctatgggaaacatttgacagtcattacaattacgtcatggttacatgaataactgttttactttaagacacagtatacatatcccttttaacatcccttttatgttctcatgaattggtacttttcacaaataatgacatatttaagcacctttggtaaagcaatgcctgttgttttcacaggaaggtaaacatccccagaattattattcttaaaatttgaaaacaatcactggcagtaataatgctctaattcttttggagaaggctaaaatatattaaaatcaatactatcgtggctttaagagaagtggtgtttcaggtaatactgaaatgcctccagataaggaaggaatattttcttaggtactttaaggaaaaaactgtagatgttttccttggtctacccaggtaatactcatattttcaatctcatctatgctatattcatttttatactcatgtttccaatcttatccatattccatcttctcactgaagtgttcctaataatttcagacttcattgattttattctctttctgagtcagtaacatgtatggactataatgaacagtctgaaataccagtcactgactggttccgatccatgacaaaattttcactgatccagagtgaaaatttcattttcattttagcgaacatgctttctttttgtgtatgacactatggtgacagtagatcataattttttatagttttttgggggataaactgagttgtttttgttttaaagctaacacttgttaggttcttttggttttgtttttttttttttttttgccgttcactatcataaacactgtactttttaactcttagtgttcacataaccctgtgaaaaaagtactgttatcagttccattctacaaatgaggaaactaaagctcagtgaaattgtctatcttactatggttacccagctacgaagtgccagaattgggattaaatcccaagcagttcaactatgtctatttctgttttatttgggggtggaggttaatgttacaggtttatgaagtcattaaatctggaagtaaccatatgtaacatgacattaactgtattgtcctgaataatatttttgtttcatactgttatcctactaaatgttgaacatctgaggacataaacatgcattatggttttgtggatattattctatttaaaaataattttagtataactgcacggctgatttgtacatagtaaattatgataataatataatggaaatatacgaaaacctctagagtatgtgtttatatatgtgtgtgtttctttgtgttagtgtaaccatttacatagcagttatctttttagtctgttctgttttcctgagtttgttgattttattgatttctgtcttcttagtggagcgttttggacacagacacatgagatagttgacgaacacccaagtctgtttggaagttgtttcttacagaagaatctgtggtttagtggatttataaaataaaaagaatataaatttttcatgcagctagtttactattttgtaaagttactgtcttggtatataaagtgtaatattattaaaaatataaactaaatgcttttaggtccacaccttgctaatggaaaatatattacctgagagaaggccttcaggcagttcagtcctggctttgtgtttgacctggaggtcagatagctattcttctcctgtattttgtctgccttgccagcagcatcactgagcattgccttatgaagtaacatgaaagtctgtggaatggtttgatacctaagtcagtctgttgaggaggtagggaaaagccttcaaaagagcccaatgttcttttcctcatattaaaccctaaaaggtctatgtagcaaactatatacatatatgtaaatccatatctaaaagagataacaaagtcttaagaagttacatttttagatcgcgttcatcatatgaaaataatatttatagcaaaatgtattttgaaaaagtaggattatactgattatacaatgacagaaaaaaaatcttatccatgagataatcaagtgtttttcagaaatttttatgaaacaacattgtattttaatatgaagagtagtaggaagaaaaattttagatagaaataagggaagcctcaaatgattaaccaagttttcttttgccttgtgcctctatttttaatgacttatttatcttcatataaatagatgtcaagatcaccattttatttcactgcttttcttttcagattcatatatttttgtcatattcaagatagtattattgttagttttctctggattttatgatttgtgtcagatattttaatacgaaaagatatacttggaattcatgaacctgattcccagaaatgcagttattaactctcacgatctctgaatgtgctatctaatttaagatgccatctggtggtatgcatttgatacacctagttcttttaattgctctcagaatcatacatcctatattgcttatgaagaatatttttgaaatgacatgcagacatttgttttcatttcaaacaaaggatcgtttgtgtttccctttccgttttctcgaagtaatatgcatgtttgctttggtctttgttaataagcataatctgattctttcttacaaagcattataatcaggctgcaagtttcagaactcagctttgctcacagacatttgtagaaattcattatcctctttaaaattctagttacatatttttcatttaattttaaaaggtaaagtttgagtggatatttggataccatttggcgaataagagattctcagataatcaagcatgaaacacattattcatttgaaattctctttcttatgttttaaacattaaaggccaactccttcaaaggtggaccttagcttaatctcaaccactgctttgccttcttcatgagataagctggtaatatttattaaatatatatcaaaggtaggtgaaagctagacattaaattgcctgtattattgatataaaatatccattccacttgagactctgaattgaggaaatgttaaaaatacatgagaagattttagctccttagaaaataatttgtggctggttagcttagtttattaaggacgtggtggcaatgagccatcttacagacttttttcctcctctgtagcctgtttagaattctcagtttattttcaaacttctggttcagtcagtttatcttaaaaaaaaaatgacagaaataagaagaggtgataataggaagtgtgatttaatctctgctgtgcaggtcacctgaggtgtatcacctaatgacagtgcagcagtaactttattttctccctatccagcatggtgtccacattaaaattgtgaatctctaaattagcattttgtgtctgccactttctacctttgtaccactcagcaggatattcacctctttaaatctcagctttctatctattcagtggtgttagtgtcatgcctgtcactcagaaagagtgaaacgctgcaaccacagcacagatatgcccaatgagtagtaaatttttgttgttattgctgtaactgttactattgtgaccggtattgttgttatgtatctgttacatcaactgttgattctagtgtatggtttttggtgattagaagtatagacaccttataaaaactccattaatttggataatatagcttgcagttccccttttgtggatgtaagtaaagactgagagggctgtgctgtgacagagtgtgcagatagttcctcctaaccacagctgtcccctacttaccttttctaaattccaaatgagttttaattcgaaagaaaataaattttgttttcatgaacatattttgcgctatcagtatatcaattagaaagaagaaaatgaaaaataaaaaatgggaaatatgagctattatatattagaaaactagaagtaaatagccaaatatatgcaagggtgggctttgctaaagagtcccatgtcaaagtaataatttctttatatttgatgattgagaatcatttggatgtaaatacattttcatttcatgtttgggtaattgactttttaacagttcatggaactaccaacaaagtgtacattatttggattttacatttcccaaataatatgcaactttagattgctttctgacatttaaatcagaaaaatgttgcagggattttcagtgagtttttctccctctcattggcaaccctaaactatttgggggtatttcgttctatacctctttgtcaaagctttctagggtttctagaaagctcaggctgtctttataacaatttcttagtatgtttcaacatgctaataagaaaacactaggcaaatatcatttcagttggggaaatgaagaaattgtaagttaaaggatcatgcgtcaaaacaatataatattgattggcctcaaatacgcctttattcttttgtacactataaagaaacttaaaccatttttagataggagctaatatttcagcttctgttttaagcaatgaatgaactcagcagtaactctgggagataggtgttctttggatatccatgtaatagatgagaagattgagacatagaaaggcttacagagcttgcccagggtcatagacttaggctgtccacagcctggagttcttggttctaaggccatgacccttccattaaaatattactcaaggccaggcagtctggttccagagcccagtgtcttatgaggcagggaaggtggccataaaccattgattaaaatactcttgaataggaatttctcctaatattctccactaatgctttgaaacaggtttctaattgacacccatgtttataagcatcaaattattccctcaacatcatgcaacctgtaaagaaggcatgctacaggtagtgaagttagtgaggtgaagtaaaaattagaatgtttgaagagctagttaatatttttaaagtgaatacatagtttttattttcttttgtcttcccccacatgaccatgtttcaaaagtttagctttagaagttgctttcaagtactgtgttagagatattggaatcattttaaaacaatcttgaaatccttctaatgcccctcaatgaaattcagataatttacataagacctcagttcctgttggtcctccagtgaaggatgaaccccagaattattttcttcttcttccttccacctctttcttcaaaattctcatcaaatagtatttattgtataacacataaaaataacaaaatattattacctcacaaatcttgtctgaaattttactttttttttttcctagttagaagaattttggcatgcaagtgctgaattattttatatatttgggctatctaaggagacaatttaaacaactgactttagcataggaccaagtaaaatttcatgatggcatttgactaccatttaaaaagacattttggacctcccttttggcttaactaaggcatatagcttgcaattttttgcctcctgctccttcttgcatttctgtgggactgccgcagctcccccagtgactgattcctgcttgatgcggcagtgtgcagccataagcccttgcctcaccctggaataaagcacctagtttagcccttcccttctaactccaagtgctaaagaatggtaattagcattctttggacctttactacatgcctaacaatatactaaaggttttatatgctctgttgagcaatcttgtgaggtgtaggtactgttgctattcccaaagttagagaaggaaatctgtctagtagatacatagtgtgagctacatgtataattttaaattttctaagagacacttacaaattttaaaagaaacaggtgaaattatttttaataatgtatttcataacttcagctttccaaaatattttcatttcaacatgtaatcaatataaaattgttaataacatattttgccctcttttttttactaagtcttttacttctgatgtttattttatacttaagacacatttcagtctgactatatttcatgtgctcaattgccacttgtggctagtagctaccatattagcacagttatagataaagaagctgaagcttggcaataagagccttagtaaatgcagccgcaggaatcaagtgcagggaactgattctgggcctcaagctctcaatcagcacagtataccatctcaggacctggatagtttcttccttcaacttacaagcatcaccttgttagattcttctgtggctttaactgcctgtatcacaactaacgagcatagtcaggttccattctctacctatttctttctctttcagttgatcctgtggtgttagctctgtgtctttgatccatttccctgttgagtcaaaggacataaaattacagaccagtggaagtctatgggagtcacttctcttttttctgacctagctacttttgtcttcccataattgtgagcttgggcctgtagaatgtatgcactatttgctacttacagttagaaagcctctgtaactagccattcctcatagtagtgattctcaaagcagtgtggcacaaggttcatagggtaagtgtatcataatttatgatgaatcaggtagggttgagcgatgagttattgaagcaagaatgtggaaaagcaaagcagtgcaatagccttgatagagaaagtcaacagcttccagtctgtctttcacacaacatcaaataaaaaaacttggatcaagaaaagggatgagatgcattgttcataatggtgacacagtgcccattttatagcatgtaactttgagaatcaaaatttttttctaaaattgctttcatatatttttaatcacaaatatttttgattttgagatatcaaatagagttaaacagggcaaaggattttgatagttttcattagaggacattgtaacacactattctgtaggattgagttgatcatacactattttatctcaaccttcattcgtctagtttctattctttctaagtggtacacatggccactcagctgaagactaaatttcttagtttcctctatcactatatatggctgagtcactaagtttttgtcagtgcggtatgaggaaaagtagcatgtgttactttcagatcatgcaactaaaaattttaatgtcttccttgcttccctttccccttcttgccaatactcttaggatggcaggagctgaagatgccattctaaccatgggacagaggtcatatgtcaggtatggcagagcaacaagacagaagggccactgggtcccaacattgtgtacaagccatgttacctcaaattgcttatatctaaagaaataagcttttatcacatttaagctattgttatagctgggtctttttaataaattttttcacctgcattctaatactgtattagtttgttttcatgctgctaataaagacataccagagactgggcaatttacaaaagaaagaggtttaatggacttacagttccacatggatgggaaggcctcacaatcgtggtggaaagcaaggaggagcaagtcacattttacatggatggcagcaggcaaagagagagcttgtgcaggaaatctcccatttttaaaaccatcagatctcgtgagacttaactcattatcatgagaccagcatgagaaagccctactgccatgattcaattatctcccacctggtccctcccacaacacgtcggaattcactatgagatttggatgggcatacagctaaaccatgtcaaacacaaaatctagatttgttaatgcctttcctgcagattgttacctatgtatcctaccatagctaccatcagtccctgccgcaaaccctgttcttttccagagagaagccaatatattgttcttttaatgaaccttgattgtctttgtttctctaacttgagatacatccgagtaatttgatctatctgaggtatgccttctgttttgttgttgtggttttgttttgtttttccccaccatcgtgaactctgtacaatgctcaagagcaggctcaggtcctacgtcttctggaaagattttcttgactcctcagatagcaaggtctttctcttcccctagttcccagtgcattttaatacttaagcctgttttatttaatgtttattaggtagtatcttctctctcccagctatcctgaaaattccttgagggaaataactgtatctaaaacttcttgaaagcaatcttaacatctgtcccaatgcctgtctgtattaggtacttaatgattgtttcattcaatttgattttgtttaataccaataaaatgttaattgaatctcagtctatcaccttaaaagttgataggtcttagagatacttttatgcaattatttttttaaagaaaaattaaggctgctttccaatttttcctggttttattgtcctagaaatagagaaaagcacagtatagcccagtatgacaacttaagagtaaataatcacatatgaaattgttcaaaatcttacctttttattccatacaaatcactttacaatcaaattattgtcaactcttattttgattttgataggcttcctagtgctcatggttataatttataacatccctaattgtgctgtttagcctgtctcaccctatatgtaagtctcctcataatttcttatctaaagatgtgacaactcatttgtgtgcctctcatggcaaattcatattgctaaacattcatataatcatagaattgtaagatactttattttgtataatcctttcattgtaatgtgtttcttttttatgtcaaatgtgatttttgagtggtctggctgcaaagtatagtgggcttttctgtgtatttttatcaaatcctgcttttagattccagattatacttatttgaggaaagttaaaaattgacaaaactattcgcataacagaggaacctccactttatttttactaaaataagttttaaaacacttttgttttccctttatattctaagttatgtaaatttcatttctttgaaatatattattttatttgagctttgttatgttacctttgtagaccttgttttaaaaaggatcctcaggtttttagagtattgagtatttgatatcttttctgatgttaaattccttctacttagtagccatcaacatatttataaatgcccataatatacccagtaaaagtctgtgaaagtcgagatacttagtatgttatttttttaattttaatatggtgatcataaacttgtgatggtctaccaatttgaaaaaattctcatgaaaagctagtaaaggggaaaaaagtacttaccaatattattttaacattcttaaatatttttaaaaaattatcaaagcaacacttattctattttattttattttattatttttagagacagggtcttgctttgtcactcacctggaatgtagtggtgcaatcatagctcacggtaaccctgaactcctgggctaaagcgaccctcccatatcaacttcctaagtagctgggactattatgtagtaatatagtgtgctaatgaggtgcacaccaccatgccctgctaaattttatttttttgtagagactcactatgttgcctaggatggtcttgaactcctggccacaagtgttcctccctccttggccccccaaagtgctgggattacaggtgtgagccactgcgcctggccaaagcagtatttattaccctaacatcatcatgacccgtaaacctaatttaccattagtttaggttatgggtagctctcaaattcccagtatgagaatattgttggtgaattctctattaccagggttactgtagtaagatataatgctaattattgattcaaaataagaaatttcagtaattatcagggaaggtcaacttccagaataaatttaaggcatacaattataaataataggaaatacaacttaactgtcagatgtccacaggcagtaggttaaatgtggattcacatgcaggccttttaaaaatggcctgcaaggagagtggttttattttcacagtctgtccttttttgtctcagttatgatttttgctagctccctagtgacccatagctatgttttagctttttaccaattcttagatcatgagtagaacccacttgttaattatgggtgccaaattggatgatactacaatttatccttcaaactggtacacttttgaaagtaaacagggaagctgttactaattatactaccacagcacatttaatccaggactgttccagataaacagggatattaggttttcctagtactatgcctcgaaggtccccagtttccacctctgctcatctctgctagatgtgaccacatgttcttaatgttggccaacttgcacatataactttgggtgcattaatcatggtcctatcatttttgggtgactacagaatgatgtactacaagtgcagattataactatctgcactaacagtatggaggtgacttcatataaataatattttacatgtaggttttgagtatgtttgtatttgaatgtagacctgagtgattcttcagaaattaatacagtaaaacattagaaatttaggacagtgatggtggagtgggtcagttagatgtgaaaaattgtaagaaaacatttcttctagacatggaagaataggcattaagattgacaaattatcttgattcaaatattttaaaatatttttagaatttgtatttattaagtatttaccctgaaataagtactgcacgaagcatattcattcagtattgtccagttgctcttagcatgaagtcactggtgtcaccttgatggcagtgatgagacaaattacttgtttcacctctttaaacatcagatagattgctggggacaaagagacagcatggcttccaaccattacacaagtcccccttctgcagccaggatcatgtctaggatgatgcagttatggaagacagcatgctgagtttctattaatttgatgaatcaccaaattgagaccagtggtggtggtgtccagggacaaagtgaattgcttcagcagtgggtagataacccactgtttttcagttaactttttcagcaaggtaataatttccttgggatggtatccaaagggtggcaaacctctccctaaaagtagtgtagatgaaatctaggctcagttctgtagctattttctttaactagcactctaggaaccactctaggaaccaatattacacttacatgaggacttgtgatgacctggacacctcttttgttttctacgatgagagtgagatgaaatggagggggagtgggtgatcgttcgagagatagttcaagaaagagaagaaaattgtggggagtcaaatatgatgaagggatttgtaagattggtgataacaagaaacagttgatttgaccaatagacttaggttccacagacaaaataagaatcattgagagttagccaggggtcatagaaataattatctgctgactaagagtgaccagggaatgctagttttgaagatgaggaaaggatttgtcagaggtggtttatgtgtgattggattgaatctgaggaattaggacaagaggggcaatagtaacacttccattaatatgagggctgtgtgaagaacacttaccaacttgagggttttatgttagatttagtgatgtctaggtgtcatgacaaatgtaaatgcttatttctagaaagggaccagtggtaaaattatgatgggaatagacatggcctttttgaggatagacctttagaggtttcggagttgacttactctggataattatgcaatttagaatggtaaaggcaaagagaggaagggttttagcaaaatatgtatcctgattggtcaaaggactctgggagcacagtaccaaaagtctgtccagtagaggtcaatgggagacagtgtgactatatttgttagatagaatacattattttcaggggcagtatgaccatgattttaaataaaaatttcagatgtaaaggtaagtcttttttggagcagattttgattttttgcttaattaatcaaggcctaatgctaaaactgttaagtattcatcatgctactgacaaataaaatctgaatatttgcatataaagtaaaactgaaacatggattcatgcttgtgttctagattctttcacataacaactgcattttatgtgtaatgggcatgttttaagggtaatgctttgccacctagtgagaagatcattggctttagaataaaacagacataggctctaatcctgcccacaagttacctaacatgctcctcatttaaacttctgtgcaagtgattgaaataatttctactttacagtgctgtgagacttgagataatgttgaaaagctcctcacgtaataactgatatgtagtaggaactcagtgaccaaaaaatatcacttattaccactaaaattgatctatgtacatatattcactgaaaccttctgtaaatggatggatatatatgtttatatttagtaaacagaaaaaataatatttcttggtatatagtagtgtactctggataatgatagtcattgttataggaattgtgttttttttttgtgcttaattcaacagtcattcctggtaagatatatcaaagatttgctgatgtattcagtacttacttcatatttgcccttctgatgtaaatcagaaacaattaaaataatttataatagaaaattcaaaaattcaattcatagaatttatataaaccttttcttactttgtttgatgtactttcttagcacctgaattccacttttcatttgactcatatgagttgtttgacatttgttttggttccaagtaaaagtatagttgttttgtttaggatcttcttgacattactgaactacaataatccctttttttcccaagcttaacaggaaaaggagggtgaaaataatagtattagtgaaaactattgtctaaaagtgatgagagtacaggactactatgaatcaggaatcccgagagattgtgccagttctgacaatgtcttcctgtaattcatgaagaggttattctaggtgatctcaaagcccttgttggttttcattctatgaatgcatttcttactccaactatatgttacatgacttcaaagggaatatcttgattagtctaatcagggtttcctcctgctaccctttaaaaacacctctgtgtcaaagtaagagataacctcaacttttgttattgtgtgatttaacttcccaccatatgatgaattcctgaacattttaaaaccactagttttatttttgtgagtacttcaatatccagaatgatttctgtcgttaacgtaatgaaacttccactcctacatgtgtttcttttgtctttaaaatatagcaggcctgtttcacaaaaacattttcttatttaaatatgcatgcttttatattcttctcatatgaataatatgtgaattgactactttttaatttgaataatgttgtggctatagaaaaaagcatggtgaaaagggaatggatttaggaattttaagtaaaatatcctagtatatcgtatatctattgatattttattggtcacattttattggtgtttgtcacatttcactgtggttttttgggggggcttcacagtagttgtattttagtcacagtaattaaaatttaataaacagttctctgtgattttctctatcttgattgttctcaagggttagtcatttgccccatatgtctgataattggtcatacaaatctctgttgctaaattcttgactttgaagaatgtttgattttcttctgtgctattttctgctctaaatagtcatataattttacttttggaagagaattagagactactccagctactggccttacagattaggaggcttggagcagtcaggcactgccactcacagctggaaagtgctgaactaggcccagaactctggtcttctagatgctcttgtggattctctgcaccaggtcccccgacccttctttgtttgtcatctatttccttccgaataacaatggagaaggtgatgactttacttctgcagcacgttattgttgcttttgcaatttaatttctgttggctgtattaaaatttaatgtttgtatacactaatacatttaacagttattcttcagcaatagacatgagtttttctactcacaaaaaccctgtagatcacataataactgaccttttcctactgacctttaaataaagcaatcccttaatgtactgctcattttgtccttgacccagagctcacttctgctttcttacatcatgtttggcagcgggacagaggtaataacctgagaggcgtgatgtttgtgccttccatgactacccctgtttaactgctgggaaagtttccctcatcttctcccgtaattatttttaaatgtcttcagacttgagggagtaaggttttgtggagaccatataatgctgatgggagtgtactagagatatccattctgtatttcctgtggaaaatggaataaaatagaatgttttcagtttcttaaacttaactcctctgtgtggtagaatcaaaatcattgtatttatgcctaaagagcaaactactccactcctatactgaggtttcttactggcaattcctctccatttgaaaatagaagatgtttcatacaccaaagagcactactttctacctgcttctttctcatcaacaatataggacagactcaggcatacacatcttttaatatggtatacagctgcagaattacaaagaattaatatgcatgtatcgtagatagctttaagtccctttggactccttagatgctccttttttcaccaacattctaatagagttataatacagcattgcagctggaagaaacattaaggctaaaaccaaatcaggtagtatgttgaaaggaatggtggacctgccactgaccagctggaataatcttggagcaaatcacttcaactccctatgcctccatttgctcattgataaaatgcatcagctaacaaggtacaagaattacctggtgatcccttttctctgatttcattcaattatagttggctattactctttcccagaagtctaccacaggtcagcccctaagttctaattcaagctgtcaactttagtcttccctttaatttctcagaagtaaaacgttttttcttttacaggccccttccagtttctatagcttcagaaacaaagatgatgtcattccagcttcttcttccaaaaattctttgtttcttttctttagtctttgttttaggatttgttttcaaggcatttacaccttttctttctagcattatagattatcttagatctttgttatgtctccaaatatttttcgggactttaagtcttaccttagtcctctgacttccccctgaacatggatttcacaaagtacacccctttatagccatagtgcctggattcaacccagctctgtcacctcccagctctgtgactgttcaagttacgtatactgtgtttcagtgtctacctagagttgtggggattaagtgagttagtacctgtcaagctcttatagctgtctggcatatagtaagtggtatttgtgtgagtgccaggctttacaatcttaccgcaggctttgttccctttccctatctcactattcttggccaactgagcatctcaccttccccagacttacacttcatgtccttagactttatattcttttagattaagaaggatacctccattgtcacccacaggctccccttaaatactttacaatatgtataattttgtgtttaggtttgcacacatattctttatattgttgtcatcctaaaagttattctcataatacttaaagctttcatacattgttaggaagaaatgttgtacttaattcaagaagatgttttagaaaatatttaagccagattataagaatacataaatacaaaacgatgtattatttcttttaaaaataagtgtacctaaagtcattgcactttagtgaagaattccctaaccccaattaattttgtgatatcttaatgaaaaaattaacaaatggtgtggttgtttcacttccttgaaaatacatcgtttaggttcatgtttcaaaagagccaattttaagcaatactgaaggagacaatcttattgataaaaacataaatatttaatagagccatagtatattaaaagattttgaaaatataaagttgattgatttcagtaacttccaaactatttgttaacaacgtggttttttttgttagtttgtttttctggcggggtggggggggcgtagtttttgtgtttgtttgtttgtttatttgttttaagaaagggtctcattctgttgcccgggctggagttcagtggtgtagtcatagctcacagcagcctcgaatgcctgggctcaagtgatcctaatgcctcagcctcccaggtagctgggactacaggcacccaccaccattcccagctaatttttaaatttttttgttgagacaaggtcttgctctgctgcctagactggtttcaaagtcgtggcctcaagtgatcctcctaccttggcctaccaaaatgtgaagattacaagcatgatccaccatgctcttttttttcttaatgaaatatttaaatgcaaaattccaaatataaaacagagaggttattattatattaatttagctaaatcaggaatttttttgattgaaaaattaaaattatttggatggaagacatctttgctaaactgttatttaaaacttatgtatgcttacagagggacctcatctctgtgtccattttcatgtctctagctatataaatcctgacatcactgtctttctagtggataagaataagtgtgtagtgtaaatatgatactgttacattttagcaattaataaaaatgtcaattgctagggctggatataattgcagaaacgacctagtgtttcactttgctgtttgaaaaaaaaagccctctaaagtttggatctttttttttccttagcactcaaattgtgaaccactaggtttgcaaacttttgtacatccaagcacagcctctctcttaccacaggccaaataaacaccctgcctaccacacatccatctattcctcattgaaatgtacctgagcttataggacatttcacttacacccctcaccccctcatcccccaataaaggcaaaagccctgttccattaatccctaaaagccactgtcagtgcccagaatctgtctttagaatctgggctgtgttattattacactggcccaatggctctacttttacactaagaggaagaagttgtagagaggagtctgaggagggaagttggcttgtggagctccgtgtacatgtgggttatcataaatctgggaatgctggatttaaatgtccagttaattgttcttcagtgcaaacaaatctaatgtgtgccttgtagttaattgattttattagtctgaattgtgaaaataaagtagcattgcaagttttgaagcctttttttacaggatcattaaaaaatatatttaagtgaggacgtgggttttagaaagaatgagaacttagagagttatgtttaatatgtcttgtgggaataagaaagcaaatgaattcccattgtaagttagaatttgtcctgatttaaaaactagattcagcttccctctgcattagaaaactaggtgatttcatggaaatagggctaaacctcctaaggctcattagagaagggaccacatgtgcttagaaaggagtctgaaatgaggaagggggacaaagactcgttttaagattttaaaagaaaggaaagtgaggaaaacattttggggacatttagtcacaagggaactgtgactaactctgttagtcacagtgctgaatacttttttacatgttttcataattaaggtcctaaataacctcacaatttggtaattaatgtagcaccaactatattctaggtattcttgtaagtttttggaatatatcagtgaattagaagcaagatgggtacataattctctctgtagatgaaatagctgaagccagtaatgttaagagcttgtctaaggccgcagatagaagtgtcagaaatgggatttggaccaatctctctggttctatgctcaggttgtgggaatatagcatgaatttctagacatactcatgttgaggattttttcccttacaataggataataatacctccactgcctgtcatgggcttattgagagagtcaagcggtactctggatatgatggcattttgtttcttcctttctcccactgctctccatcagtactttgatagagcactaatgctctggattaagtcatttacaagtatgactcgtttaataagaaatacacagctgtagtctacagactatcattcattcattgaatcagtcagtctacaaatatttattgaatgctgtcatgcattaggcattgtgctatatatggcagtgacatagtaaatgagagacatgctcattttctcataatccttatatcctagcagaaattggtattaaacagattacacaattgcatatatttgtggtaagtattacagaggaaaactagagacatatttatgtatcttacacctatgcctgttttttaccaagtaaattaattagtaaattaatgaatggtgagaataaattcttctacaaagtcatgactgagcatgggcactctagagttatgccagggttcataatccagccttatgcctactgggctttgggactttacatgagttacttaacctttccatgttccagtttcctgcagaatggggataataatagttttagaagggctgaaagaaggaacattgggaaacagtttagaacagtgcaagatatacagtgagtgcacaataagatttagctattattatttttattactattgtcatgtagcggaacttcacaggcaagttctcttttaaccatagtatttacctaagctgtcaaccttctttgaagggtttttttttttttttgaaagaattgttcataaacgagtatgcatcagaaccaactatggagctttaaagaatatacatgtttagctcctattgtgggagattgttattcagtaagtctgaattgagctctgcttttcagaagctccacagatgaccccgattcacacaccaaggtaaaaacggatggctttcaaatgacacagaaaggagatttcacacatggcagggaaggaatgtaaactactgacaaccacccaaaggacttttctctgtgtaccttgggtgagtattgatagctacttggaaaaatgtgatagtaagtaaaacagtaaatatttaagtattcctgtagatgctagttaattcctttttaaatgggattgaattttagtactttaaaaaataccaaaatgattatttgcccaaataagtttgactagactagaatgcgagctccttgaaggcagggatttgtgtcagtttcacagatatattggtaaatgtatcagtaaataagagtgctcaataaataagagtttaaataaattgaatgaattttgaaagcttaagatatttggggaacagataagaatgattaattataggctgggcaagaatttttgagtgaaggtagatgaaacgtgattattctgttacttttcttagtaaaatccaagtataggtatatctaagaaaagtgcagacatgtagagaagagatgctaggtgtgaggttgacccaagcatggtgaacattttttggcaaatatgaaggcagtctcctgttgttatttttttttttcacctctcaccctacttccatgatattctttcccagcccttaactcctttccagttagttaaattccatttatttatttgtagtaacatgcaaaatgtttattgcttttgctttttaaattctgactgatgctctctgttatgtagttaactgtggctttagaattaccaggaaaaattatagccttgagggtccaggagattaaagcctaacatctcaggtactttgcagtatattctgccattggatctctatgggagattttcaacaagagtcaggaggagtttttttttcttttctatgtagttttatataattgtgggaaaaaatgtcttgatgctctaaattacagacttttgtgttacttgttctaaggccacttttgttatttcaattggtaagccaagaatcttaaattattatctgggagtaatttaagtcacttttgtatcttgtgttacagctgttaattggaccacgtttaagatcagcaaatgctagcaaataaatactgtattttatatggaaaactatagaaataggggaaatttccataattgttagcagagccaaaaaacttgggccttgcctgataattagctgcctaaattcaaaatatactgcatgacacttactgtaaaatgaacagtcttttcagaatcaaaactgactccccaaatttaagaggataaaaatcaccaacatgtcttaaaagcatggtttgtaaattatttctgagtcagcattttttgaagcctcttcttacagatttctctaaggttgcaaagtcatcacataagagtcagcagtaaaaaaaaaaggcatttacttcttctggtatataacatttgcatgctctacttgccttttagcagcttataatcagatgctgaaaacatattcacctatagaactgggtaaaaatcaaacccataggtaggcatttaataactgtctctttctttaggcctgtttcagtttatgttgatctcaaaggatatttagcatatatgtgccattaccgtgattgcttttcagctttaggataaaagtcagagtctgactgatgctccccagggttgccacaggtggttgggcatgtctgcactacacgtctcatgacatggtagcctggtaaatagcgccctctggagtactgtaggacatagccagagtggtcatttgtagtagccttgggcatgcacaccattcattcttgtctttgctgctgactgagcatcttctctacgcactgtgctaaatccatgtagaaggtaaaagtgatgaatttcacttacgagctttattagaatttaggtaatatattcactttcctaaattgcctatacatgattaccatactaggcactcagtttgatcttcagtgaacaggcaaggctggttgttgacctttgtatgtaggtataattgcttaactgcttatctgtagttcctgtttgcaattaattgcccttgtgcaaaagtgagcgtctcaatttcctgtttgcatttgtgactgaagtctatgaagtagctttattattgtttcattcagtacatattattgatcatccagcaaataggtataaaggggaagatagaattataaagaattataattcttatatcattgctttagaaggctaagatggtggatttagcacatgtatcatcatatgtgtaagcagatacaaaagactggtgtaaatttctgatataataagaggtcttacttgctagacatgtggatagtatggcatagctcctaaaaactaatttttaaggagacgtatatatggtcttaatagatattattcagttcagtacctgaacctttttgccatcagccaatttttagtctttctttcattggacctcctgagaagttgacactccctctttctttcaatactttcttcccttggttatcaggataccatgctcacctgctttttccttagtttgtggtcctttttacttagtctccttggaggttcttctccctcttagagtgtcccacaatttagtccttagacttccctcctctatctacattcactgcctttggatattttccctattgtcttgttctaaaaattgtcttttgtgagatgattcctaaatattctcatctttagcccggtcctttcctctgtccagtctcatatttctagttatctacttttctccatttgcctgtgtgagacacacctcaaatttaaacatttccaaagccacacttctgaccttccttcataaatctgttcttcctactttgccttccatcttattacacacaactatattcttgacatctcctttctattttttctccatcctgtacacagtctgtctgaaagttcttttagctctgtctttaaactatgcctggaatttgatcacttctccattccctgtctgcactagcccttccactaccttggctggattattgcagtggcctctatctaaagtgttctctggcttccctctgcccccattctcaacccagtggtcagtgtgatgctggtaaaacagaagtaccaccatacagcccttctgctcacatccctctaggagcttcctttcccactagagaggtcaagaggataagtgctttacctcaactccaaggcctttctgatcctttgcctgttatgcctttatgtctttctgatttcaactcctactcctgctacccttgttcattcacctcagcccctctggcttcccttctctttctcacacatgttctgtagtttgtgtcctttccagccagccagcctgtcacccacataattataccagccctgaccttctgtgtctgtgtttagaagtcacctcctaagggagaccgtctctgaccaccctgtgtgatagctgtgtcccccaaccctcaccacttcccaggtgcttgttatcacccctagattataatctccattgcacttatcattcattgatacactttgtagctcagttttttttatttattagttatctttctgcctctttagagtgtacactgaaggaggggagagatgtttaactctttttttcattgccctatttccagtgtctaaaacaatacatcacatatattaagctcttggtaaatacttgtacacatattcggtaacgatttaaatgttgactaagctcctctttgatgcttttttactaaagctgtctaggtgaagaaaactgtctggtaaccatgtggctgggatttactcaaaaaacaaacacaaaagtcaccatgcatctcagtatgcatccagaagcaatttgttcttaaggtgccttaaccaagagcctctatagtgatgtcaggaatcatcatccctattgctgtctaaagattatctcccctaataatgggcatttacagagcctagagagttatttctcttacagaaatgtaattttgtatttgtctcaccacttccttctattaatgatgccaacatgtttagttaagagaatggaatttggagtttaacttgaggcaaatcatttctcacctgtctttcttctgaattcagatcaaaatgctaaattgcaggtataattaaaggggggacaagaaagactaagaaaatggctgtgtgctgttgtttcagttttgaatattgtctcattgctttctaataatttagctcttgttaatatcaacaaagtaaataaatcataatgttttggcttgaacccaaagtagctttcaaatgtattaatataccctaaggaaatatacaatgtaagtggtaaccaacaaatgggtcttcatattgttgttgctttggaatccttagaggtaaaaagtattttatccgtcttttaaatgatgaactaaatacttttcaaatattggcttcatagagtgtaataaccatatgaaaatccaaattaacataatatgttctctccagaaataaactgtacaatgtggacttaacgtggcagggtgggccacttgcaaacatgacctaagcaatgagaaattgaattcaggaaatttagttttcttttctttttctcttttctctctgcctttttgggacaactttccattgagggagataaaatattcaggaaaaaatactctaaggagtcaaaagaaatttgtttaaatgagtaaacattaaatctttgtgttgagactgaattttgcatgataaaaatctgctttttgggttggaggaacggtgcgttgcactgctctcatgggacaattgtgtaatattttggcacgaaaatgggttatcagacaccaaagaattgtgtacctcagaaaagccaaagtaacaattggtttgaggtgaaaggaaaatctaagtgatgaaattcagagtctggaagagaatatgttggtgtttgattgggtgtagtgggaagaatttctttgcctaggagtacttcattatctaaatggttgttgtatatgtttcatcctaaaatacttttaagttggaatgtgcatgcaaattcaagtttatcttcttgaaatctgctaaatgaatatatgttccatattttatctggttgtatgtattctaattgatcccttatgacttaaatttttacttaactgatttagcaagtctaccatcttctacctttgatcattccattgctgtatcatccatctactttccttttaactaaccaggtaagactaatcttatttaacatgcaaaccacttctgttgttatatagaaaattttatgtagtatctatggcctggatgtcactaccaacaaagccaatggcagtttgagtatatctcagtaatgttatctgataaattccttttattttcatgtaaattacctattgtttcataaaaggctgctttgtgcttgtatatggccaattctcttgaaaggttagtacattttattgatgtacacatgtaagtattataatatttgaacaactacttagacatcaaagcagtttcagatgttcaagggtttttcttttattcttgggtaaagcaacaagggaaaagggtttaatataaaaattgtataagttgagaatgaggtctgattggttaaaaggttaggggactgtatgaagcacattaaaggttaatgttcagtttaagtttgtgtctgtctgaatctgtcttaaagattgtacaggtaaaaaaatagacatagcaaatgttttactgtttgtacaaagaataattagtctatatttaaaaatggcattatttcatttttcaatgtttgggaaaaagactgcctttatggaaggagaaatgtggaatgtctgtcttcgtttgattattcttatttttaaaccatgtgcagtatcccttacatcaaaaagagatacaaagaaatgttttctattataagagtcatccaacatgaaataaactgcttttgctgagtttgttgctgttgttgttattgctgcagcagctgctgccgttttgtttaatcgcagattccatagagcataaccttctttcaggaatcatttttttagggattcctgtactggatagactactgaacaaaatcatcaaaatctctcctcccctacccagagtcagtgctaatcactagattatagtaaaatgatgaaagaaatttaaaaattatatatgtatatatgcctatatacatgtgcaacattggcagccctttatctctggtagaaccattttttcttctaagttttttggtggattaggtatatgaacctaatcctattttaattatgatagatgctattggtttaatttaatgcctttgcagagcaaaagaacatactgacattatattttcatctgatcctcactgccctctctctgctgtgggggatattttactggtccatgaaatccaagtctgggaaccactgaagtaagtgatctcaatggttatttcataatcattctatgtaaatctacccaattaacagattttgcaacggcttttaattgtatagagccaggaccctaaaaaaaaaaaaaaaaaacttaaatcccattatttttagaaatagcaagttatacagaactgataggaccttataggggacaagagggagaggagaaatcaaaacaattgattcatttaggaacttcttattgacacatattcaacaagtatttgaggtattattatatgccaagtactgttttaggcacttgggatatgacagtaaagtttctacaaagttccttactgtcttaacagtagaagacaaaacataataaatccaataaagtataaataagtaaattataaaagatgttagaaggtgataagttccatacaaatagaaaattgtatggggtgggataagggagtggcagggtgagggtgggtggaattgttaagtagagtggtcagaataggcctcattgagaaggagaggagatttgagcagacttgaaataggtgaagaggtagctaaggagacacccagaggaagggctcttcacagtgtgaacagctggagcttggctcccagaaagaaatattacaacatcaaggaggcaagtgtgactcagagtgagcaggctgaaggcagtataccttattgtggtttctttcatagtattgctaagagtctgtcatcctataaaccttgggttacttcatttgtaattaatgggtttgttttggtaaaatttaaacttgagtatttattaacgctgaattagattaaattatataacatactgcttatgctgctcatgaaaggaacaacgtttttaccaatattttcttccaattgtgttccagtggacgtttataggtggagagaatgaaggcctggatgtgaaattacagatactagaactctgtcatgtggccaggcacagtagctcacacttgtaatcccagcactttgagaggctagggcaggcagatcgcttgaagctaggagtttgagaccagcctgggcaacaaagtaagaccctgtctctacaaaaaaattagccaggctctgtggtgaatgtctgtaatcccagctggtcaggaggctgaggtgcgaggatcagttgatggcacaggaattcaaagatgcagtaagttatgattacaccactgcactccagcctgggtgacagagcaagacctcgtctctaaaaacaaataataagtaaataaaaaataaaataaaaataaaactgtgtcttataccaacttccacctgagatcatgatagaaatctatttattcatgataaatagctactggctaagcctttggccctaaacctcagtatagtgcctgaggagctagaccaaaccaaatgtaggactctgttctgattcccttaagtgacttaaaaataatgtaaaattggctttacttatttctacccctaaatcaaccagaaactttaaaccatggtgtacctatcatatatgccagagcaaaatatgtatcctaacacctactgctgtgcttccataacccagcccagggcttacgcaagtgtgaagagtagaaagagaagagagggaagcagaataaaaataaggatgaacacaccttgtccagatggttatttaagcctggaagaaagggtgggaataagaaaggatgagagaatattctcttgtcctcattaaagcctacatcaagcaattacagagaccacactgtctatgctacatgcttttgtgatctctttaaaaataccactactttgacttgtgggccaatgcatatcctgaattgatagattcagatcattagtttttcttgagagaagggacctcagggcgaacaacaacaaaagccccagatatttcacactgaaaagagttttaaaacaatgaattaagtatcttcaaaatttttagaaaaagcagaggaatatatcagttcaggtttcttgttgctgttgttccctctactgcaaactgtgaactggagtccaggaaactgccatgcacaaatgcaggaaatgcctgccaaagctgtaactactccatagcccctaaactggtgactagaattggaatatggaattgccagttattaaaaagtttttaccaaaacctgtagtcagtagccatgtcaagtgctggggatggatgacttttaccttcctttgctttcagctaatcacatgatgtgagtacatctccttggctgaacctaagccttatccagaaccctaatggcaagggagtctgggaaacatagtgcttcagcttccagctcctatagctcagagagagtatagaagagtgtggtaataaatgctgactgacaattaaggtttctcaaaggcatggccattttctaaatgaagaagtgaaattaaatcaaaattctcatagggaaaggatgagtcaaatttgctggtgaaaacttttaaacccagggcaagatactttaaactgtatgtaattagcgtgcatgcatatgtgtttggggactccatttctttgagtggatcaactaagaaattcattgtcaaatgttgcacagggggtcacgtttatattccacaaagtgtcaaagatgcagaaatcagttctatacctgatacatttccctttatttatttatttatttatttatttatttatttatttatttattttgatggagtcttgctctgtcgcccaggctgaagtgcagtggcgtgatcacggctcactgcaacatctgcttcccaggttcaagcaattctctgcctcagcctcctgaatagctgggattaccagcacccgccaccacacccagctaatttttgtatttttagtagagatggggtttcaccatcttggccaggctggtcttgagctcctgacctcgtgatccacccgcctcagcctcccaaagtgctgggattacaggtgtgagccaccattcctggcctttttttgttttggccagagtcttgctctgtctcccaggctggagtgcagtggcgccatcttggctcaccacaacctccccctcctaggttcaagtggttctcctccctcagcctccccagtatctgggattacaggcacatgccaccatgcccggctaatttttgtatttttagtagagatgggatttcgccatgttggccaggccggtttcgaactcctgacctcaggtgatccgccagcctcggcctcacagagttctgggattacaggtgtgagtcaccgcgcccggcctatttcactttttttaacctcgatgtggactatcaaggtaaaatttttctatagaatgtatatatagccaagtcaaatgtctgcctgtgacaaaatgatcactttgcctgcttttaggcaactcctattatggtatgctagtgtagacactggccttccctgttcttttggaaacaaatgacttttctcttacacatcaactccatctgttctttttcctgtattcttctgaaatttgcaactttacttgaatttgttcagaattgtttaccaagtattgtaaagctctcacctgtatgtgttaaaaagagattttagaattgtgtaaaatcctaattgccaaccgagcatttttttatgtctgtatttaaatgattcttaggactgccagtcttctagagctaatgaatcctttcccatttggcagcagacagcttactgccaacttcctcccatctgataaatgttcccataacaacactaaggcagtctgcttagtttcattaaataccaaaattatagcctgagaaaaatgtataatgtattataccatattacagcaccttatgaaataattcatgagtgattgaattcattgtgatagggagaggcttgttcaaatactcaataaaaatgttatagtcacactttgcttaacaacagggaaacatcctgagaaatgcgtcatttgccgattttgttgtgggaacatcatagggtgtatttacacaaacctagatgatatagctgatacagggtctatttatataaacctagagaatgtgatgtagcctattgcttctcggctacaaacctgtaccacgttactgtactgaatattgtaggtaattgtaacacaaaggtaagtatttgtgtatataacatatctaaacatagaaaagacacagtaaaaatatgatgttataatcttatgggcctaccatcatgtaggcagcatgtccttggccaaaaccttgttatgcagtacgtgactgtatttctttgtagaaggaagaaaaagaaacccttgaaatctgagtcattattttgaacttcaacaaggattcagattttgtcttgatattagcagatctaatatcccaagtccattttctctacattcctaaaacctagccccttattaccaatttggataccttcactcacatacatattctaaagaacatcttcatttgtctgattaaaaaaatatttttaaagaatagttatactcttgatatataaaaagaagaaatagctattgattcatgaaaatcactatcttttagagtagtgtaagggtgtttgctacttgagagggtggatatgcttattctaagcaactccagtaacaccttgacttcatagaaatgaaagaaaggattattaataattttgcaagacttgttttgcttctcgagtattcacatagctatcccatagagcacactctgtgcatttaccatgatcggactcccacacattttattaatgcataaatttgaaattattgtttttgaccaagttgatgaatattaaagtttgaggaaactaaagaaatcacgttggtcattttcctgcttcttcagatgaaaaaatgggggcaaaaaggataagttatttccctaaagtgagccaaactgtgttggtaaggactagaatgacttatatcagtggtcgttgtcaatggattttccatggggaagtaaatgtacgtacttgagaattttgttagcgacttcatcattgcagtcactataaaggtttgtacttagcacacttctaaattgtatggcacatgcagttcaagatagaagtgtggaatgtagcaggcgtgcaccaaccatacttttatattttactttctatttcacatttttcttctctactttcccaaggtagttgtcaccttatcctagcttgattattataatgatgcatacatgaatattttttctattgggctattttcagtaagaatcagacagaatattttatagatagttcacgtttttgtaactttaagaataatactgaatactgcttccagcaatggccccatttctgtgtacagatggttttgatgtatgtatttcaggtatctgaagcaagcagaaaaaggcagcgctggttgatacctattttagaatcagccctacatccataaatgtatatttttgaaagatttatttctggtattttgcaatcctgttataagactatattctgtgaatttttaaagtagtgacaatatagcacataggatgggaataattttaagactaggggcattatgaggatttctgaatcagttttacttaataaaaatacagctgttcatttagatcattattaaccattaataaagctgtctttcttttgacaccagaaagaaggccagtctagttcactcaagtgacaaaacttctggtaaaaaatctgtcacagtctaaacctgtttcttttgggtggaagtgttgggttactgtaaaatccctggtctcttccccttagataatgtaaacccagattaaatcagaggctggcactgttcttatcctggggtagggaatgaggggctggggaggtgggtcagtgggcaggtatggggtaaggagataagagatagagggaaaaaactggtgagtacctagttagagcagcgtggcctgcaggaatagcactggcctctgaatcactgtttttttagaatctacttcttttccagttccaactttctaccacctaacgagctcttcttgggccctgcggccagactgccaggattggttcacatcttggctgactgtataacttgctaccttaagaattttggccacttacctaaaactcgctgagcctcagtttcctcgtctgcataatggaggtaataatagtacctttcttagggaactgtgaggattaaattagccaaacccccagaggaagctaagtcaactactattatcttggtttaagtttcttaataatttttgagccttagttatcttcattcataaaatggagtatcgtcactactgtgaagattaaataaaatggatgatattggttaaaagtacttaataaatgttactgagatatgaattaacttttagctgattaaaatgctttaactattatttgccattgcatcaaatatttgaataacaaagcttttactatgtttggtaaactgcaacttattcataggattcactaatttgggtattgaataaccagataccaaacaacaattgactgactcattcagatattatttatgggcaccagtgataggcaatcacagtagaggccacagttgaggtcactgaggccccaaaaacctagacctgccgtgtggcacctagttttaactacgctcatgatttctcatctgacatttaattataatatgataccgaggcccaaagtcctaaacgtggaaactgaaaggagagcccccttaactcatcttcatttgaacctcaacaacaaaaaattaaaaaggaaaaacagttgctcccttcttaagtactgccttttaaaatgttcttgttgcacactgcttcaacttttctctgcccaccaggcttccatttgtgatctgtctgaaataactatttttgcataacacattctttcttcgctgctgatcttccctggagctgctgctgcttcccgtggggaatacagatgaggctggtgatgcaccaggagcaggccaggggactctgagatgatgactctttgtcattgtgaataattctctctgaattctcgggtttctggtgggtttttcttctttcttttcatcttcttggtataaatctagttttaattatttcacagaatatttgtctttctgaaagcttctcgtgcaaaacaaagacaaaacattaacatagtaaagttattttatcagtagcctttctctgtgttaattaggatgtatatcaatatgacatcattattttcattatttaaatgtactaaagtttaaatacttgtagcttttagacatgaattaaaaatagaactattttgaaactggtcatgaagactgagaggtttttttttttttttttttttttgcctcctaaggaaccgtttaggatgattcataaagcattttctgaaataaaaggcagaaccgtacaattctgattttaaaaaatcagggaattagagtacctcagtcttgcagctttaaaagagcagaagaaaaaaagcattgaacaaactttacattctcttgatgggtttcaaagaacatcaaaattatctaagtcaattctcttctgccagacaggagttcacttgcatcatcagcctttaagaactttgattcagcgcacacagacaccagtctcattttccttgtactaggttacctctaggatttctttagcctactcaaggcactgccatcctccctgtctcccaggcttgaaactttagagactgtcttcatttcttcttttcctcgtcccctttctctagtcagccactaagtcctacttttcatttcaatgtcttttgtgtcagctttctctttttcctatttctattgtcttcttcttgacacaaatgcctggaaggtgaaagtataaaatatcttgatattaccaaggaattaatgtgtggaactttcacaattaaatcactactgtcattactatccaataattcattgtttatttctacacctgcagttgcagtttacctggaggtactttgcatacagaaacatttttcatcacttactaagtgagaataggaccctggcctagggggaaaaacaaccacagacaaaccatacttccctgagaagcaggagcatagtgctggctagtgaattgctttcacaaaccgacctcataactctgtgccttagaaaaattagaaatgggaacatttggagatcacttgggaaaacttgaaattatgaatgttaatctgtgattgctaagggaacgtggtatttcctgcctattttgtctgtagtttgtctctttctcttctaattcatttttaaaactctgctagattaattttgctaaaataacgttttgcactcctcatttcctgtttaaaaacatgtagtgactcaccatcagttttagaaatcgatttaaaggacttcatgaaactggtttcaggccacccacagtttggcccatacctatctcctgttctccttcataaacctttcaaatctagccaaattgctttgttctttgtccctggagtatggctttctctttctttctttctttcttttttttttgagacacagtttcgctcttgttgcccaggctggagtgcaatggcacgatcacaacctccacctcctgggttcaagcgattctcctgcctcagtctcccgagtagctgggattacaagcatgtgtcaccacacccagctaattttgtatttttagtagagacggggtttctccatgttggtcaggctggtctcgaactcccgacttcaggtgatctgccggcctcagcctcccaaagtgctgggattacaggcgggagccactttgcctggcctggaatatgcctttttctattgctgtgctttattctgatttttgttttagaatagctttcaaatcttattctgtttctttaatctctcttgtgtctctctttatgccttctgggcttcacatggggactggtgtggttgtaaaggccccctgagttgagatgtggaagcaccctctgttacagagtgagggattgactcactgaaaagaactattcaagtcattcctgaattgcttacctttggtacttcttgatttagtaaagtagatttcctgttttcatatgaaaagcataattgaatcatagagcaggtactaggaatcagactgtctgggtgtgaaaccccactctgacttttactagctcttgaccataggcatagtttccgtatctctaaatgcatgtaagggtccctgtctaccttgtagggtggttgtgaggataaaaacaatacacagcacatgataagagctcaatgaatattagctgctgcctttgttattcgtattcatattattgtagatattttctgatgaatttgatactcgttcaccatttacttcaacacatttcaagttaaaagatatttcctgctttgagaataaaattatttcaagttaaaataaaaattaatctaatatacccttaagtagtaatgaggcatgtagttagtgcactgaagtagttatgtgcttcccaaagtgggaacttaaaacaaaaaggaatcttttaagcttaacaattccttatgttagtcatataattatcccttttctcagaagcctggggccaaatggatctgttcctaggagaaaggaactgtctctcctggcttaacaaagattcagtttaaaggctagctaccctctgagtcatactgctttctgatcttggagtgcttgcctctgtcccatgagaaagaaaggtggatgaacagcacttgcaggaaggaactttcatctttcttgaagccaatccaaggcctcagatgcagaaagaatgcctaccttacctcttcaggggaaaaggggtttgataaaggtgctctacataatgcgaatctgttttcattaattcatgcattcatctactcttttattatgcattcaattcctcaaccatttattgagtatatacctggtgtcaagcactgtgctagctactggacacgtcaaaaggaaagaatgagattttgtcctctgccttgagattaaggtagtttttttgtttgtttgtatgttttaacataccaagtccagtgaaatcttaaaatattttttatatggctgggcgcgttggctcacgcccgtaatcccagcactttgggaggccgaggcgggcagatcatgaggtcaagaaattgagaacatcctggccaacatggtgaaaccccgtctctactaaaaatacaaaaattagctgggtgtggtggcaggcacctgtagtcccagctactctgaaggctgaggtaggagaatcgcttgaacccaggaggtggaggttgcagtgagccgagattgcaccactgcactccagcttgggtgacagagtgagactccatcacaaaaaaaaaaaaaaaaaaaaaaaaaattctgggagtgaatgtgttctgaagcagatttacatttgctaaattccatgccaggcagaacaaatgtaattcagtgcatatttgaaattcataaaatggaagtacttgagtagttggagaacctgttattgaggtgaagaaactcaatcataattagagtcataatgattacactgggtagagtctaagcagcaatttctaaaatccagtgactctctattatctctgtgacaaaatgttggaatttaaatattacttctggaaggccaggtaatttttagatgtgttggaacacttttattgccccatagcatagctttagatttttttctttatcccaccctttccaccaatctgggaaaagaaccatttccaaattcttgtacagagtaaatcacgtgctctttaattgttggaactaattttaaattttgatactgtttataaatttactagtcagaattctgttacttgatatgttactttgggtttgaaaatgtttctcttttttattcactggtagaatacctgacttttgggagaacagcaaatatttcatggtggtaaacttgttttaattagctaacaggaccattcacagtttttgaagcattctggccaagaagtaatttagagtggaggatagaactattttcttcttgaaaacaagaaggcaggcaagcagtgttcataaggatgacatatacaagcaaatgtggtacttcataaaaaactgagttggttctattgttaagtagcatatttactccttttgacttggaaatttttttcttttaaaagtggccatgggctttatttaataacttttaccagagagcagcagagaaggccatgcatatgtccaaatgtattgtgcttttttttttctgtagaatccacatcctgtacaaccaaatgtattgtattaaaaatgaactgtgatagtaacttggtaacattgcaggaagtatgcctgagcacacagtggttctcttaatgtggttctgagattttcatgctgcttgtctttgttgacttaatcccactaggaagaggtcttcataaaattcctttttgctaggtagataacctgtgggagctgtttgttttttcctaagcaaggagaatacctacttgagtgctaataggattcttagtttggttttctaattggaagccctaattaagctctgacaagatctctttttgttgatattttgacaccctctttgttgacgtgattctttgttcaaagatcttttagcagctaaacaaacaaatgtgaggtgatgacaataattttatattccatgtaccaagtgtttatacaattctactttgccagtagtatatagtatcttcagaaatcttgaactatatgtgtactgttgaaatgaatgttattaagaaagatgaaataaacatagtaatttattttttgctgatagttgaacttagcaagttctattgttaagggatgtttatttggtataatgtcatgctttctttaggttccatgttgagaaaagcctgaattcttttctttaaaataatgcctgcctcattcagacccacacacagagtttctgcacatacaagtcagtccactgtccctacacaaaaccctttaatagcatctctttgccctttggatagaatccaaacactttaccgtcctaccacttcaccccgaatgctcagaggactgctttctgctttctgctttcttctccagccttctcttggtcctttccccttaatctccagactctagatttactagatacctaacatttaatggaatttgttaagctcccctttgacccagataaaccttactcaccctttgggtctcaaattaaatgtcactcctatgggaaatctttatcgacagaagtataccatctaatgctttcgcgttttttttccttttcttttttttagtgagactagtacacttagatttacttttaatcacacattcagtggcctatgttatctgtgatctttctagaatatatgtttatttcttgcaaggactgtttctctgcctctttcttcattgtgtcatactgtgcttgccccatggtaggttatcttaaatatttgcagattgactggttgattggttgataaggagaaagagttgtacaaggacttaatggcatgatagagaaatctgtttctagtaaaatttactcaagttatgttattgcattttatattattttctgtccaaaatctggtcttacaactgccaattttcttactttgttagtagcctatgacattacatgatcttacaaagtaaaatgtctttattcagcacctactacattagaatgtgatcatttggacagggtgtactgacagcttttagaggtaactcataaaaagaaaaatctttttcaaatatccaaaagcattatagatgtattattttacttacaaacgcttctgctagttattctcaattactcttacctatttcttatcaagtttcataaggatttatgttaatacatctcaacctagatcaaagtactatatgattttccaaatattaaaagtgcatttttatgtctatctaatcattaatctatccagtcagtgctttttaactggaagaataaattaaaaacatctttaatactaaattgtggatatttagaaagaaatttagaatactacctctgctttcttcaaatattcggaaaaaattcttaagtttcaaatttgtagcaactcaaatctgcaccatacttctagttatgttgaaataatgaggtttttctattttgtatttccagaataataaaatatttgcatatgtatagaaaaataggaaacttggctgggtgcagtggctcacgcctgtaatcccagcactttgggaggccaaggcaggcaaatcatgaggtcaggagatcaagatcatcctggctaacatggtgaaaccccgtctctactaaaaatacaaaaaattagcagggtgtggtggcatgctcctgtagtcccagctactcgggaggctgaggcagtagaattgcttgaacccggaaggcggaggttgcagtgagctgagattgcgccactgcactccagcctgggcaacagagcaacactctatctcaaaaaaaaaaaaaaaaaaaaaaaggaaaccttggcttagctaaattttgggaatattctttatcttttcctttgttgaaaaatgaaatgagagtaaacatttcttttttttttttttgatacagagtcttgctttgtgacccatgttggagtgcagtggtgcaatctcagctcactgcaacctccacctcccgggttcaagcgattctctgcctcaaccttcagagtagctgggactacaggagtccgccaccacgctcagctaatttttgtatttttagtagagacggtgtttcaccatcttggccaggctggttttgaactcctgacctcgtgatccacccacggcctcccaaagtgctgggattacaggcatgagccaccgtgcccggcctgagagtaaacatttctatatggaaatgaatctgttgaacctcattcagataaacaaatgaatatttggccagaacaatgattattcaaccattatattcaaatcttgactgaaggtccatggtcacggtctgtgtgccattgatgaagtagcactttataaaaagctgtcaatgttaaaagtaatgtttaatggctaatgttaaaaatgaagttatatgattctaaagtcttcttatgaacttaattttgagatattataattaattttaaattttgattatacctttttcttttcaatagacctttgtggattacatgtaatttatagcatggtagagtgggcctagaagagacacacatgaaaaagtatggttatgtcccctaaggactgggactttaggagactgaactaatgtttccccaaataatatgtcgtatgctgtgatagagtccaaaaattagatgaaaataaagtattatgtgagtgccaaggaggaagcgattaatattaatttgtagaatcagaggatgctctgtagagcatttagactttattttgcttctatacagctttattaactattctatactgtgtatcatacataatgctttatttagcaatgttttcatttcagttaaaaaatactttggtcccagtaggttaatgaaaataaaaaaagattacaactgtcataccagtctatatcattatattctaatagtgataccaatcattacataaagtggcttattctcaaagcagtttaatacatgttctctcactagcaaagtgaggcaaataggatgttagcttcatttaatgaatgagaaacgtgaaacttagaagtgttgttagtaaagagcaagatctgttttacctatgtcttctattgccacacagagctctcttcacactgcacaatactgcctagaattctcaaaatttcaaagcacaaagaaagcttaagaactgttagcggtacaagaacagaatttggaagaatcatcagacaatcagacctaaagacctaggaagaataaactactaagtatagtattttgacatttggatttttaataatgatgggcctattctgaatctttcagtttcctctaacgttctgattattttattccttctatttcagtctttatatagtggggtgggtgaaagtatgtatattatcattctactcaaaatattagtgtgggtagtgtaggccagaagtcaaaaacacagactatggagttagatggcttgatttcaaatcctggctccactttgaatagccctgtgactttgggaccactgtactctctctcctagccttagtttactcatctttaaaatggaataacagctgtatgtgggcagtaggattattgtgaagttttaaataaggtgatctacataaagaccttactatgtggttttgctcattgcagactgtcaataacctagccattgttaggataatgatctaatgagatagctgaaatcttgagagtgctattgatactacctttgtctgccacttaaggtctaaattataatttaacaactgtacctaataatttgtgagtgtttgataaatgtttgaggaattaaaatattaggcttgagtttgcactgctcagttctcaactgttggttagagaaaatcattaagttgagagacttaatgttggatttttagtacctaatacttcagcagtgtgtacaacacaaagacaaaacaaacattgccattgttttggttctgatatcaaacttattctagcaaaattttttaacttagattaatgtttgactttcaccttttcctggggttgaactaatacaggatttgaaatgttaatcttttggttatataagctagagaatgaaaccaatttcttttgttattttctgattaatacatacattggtttgttaacctggataatttgtctaaaagtgatgttttctaacacttaggagaattatgtgataaagcatgtgaaggcaaagccaatttgtttaacttgtagcttcttttagttactaatgttgcaatgcatgtgaagaaagatggtgctttatgcattccaaattcaattttatctattttttatcataagcaacttctttagagtttaacagtttatgttacatgtgattatagcttcaaatacataattgcagcattttcaatagcattttcaaaaatactgattcctgaaaataaactttttgttactttttaaaatataggaaacttcaacaagacacaaattttaaaaaattatctttattcattaatatggcatgctagtaaagaatgtaagaacaatttctgtgatagactgctttagaaatcagaatatattatgctttaacaatttttttcctcatttggaatctgataataggatattctgagagatttgccagctttactctttttaacaaacatacaaaaggtgtcatggtaacatgtttgagagaacctttgactcttatctttcactaaagccttacactccttgtcctttcctgggtctgatggtacatttaccatctgagataaaagacatgctcaggcaccaggtctcttgggatcttaaagcactatcggaatccaaagaggtggcaatccagcttctttcttgttactttaaaatatatatgctaattcgatcgggaattcagctcacaaaagtaaattaattattctgccttaagaaaagtatatcaagagattaatatctctaagaaattcactatttgtaagtataaaaaataaattatggtaatgtttcttttcatggcatctaaaattcctgtttagaaagataaattagctttcatgatcaagacattaaataaataaacagcctaactacggcaactgagttaagtgttttaaataattctacgttaaaaagtgatattgagaaactagaaaatgtcacaaattttaatgggaatacttaaattgatataattattttaaatcatatatgtaatttaatattcagataattctttaaaatccatattcacccttcttggctttactttatatctagctcaaaggaaacattttttttccaagtacattttaattcagtaagaccagatttttcaaaatatcatgacaagacttagcttttagtgtatttcagcaataatgataatttcagtgtatcctaagggaaaaactgttatcttatattttggttgaaagagttgaaataaacattttgagagggaattgttattgtctacaatatgtcctagaccagtgaaattacctgattgtgtctattttggacagagacgtggatcttagccacagttacctaactgaccagattttggagttactcaatttccctcataataactagacacttgtgacagctagaaaaaataatgcagttaactttaattttatagtttctaatttgataaatattagctattttacagtataggctgttgttagccacagaggaaaatatagtatatggatatgtggtttgaatctacaaatctgtgtgtgggtatgggtgtgtgtgtgtgtgtttatatagagtgagaatgaactatggatgaacaaggaaaaaattagcaattgtagcaaatgaattgaatgcattacagttttaaaagaatagctcttggagagaatccagattggttcaatttcaagtagcaaaggtaataatatctgtgaattacctgtatgccaacattcttgtataatatttcaatgggctcagctttttctcttcactgtaataggaactctgtgtctttttttagttagtaccctttgatattctcagataaaaggcatccttttcaattctttgatcatacatgacagcaagccagcaaactctcattcatgacatttttgaaaaatactgagtcttctaatttattttaaataattgaacaacatggcaaccttttacagtaaaaagtataaaggaaattaagccagaatttaatggcatgctctaaagaacaagtgggaaattattggccataaaagaaaaactttgaactctaaatccatcattttatcaatttttgacaattcactgtattgcctttaacaacagagtctaatgggaatagcctagacttcgggacaaatctgggttcaagccccagctctgctacttattagctatgtgatctgtagcaaattttaacctttatctgcttttctcttctaatttgaaaaatgaggataaaaacagtacctatctcagaggaatgttatacaaattaaatgagatacagtttaagcatccctaatccagagcttgaaatgctacagaatttgaaactttttgagcactgacatgatgctcaaaggaaatgcttagggctgctgaaccaataagtataatgcagatattccaaatctgaaatctaaaaaacttctggtcccaagcattttggataagggatattcaatctgtactgtatgtcaagaacagtgcctggtagatagtaaatatacaataaaatgtggttcttggccaggcgtggtggctcacacctgtaatcccagcactttggaaagccgaggtgggcagatcacgaggtcaggagttcgaggccagcctgaccaacatggtgaaaccccatctctactaaaagtacaaaaattagcctggcgtggtggtgcgcacctgtagtccaagctacttgggaggctgaggcagaagaattgcttgaacccaggaggcggaggttgcagtgagccgagattgtgccactgcactccagtctgggcgacagagcgagactccatttaaaaaaaaaaaaaagtggttctttctctagtactggttctactactcctaaatgtcctaagtcaagttaattagttcatcctttataaacataggataacactgactttcaggattgttgcaagaattatgaatgacatatgaattatctagcacatccattaccctgttgcctgacacacagaaatacttggtaaatggtggctttactgcaaagctcctacctaatctgtattgttctttgaggtgtttttggataaagcagagaatatggatttcaggcttttagggactttttagagtagcagagactcaattacagaaaacacataagcataggtgagaatattccaacttgcagcatgaatagagaaaaacttcataaacttaaactattctaaatttcgatttctcatacttagatctggaccaggctgaagtttactttgaaaatatctgtgaatcaatggttttttgaactaaataaaatgtgaaacgtagttcaaagggacaagattagcttttaacataatatttttatgattttaagctcataggttatgaacaaaatgcttttgtattcattaaagccagaatctttaatttttagaaatagtttacagccatgtgtcaacttcagtgatgttatttctttttaaatattctatatttttcccactatttacatggattttcttacattttagttaaattctgagtgctttccagtaacatgtaattattgttgggtaagaaataattaattattctttctaattattttttgtaaccattagccattcccactttttccttacccccaactacccttcttagcctctggtaaccatcattctactctctgtcttcatgagtttaaatgttttaatttttagcttccacaaataagtgagaatatgtgatatttgtttttctgtgcctggcttatttcacttaacatcctgccctccatttccatccatgttgttgcaaataacaggatctcattcttttttatggctaaatagcactcccttatgtatatgtaccatgttttctttatccattcatctgttgatggacacttaggtttggctattgtaaacagtgctgcaataaacatgagagtacagatatctcttgtatatactgatttcctttctttttggcatatacccaacaatgggattgttagatcatatggtaactctatttttagttttttggggaacttccaaagtgttctccatagtggttgtactaatttacattctcaccaacagcagacaaagtttccttttaagattttttttcctgaaaacattatatatagagcagtgttttccaaaatgtgtacatcacagtccatgagaaatgaaagcaggttattgtgtcaatctagtatttttttatttaatgccaagaactagactaggaaagaaaatacgagtttactataccaatcaaagggaagtatttctaatttttgtatttgtattcatatatgtttataatggcttatgatgtaaaatatatttctaagcttgattagtgatcaaataatttacaaaagcactgcctaaagcacaaaaccttgcataaaatttgcattgttcagagattgtggcataggaaataaaatatgaaataggttttctttaccatgaacctcagggaatatctaacagtagattgaagtggactaaatagaatatcattcttctatttagctcagaaatgtttgttgatcatttatatttataggatctagagtcacagggttaataaatgtaatatctgcccttagtggtatcatagtctcctaggggagacagactgaaatcagtctattataaaaattatgatgcatgtgtaaagcaagaacaatttgcagggaataacagacttcaaagtgaataactttgtgggtacagatcaaaaggcagtaacttctgataaagattttgaaggacaaatagcagcttaccgagaccaaaaggggctagggaaagagcattctaggcattcaaatgtgtcctaaggagcagagggatgttttagcttgatatatttgcaatactattttccagctgagggaatgtgccaggagagagattggagagtttgtcaaggaaagtcccctatgctaaggataagtactttaagcttttagtatatacgtatattccaaagggtatttagtaaggaaaagacttgatcctatgtggtatatgttactattatgttttattcacttggacatgaatctgaagttagtgctggagggagcaaggctgaaggcagaaattccatctaaacttcatgtaatggtccagacagcgcttgaaccaagacagacatagtggcaacagcagtggtggtaaagatgataggattttaataaatatttaagatttggggtctaaagaaggagggtgatgagtggaaagagaaatctagaatgattttcagttccctggtttatgtgactggtttatgtgacttgatagatggtgatgccatcatccaagacaggatgtgtatgtaggcacaagtttgggcaagaaggcaatggattcattttaaatcggctgaatatgagcattttatgtgacacctaaatgaaaccacccagttgtaacagctgtttgtaatttctctggagttcatttgggagatctggtttagagacaccactctggagctatcattgtgtagacagtggtaaaatcatgcaagtggatgagattacaaagccagggataatgcctgcaattaatgaaaaatcaaaggaagtggggccacagagattgagaaagaacaatagtctagtggaacctgaggagaggtggactcaagaatacctgctgggtttgacagttaggaagtaactggtgcaatatgtccatagaaatggaatagaatggcctgggacaaggccattatgattatagtgaatcaagagtgattagggagagtgaggaaaaggaagatactcagggtggactagtctttcaggtagcttgactgaggagctatatgacagtagcaacagagaatgagagagacaagggaaaactttatgaccatggaagacattcaagtgtttataggcaaagggaaagaaaccatttgaaaagaagttagaaatagaagaaagggagtaaataattgatgatggagtgtgatccttgagaaaatagtcatgagaatactagcagactgattagctttaggtaggaataaagaccttctgagaccataaggaaagaaaaagtatgaagatagaaagggtgacgtgacataggaagtagagaaccagaaaacagagaatgtggatcccagcccactttctctcttacttgtgtggtagaaattaaactatgtgctgaaagtgaaggctaaggagaaacctggagatggtatagaaacctcctgaaagggtggctgggaaagagaactgaccagagacatggcaaaaagtagagtgagatcagcacagggattaaggtatatagccaaagaggccttgcacagtccagttccagaaaatgccactcctcacttgagtattgttgcctccctgatcattaaatattagcaaaaatactgtaaaatgatggaatccccagctgccttgctgtggaaaaatggattctacaagatgtttaccaagtttgtttccagtgtctattttcttacctgaattaattatgacagttgtttttaaaggtttactttgttttaagaaaagaagggaagccaggctcagtggctcacacctctaggtcccagctactcaggaggctgaggtgggaggatcgcttgagcctgaaagtttgaatccagcctggacaacatagtaaaaccctgtgtctacaaaaaagctggggcgggtgggtggagtaggttgtgagggttaaaggaggttatgcatgtagggtgcattgtatagtgttggtcccataattgacactcagtgattgatagatattatcattattgttgttgctattcattctgaaagtctataatgtagctttgggctgtatttagctttcctctttctcactgtctccactactctgccgatatcacgattttcttatcttttctgattcactaagcagctcttccttgtatgtcaaagtcaggtatagacaaatagttatcctatttcctcaagctcctggggatgagatttacaggaagtccaatttagtatttataaaatgcttacttctgtacagataattaaaatgctattcaggaaggcaaagtctaccgtttctagtatactttgcttccatgctaatttttggttggtgtctttaattgtattatgtattatttttatccaaacagataatttgtggtagaccacaataacttcttcttttttttttttttttaccttgtttcctcctctaaatggtgtgaaatgcttgacgattggagtgccttttcctatcatcctccattgacatgctaatgttaagttttattgtaccgcaactaagtggaatctgagattatatttaccactttgtgttataagtgtaagttcagcctttgtatcacccatcctatacattcattcgttcactcaattaagaaactttttgaggcagtcactgattaataagtcaggatgcaggagtgaacagtctccgttcttgggaagctgtgttctagtagggagagacaaagaaactggtaaatttaaagaatacaaaataagtgaggttgtaacaagtgctgtgaaagaatattaaagaagagatagaaagtgtcaggtaggaaatacaagagatggggatcagggaagacctttctgaggaaataactcttcagtagggtactcaataaataaagaggagagcagaggacatgtttaaggggaataattctgtaggtaaaggaagtgcaaaggacgtgaggtaagaattggcctggtatttttaggagagcatgaccactgtggccgaagcaaaattaatgactaggagagagggaagctgtggttagagaaggagtgggggccataacacaattcaaatatgacactgcaggggttttttgtttgtttttttgagatagtgtctctctcttttgcccaagttggcatgcagtggcgtgatctggactcactgcaacctccacctcctgggttcaagcaattctcctgcctcagcgtgtcaagtagctgtgattacaggcatgagccaccacgcccagctaatttttgtatttttagtagaggcggggtttcaccattttggtcaggctgatctcgaactcctgacctcaagtgatccacccacctcggcctcccaaggtactgggagccaccatgtgtggcccactgcagggttttgagcagagaaataaaacattggttttatggtatctttagattttaagtattatttctgtctccattatgttttagcctcttttttgactcatgagcaagtaatcaaaatgattcagtattctatgaaatgtactactagtgaaaagtatctcatagataatttaagctcaaatccccactaatttactttatgtgggtagaatactaaaaacagataatattgtttctgttaaattcaatcatgtgactcaaagaaatgagtgtctgtggatggagagacagaatcataattctgttactgtgtacacatattgggaatgcttttgacacctgcagtcattctgcatgataattctaatatcatttctctttgtccataacacaatgtttataacttggtcacagatacatttgacttttgccaaaaatgacttcaaaaaaaggactttgagtttcttcttcttaagtaaaaatataaacatattagggcccaatttttcatcttattctgaatcacataggtaatgcatcttacccagagaagataatactgataaaggaaagaagaggggaaaagaaagtgtcctcaaggcctaatattgcatgactaatcttctaagtgctgctgaggagagctgatcaaatctcccagcacttccctgtcattacagggcccagtgtttgcatagggcatgcactgggctgctgagatctgtgtcttgaaaggccagtatcttgaaaatgataatattattaagtcattagtgctgaattctgcactcagaactcagcatggatatacactaaaatctagtttaatttgaagagtaaattgcaaagagaaatataggatgagttccactttaaaactgacaaatgagtgttttcacaagtaatctcctttaggaaactgagagtgatgtttggacaattatgaattaccttttaaaaattgctatgtaaattattcattaatagtttagagaatttttatgctaatcattcacttctagtcataatactattctagtaaaatatgaaagtgctatgcagaattagttgggaaagcaatgtaaaagagataatttgttaccaacagctaaaattgtatggtaatgcctttttgccacatggcttaaaaatacccggaaaaaaaaaagattttaaagacttcaggtgaatttaactgtattgttctatttactctagcatatcttttcaagtagtaatagttgttgcagtggatttacaccccaagccaatagaaaaaagagttaaggttctcaaagccttttatcttttgtgttatttattgagtagttacaggacaaaagcacacaagcaaacccaacaaacagcaacaacgacaaaaaaaaaaaaaaaaaaaaacacaaaaaaaaccctcaaaagtcactttgggtagaagatccattccactttgtaaatttatcaggactctgttcatgttcactctttcctggcatatacccaaagcactgtttccacatctgtcatattcttttaggggtcgaataaagtatttgtgagctcccacaatgtacagatgcaaggcataatctgggtacttagaggacacagaaaggctgtctttgtcttctgaatgtctgcataaatttgtatgaacattagtaggagttaaaagaatcctgggcttgaccctatcactggtcagccaaaatacctttaatgggttgtccttttttttttttttttttttgagacggagtctcactctgtcacccaggcttggagtgcagtggtgggatctcagctccctgcaagctccgcctcctgggttcacaccattctcctgcctcagcctccctagtagctgggactacaggtgcctgccaccacacctggctaattttgtttttgtatttttagtagagacggggtttcactgtgttagcaggatggtcttgatctcctgacgttgtgatccacctgcctcagcttcccaaagtgctgggattacaggagtgagccaccatgcccggcctagtttccttaaactgtttacataaattaaaatacttggattgtttactgttttatttgaggattaaggaaaatagtatatgtgaatgttttcttaaaaagtgtttttcacatgttaggttttcataatattttgacattatttatatcacttcaatttcatatatttgtcatattataaaattattaacaatgaaaagttacaaatgtaaccttatgcatatgtagtatcatagtcataagtttacatctgtgaccttgtatgtaaccatatgtaaaatactcatgtattatatcagtatacaatgaatagtagagcaagcctaattagatttcagacaaataagagtgcagagtggaatgcttttgttatacaggggagcatccctaatctgaaaatttgagaattccaaaaggctccaaattctgaaactttttgagtaccaacatgacactccaaggaaatgctcattggaatatttaagattttagatttttggattagggatggataacttttcagtagataaatattctaaaacccaaaaaatccaaaatacaaaacacttctgttcccaagcatttcagataagagataattgacctgtaataatagctaccatttatataaacctactatgtttcagctaatgtgctcggtgattaaatatatcacacaataaaccaatgaatagatgtcttatttctgttttagagatgagaactctgatgttcattggagcttagttacttacccaaaaattatgcacttaaggaaagaaaagccaagattcaaatcagttatgtaaatatcaaagctcaagcccataaccattccaaccatttctccaaagggattgatgagacaaggctgcagacgtgagagagaaccagtttgtattgagaggacagaatatgttatggtagtgccatgatgaggaatttagatttctgtcatttaggcaaaaggcaaccattgcttatttctgcccagatgagtgatatgataaaagcaatacttaaagattagtgagatcttgattttacagatatggaaatacaactgctcgcttgttagtgacctgttttatataatgcagaataataaagacaaagtccttgctggtttgaattttttatttttttgtgcatgtgtgtggaaggttttttttttttttttgtggactgacagctgtgagttataatgagcttcccaaatttatgtgtacctactctcagcccatggagagtagtaaattgctctctttcttatgacacatttagattaggagaaaacgttgagaggagggaagcattgcattggctagttaaaactaatgtaggatgatgatcctgtgaaaagaataaaatcagccacagtgaaaagtaaaaatatcccacaggcagacacctagaccagagagagtgggtgctcagctcttccaaaggacatcagcctacccttgctctgggaagccctagcctttggtttggttgggtagggaagggatactggcattgaggtgctccacagagaagctgtggaaatgacatgattcccaatagcacacctgggagagcctggacaggtttatttgcgttctcacaccgagcatgacacctgggaactgcaaaccattcctcagccacagagacagccagctttgttgtctctgtaattccttatttaaagtggtcttttagttgtatttcagggcatgactcagtcagattccctactactccccccatcttgcctttttaattgctttgggatgaaataatcctaggtttggaaagtaatttagcaatcttctactgtagataatatcagaaaatccccactgtaatatgcctggtaacctgtactccattaagcaaatacttgttgagcccctcttttatgtaactacagaggtacatatttaaatagacacctctcttacagtcaaggaaaattatactaatcaaacaacaatatactttacaattctaaggtgcacttttttaatattttagctactatgaaatttgcctggttctcaagtggctgttggtcaaacactagtcatgatatatttatagttgtcattgcccgctcatgcacgaactcagttatagctgtttatattgtctctttgagttataagcattgttggaaccacgtatgttgagtttaattgctatttaatgtcttcaagtaactaaatgttattgttcaaaaacacacagacaaaaggcagtgaggtgcacattagtaatagaaaagaaaatattcattattgattggatgactgtctgcatttcccaattttcacacaaaacaaaacccaaatgctttgtaggaaggacttgagaaataaagattaccataagctgatgaagcctgttatattttcttgccaacatacaagcagaagagcacatatcatacatcaaacaaggaagtccagcaacaaaatccttgttataatactggagtgctcctttaaaaacattgcttcatgaacacttttttttttttgaggcggagtctcgttctgtcacccaggctccagtgcactggcgcgatcttggttcactgcaacctctgcctcccgggttcaagccattctcctgcctcagcctgccaagtagctgggactacaggcacatgccaccatgtccagctaatttttgtatttttagtagagacggggtttcattatgttggccaggttggtctctaactcctgacctccagtgatctacccacctcagcctcccaaattgctgggattacacacccggctgatgaacacatttgatagcacagatgatatttggtgtaaaaacatgaatgatactgatgtgaaaaatgactgatgagccaaagtcaatgggaagaagatttgggaatatattaatcaatgtttcacttataaagtatgataaagattctaagtgataggaaaacattttgttgtttaaaaatagataaactaatcatatgtcttataatcagtggtatattgaaatatggtagtgacagccacaatgcaatatactttttaatcctcagacagccctgcaaggtggaatattattatttcagttttacatatgagaacatttaaatgaatagttcaatatatcatagctgattagtgctagtgctgccatttgaaccagagttcaagctgtttacccaaagtaagttgccatgagtggagagaataattaatcagaaagaagaaaatgaaagtaaaaacaggaataggataaaataaaaataacgacttggtgtttcacactttgcttaaatgtttctagtgtgggtgagctcattacatcacagtgccagctattccattctgaatggttttcttgttataaatgaattttctttttcttcagttgaactaagtgggcttccttttaactttcactcatttgcttttattctgccctctgggggagaggagggaaccagagaaaataagtgaaaataagcttggtgcctcatgcatgaaagcctctctgatacttgagcacaggtatcatgctgccattgattctgttttttagaccaggtagcctccgtttttcttataaaacagtgtttcaagacccagaataatgttaatcctgagtgtattctgttttgccagtgtgtgttaaaaatacggagttcagaataaactgttgcactaagggtttcaacacagacatggcagacatggcacacattgcatgtaccaacgactaaaatttccaggacatttttcaggtgatcgttatggacccaggcttctcacatattgatttttttttttttttgagaaggattaaaatttttttattgttattatactttaagttctgtgatacgtgtgcagaaggtgcaggtttgttacataggtatacatgtgccatcgtggtttgctgcacccattagcccatcatgtacattaggtatttctcctcatgctatccctcccctaggcccccacccttccacaggccctggtgtgtgatgttcccctccttgtgcccatattttctcattgttcagttcccacttatgagtgagaacatgcggtgtttggttttctgttcctgtgttattttgctgagaatgatggtttccagcttcatccatgtcccagcaaaggacataaattcatccttttttatggctgcacagtatatatgtgccacattttctttatccagtctaacattgatggacatttggattgtccccaagtctttgctattgtgaatagtgctgaaataaacatacgtgtgcatgtgtctttatagtagaatgatttattattctttgggtatatacccagtaataagattgctaggtcaaatggtatttccagttctagatccttgaggaattgccacactgtcttccacaatggttgaactaatttacattcccaccaacagtgcaaaatctttcctatttctctacatcctctccagcatctgttgtttcctcatgttttaatgatatggccattctaactggcgtgagatgacattgtggttttgatttacatttctctaatgaccagtgataatgtgctttttttgtttgttggccacataaatgtcttcttttgaaaagtgtctgttcatatccttcacccactttttgatgagcttctttgtttttttcttgtaaatttaagttccttgtacattctggatattagccctttgtcagatggacagattgcaaacattttcttccattctgtaggttgcctgttcattctgatgatagtttcttttgctctgcagaagctctttagtttaattagatcctatttgtcaattttgggttttgttgccattgcttttggtgttttagtcatgaagtctttgccgacgtcctgaatggtattgcctaggttttcttctagggtttttatggttttaggtcttacatttaaatctttaatccatctttagttaatttttgtataaggtgtaaggaagaggtccagtttcagttttctgcatatagctagccagttttcccaacaccattatttaaatagggaatccttccctcattgcttctttttgtcaggtttgtcaaagatcagatagctgtagatgtgtggtgttatttctgatgcccgtgttctgttccattggtctatatatctgttttggtaccagtaccatgctgttttggttactgtagccttgtagtatagtttgaagtcaggtagcttgatgcctccagctttgttctttttgcttaggattgtcttggttatatgggctcttttttggttccatgtgaaatttaaagtagttttttttctattcctgtgaagaaagtcaatggtagcttaatgggaatagcattgaatctataaattactttgagcagtatggccattttcatgatattgatccttcctatccatgagcatggaatgtttttccatttgtttgtgtcctctcatttctttgagcagtggtttgtagttctgcttgaagaggtccttcacatcccatataagttggattcctaggtaattaattctctttgtagcagttgtgaatgggagtttgctcatgatttatttctctgtctattattggtgtataggaaaacatgtgatttttgcacattgattttgtatcctgagactttgctgaagttgcttatcagcttaaggacttttggggctgagatgatgtgtttttctaaatatacaatcttgtcgtcagccaacagagataatttgacttcttctcttcctatttgaatacctttatttctttctcttgcctgactgccctggccagaacttccagtactatgttgagtaggagtagtgagagaggccatccttgtcttgtgccagttttcaaagggaatgcttccagctttttcccattcagtatgatattggctgtgggtttgccataaacagctcttattactttgagatacgttctatcaatacctagtttattgagtgtttttagcatgaaggagtgttgaattttatcgaaggccttttttgcatctattgaaataatcatgtggtttttgtccttggttctgtttatgtgatggattatgtttattggtttgcgtatgttgaaccagccttgcatcccagggatgaagctgactttatcgtggtggataagctttttgatgtgctgctgtattcagtttgccagtattttattgaggatttttgaatagatgtccatcagggatattggcctgaaattttcttttttggttgtgtctcttccagcgtttagtgtcaggatgatgctggcctcataagatgagatagggaggagtccctctttttctcttgtttggaatattttcacatgaaatggtaccagctcatctttgtacctctggtagaattcggctgtgaatacatctggtcctgggctttttttggttggtaggctattaattactgcctcaatttcagacttgttattggtctattcagggattcaacttcttcctggtttagtcttgggagggtgtatgtgtccaggaatttatccatttcttctagattttctagtttattcatgtagaggtgttaatagtattctctgatggtagtttttatttctgtgggatcagtggtgatcacccctttatcattttttagtgtttctatttgattcatctctcttttattttttattagtctgtctagtggtctattttcttaatcttttcaaaaaaccagctcctggaatcactgatttttttgaaggtttttttgtgtctctatgtcctttggttctgctctgatcttagttatttcttgtcttctgctagcttttgaatttgtttgctcttgcttctctagctctttaattgtgatgttagggtgtagattttagatctttcccactttctcctgtgggcatttagtgctataaatttccgtctgtacacttctttagctgtgtcccagagaatctggtacattgtgtctttgttctcattggtttcaaataacttctttatgtctgccttcatttggttatttacccagtggtcattcaggagcaggttgttcagtttccatgtagttgtgtggttttgagtggctttcttaatcctgagttctaatttgattgcactgtggtctgagagactgttcattatgatttccattcttttacatttgctgagaagtgttttacttcaaattatgtggtcagttttagaataagtgtgatgtggtgctgagaagaatgtatattctgttgatttgggatggagagttctgtagatgtctattaggtctgcttggtccagagctgagttcaagttctgaatatccttgttaattttctgtctcattaatctgtctcatattgacagtggggtgttaaagtctcccactattattgtgtgggagtctaagtctctttgtaggtctcttagaacttggtttatgaatctgggtgctcctgtattggatgcatatatatttaggatagttagctcttcttgttgcattgatccctttaccattatgtaatgcccttctttgtctttttttttatctttgttggtttaaagtctgttttatcagaaactaggattgcaaccactgcttttttttttttttctttctatttgcttggtaaatcttcctccattcctttgatttgaacctatgtgtgtctttgcacatgagatgggtctcctgaatacagcacaccaatgggtcttgactctgtatcccatttgccagtctgtgcctttttattttatttatttatttatttatttatttatttatttatttattttgagacggagtctcacttttgtcacccagcctggagtacaatggcgcgatcttggttcactacaacctccaactcttgggttcaagcagttctcctgcctcagccttccaagagctgggaatataggcccccaccaccatgccccactaatatttgcgttcttagtagagacggggtttcaccaggttggccagcctggccaggctagtttcaaactccctaatctcaggtgatctgcccacctcggcctcccaaagtgctgggattacaggtgtgagccaccacacccagcccagtctatgccttttaattggggcatttagcccatttttatttaaggttaatattgttatgtgtgaatttgatcctgtcattatgatgctagctggatgttttgcccattagttgatggagtttcttcataatatcgatagactttacattttggtttgtttttgcaatggttggtaccagtttttcctttcgatatttagtgcttccttcaggaactcttgtaaggcaggcctggtagtgacagaattcctcagcatttgcttgtctataaaggattttatttctccttcatttatgaggctggatataaaattctgggttgaaaattcttttcttttagaatgctgaatattggcccccactctcttctggcttgtagggtttctgcagagagatcccctgttagtctgatgggcttccatttgtgggtaacccaaccattctctctggctgctctttacattttttccttcatttcaaccttggttaatctgacaattatgtgttttagggttgctcttctcaaggagtatctttgtggtgctctctgtgtttcctgaatttggatgttggcctgtcttactaggttgaggaagttctcctggataatatattgaactgttttttccaacttggttccattctccccatcactttcaggtaccccaatcaaacataggtttggtcttttcacattgtcctgtatttcttggaggctttgtttgttcctttttattcttttttctgtaatcttgtcttcatgctctgtttcattaaggtgatcttctatctctgatatcctttcttccgcttggtcaatttggctgttgcttcttctatgtgcttcattaagttctcgtgctctgtttttcagctccatcaggtcatttatgttcttctctaaactggttattctagttagcaattcctctaaccttgtatcaatgttcttagcttccttacattgggttaaaacatgcttctttagctcaggaggagtttgttattatgcatccctctgaagcctacttctgtcaattggtcaaactcattctccatccagctttgttcccttgctggtgaggagttgtgatcctttggaggagaagaggcattctggtttttggaattttcagcctttttgcactggtttgtcctcatcttcgtgaatttatctacctttggtctttgatgctgttgaccttcagatggagtttctgtgtggacattgtttttgttgatgttgatgctattcctttctgtttgttagttttccttctaacagtcaggcccctctgctgcaggtctgctggagtttgctggaggtccactccagaccctgtttgcctggttatcactagcagaggctgcagaacaacagattgctgcttgttccttcctctagaagctttgtcccagaggggcacccaccagatgccagccagagctttcctatatgagatgtctgttgacccctgctgggaggtgtctcccagtgatgaggcacggggatcagggacccacttgaggaggcagtctgtcccttagcagaactcaagcactgtgctgggagatctgctgctctcttcagagctggcagacaggaacgtttaagtctactgaagctgtgcccacagctgccctttccccaggtgttctgtcccagggagatgggagttttatctataagcccctgactggggctgctgccattctttcagagatgccctgcccagagaggaggaatctagagaggcattctggctacatcgtcattgctgagctgtggtttgctctgcccagtctgaatttccctgggctttgtttacactgtgaggggaaaactgcctactcaagcctcagtaatggcagatgtccctcaccacaccaagctcaaaagtcccaggtcaacttcagactgctgtcctggcaacaagaatttccagtcagtgtatcatagcttgctgggctccatgggggtgggatctgctgagcaagaccacttggctccctggtttcagccccctttccaggggagtgaatggttccatctcgcttgtcttccagccaccactggggtatgaaaaaaaactcctgcagctagcttggtgcctgcccaaacagccgcccagttttgtgcttgaaacccagggcccttgtggtgtagccacccgagggaatctcttggtttatgggtcgcaaaggccgtggggaaagcgtagtatctgggccggagagcactgtccctcacagcacagttcctcaaggcttcccttggctagaggagggagtttcacaaccccttgcacttcccaggtaaggtgacgccccgccctgcttctgcttgccctctgtgggttatagccactgtgtaaccagtcccagtgaaatgaaccgggtacctcagttggaaatgcagaaatcaccagccttttgcattggtgtcgctgggagctgcagacaggagctgttcctattcggccatcttgcccaggaatcaaaaattaattttaataaaaaattttaattgacaaatgataattgtgtccatattcatggtgtacaacatagtgatgtttcaatacatataatgtatgatggatgatcagaccaaggtaattagcatatccatcatcacaaacatttatcatttctttgtgttgggaacacccaatatccttttcactatttgaaaatacataaaatattaattctagtcatcctgtagtggtatagaacactataactcattcctcctatctagctgcaattttgagaaggatttttatgttagctctcagggcacatagcctcttattaggatagggaagactggacaagtctgtggcctagatatctctatgtgagggatgcctttccataaagactcaggggcttatgatggcagaaagtcctatatgtacatcagagatgtagtagctgacatcagtaaggatcctgtatagagcacagtccccagagtgagactgccttggtttgaattccagctctgctacttatcagcttggacaattgcttaatctttctcaattctccatctgggaaatgatgataaatacttgtactcacctcctatggttacagaaaggttaattgaactatttcatccaaaatgcttagaaacattgcttgacatattttaagactcaaaatgttgttgttgttattgttgttgtgcatatgtatagcaatagaactcaaataattgagtaatacatttggtgtatttgtttcttagggctggcctcaacaaagtgctaccaaccgagtcacttaaaacaacagaaatttattgtctcacagttctggaggccagaagcctgaaatcaggatgtaggcggggccttcttgcctctgaaacctctagaagtagatccttgcctcttccagcttctggtagctccaggcctttttttggcttgtgacagcaagattccattttctgcctccatctttacatggcctctctgattctgcctgtgttcaagtgtttctttaattataaagacaccagttatattggattaaggcccatcccaatcaagcgtgacctgattacatctgcaaagatcctatttctaagtatagtcacatttgtggctaccaggggttaggtcatcaacatatttttggtggggggtagagcacagtttaacccataatatctagaacagagacattcaaagtagaggaactggatgtaccagaagcaagcagagggcactaatggagttgggggtgaggtggaagatctaacaaaagctgatattttgacatttaactagtgaataggcctagaggtttctctgaataaatgatacacccaaatcaaacctcagataagggaaaacaagatttctgtcccctgggatgggtgtaaggggcagaatttggacttaaatcctagaggaatcagggtattgaacagattctcaagatgtaagcagtagacttacacttggcacttaccctgttcacttttggaaatgtctttccttaaacatgggataaatggcatcttggcaatttcaaagtgttaatgtactattaacaaccttcataaaaacagcattgtagattgtagttgcctggccattttccaacacaggtagattttacttatgtaaggtgtttttgagatcttctgggaatgagaatgtgtttattttctgtttttgatacttaactaagtttgctttgtgtagccaataggtattgtctcatctcgagagctttactggtggataaatatgagttcgtcaggtttttgaagtgtttaaagatacaatgaataaaaggtgcatcataaaaagaggtctattatcataatctctgtatctgtacgatcagaatttccatagtaatcagtcttgatttcctaaatacaggattatgactgtaagtgagaagcaataatctctgaaatattaaggaaattcatcttttgtatcttagtaaaaaagtattttgtgaataccatattaatgacaactgtggaaagagaaatatggaaattgtacttaacttagaattttctaatccttacaggaatttgaatcaacgaagattagatcatcccctaagtgggtttttatatagttgtttcatttccagttttccatgcctttttaacacttgatctttgtatgaaaactactgccatattcagagacatgagtcatggtacttaaaatgttttcaccatattttagacatcacaggatactacagtaggagaagagtagtctcttggcattcacaatttttacattgtaagatttgacctttcacagtagttcattacatgtgttaatttaactcatgcattattctagcagatttctcagcatatgaatttcattttggcttttcctttaaaaatattgtgtataaatttacctgcacatctctcttcctaccccctaccatgtagtatgagtgtttatttcctatgaaaaaagatatccatgaaaagaaagcaagttccattgaaagtgagaagaaagtgatgaggtgatgacttaatagccagaaagaatggcttcagataaactaaagaataaaatgtcatattgttcagggatttagatctgtaatataaatgaatctattataaattctatgcagaaactaggtggggtgaatataaaatggtttcagtgagttttccaggtcttgccaagattgctgaagtaagaacctgacctctagccaaggcactggaatggctactgcaatgatctttatgataaagagaaatatataagagtttttacttcttaaaaaatgcacaaacccctgcttgtgattgttgcctggaatatttttcccaatcccttttcttttgataataggcttagccttcctcctaccagtaggagggagtgaacacatgacccaaaactggccagtcagtatgcaccattccctggatgcagtgattgactcatgagtgtgcaggagaccttcagagggccagtcacatttatttcatggcatagttttgctggaattggtggatctaacttttaggttatcgagctggctggatgtgatttagaagatacttggagtaggtgcaagtgcagtaggtgaaagtaagatcaaagtgcagagagaagttgatcaagagtgaaagaggcaggcttcctttaagctcagatccatttgcgcctgaaggcggtgtttatattgtactgcattttatgagggaaagatatgtttagtaatgttcgtgaatggcaagatttgcaaagagcttaagagaagatcctgcaagtggcttaagtttctatagtatcttataccccccctgcctatgtgctaacgagcatttagacttcattagctttgaggctttgatgaattgaatctctattttaagatacctcgaaactctttgcttcatttgaagtacattatatttacaaacagtgaaaagaatattttacatctgtagatgaaaagtgaaagcaagatgtaaagtgcatcaattaataattcagtaacctgtgaatatttagctactttaataatgaatatcaatgtgaaagagctctgtaaatgatgggattttaaaagcatggtagtaaaatgtgctcctcaacaccaatacagttttctctttctttctttctttctttctttctttctttctttctttctttctttctttctttctttctttctttctttcttctttctttctttctttctttctttctttctttctttctttctttctttctttctttctttctgtctctctctccctctctttctttctttttctttctttctcttttttctttttttgagacagagtcttgctctgttgccccagctggagtgcaatggcacgatcccggctcactgcaacctctgcctcctgggctcaagcaattctgcctcagccttccaagtagctgagattacatgcctggctaatttttgtattgttttagtagagacggagtttcaccatattggccaggctggtctggaactcctaggaacctcagctgatctttccaccttggcctcccaaagttctgggattacaggcatgagccaccacacccagcccaacatagttatttctatgtacttcattaatatgtaatttctattttaaatatttctgcagtttttttttctaatttggtcatattgtgtgaaaagtggtaaataagaaagcagtgtcatcttgcttgcactttacatctacagatgtaaaattgggaccatcagttacccattacctagcattcaattaaagaaggcaagatagaaaataagatatacaaaactctttaaaagcctagcctgatgctagtgatattttaacattgaaatattattgtaaccatttattaaggggatagttctaatcaagtggtgctaaagaaagctgtggtatagtaggaatagggagcttaccttctgccgaagtattaacctgtaccagttattctagctgtcttctgtgagagtactattctgtacaagttactacaactttatcaaattttttatctttacaaccactttgtatgggagatgatattgtccttattcttaagaacttgaggcttagataggtataattacttgccagaagcaagatagagtctttctgttgcccatttttcttccatggctcctctttggatgaaattcaagcttcctagcctggatgacaagaccctgattatctatcccttgttaatcttttggggggtttttttgtatattttgtagagatctggtttcaccacgttgtgcaggctggtctcgaattcataggctcaagcgatctgcccacctccacctcccaaaatgctaggattataggcgtgagccactgtgcctggcctgtcccttgttaatctttacagcgtcatatcttttcattccacacctaaacttcaagtttatagatctttcacttcctgtaatatgacatatgttgtttctactgtgagcaacattccctttcatgtcccactgttctgtgactaactcctcttcattcatcaagtttccgcttaagtaccacatcctccaggagacttcatcaagttcaccattgatgagcatgatgaatgagtccaccatgaacaatgcccattgcattgttccttcattcattcagcaaatatttattgaggatcccctatgtgccaggcactatcctaggccctaggaatgcaacaatagacaaagaagaataaaaatctctgcctttgtagcttgtaccctagtattattaattatttaattcagtgtcactcattagatgtttacttctgttaacattcttggggtctaacacaatgggatattaaaagaatgtggtaagcatttaatatttattgaatcaaaggagagatgaatggcttcacttattattttaatttataattgtcttgaagaagtcaaagaatgttctgtttggccccttttatcttttcacactgccaccatcataataccagacctcattgtcttgtgactgtagtaatgcagcaaacctcaaattaaaagcaactttttttttcaatttttcttcaccattggattctgcatagaattaccagatttatcttcctaaacattacaggaattgttctcctcgaaataccttatgctggaatttgagacccttataatataatgtcaccatccttctctgatttatctctagatgtttcacatatactctctgttcaatccagttttttgtttgttttttgcaatccacttattttgattcatttgcacctttctgcctagaggtctttcagcttatgacaaatttcatcaatgctgcaagtcacttctttttggttaagtcttctttgataatgtcagccaaccttcttttccttaatttctgatttcctgtaagaattactgtctatacctatagtattccaaagccttttgtaagcagcagaatctaccctgtgtcacatctgtaacataagtacgtgtgcacatatgcacacatgtacctgtgtacacacacacacatacaaagagctcttacatggaaatccaaggtataaaaaaagttaaaagtatagcttactgtactaatgaccctgacactcctcaagaacccttccactccacagaacatacttgaagccagtgttgtgacctcagtcacactggtctttggttcctctcactattccaaagaaaaagtcagaagtggtcaggatgacttagcattgctgagagaaaaattactttctcatgaaacagaaggaaagagtcatatttgtcatacctgctacagcaaccatttcaagccttgtgttttttgacttcccatcacttcccaggaaacatgtgcagggaacagggagtaaagtcagatttcatccctttctcaggttctgagacacttgaaatgctagagagcctctaaactagattcttctgaaactgttttagcagttcacatttcacatatgtgtggaccacagagaaaagtccatggtcaaacgtcagtgtctccttattgataaaaggccagatcaggagcagttaactagctggaggccccatctgttttctgttcatatgtgtaagtctgtatatcccaagcatactctatgttccttgagaaaatcagttgtatttgtatactgtaactataaagttactcattatttttaaattatttcatataggcttatcttcccaacaagttcaaaaaaataatgactattttttttaattctccattacacctatggcacagcaggtacttaataactacctgttaattaaaatgaaataaaatatcctagtttatgtacttagctattatttagagttttagaacgtttttctgttctgacatattaactttatatacaatataactgtagggaaatcaagcgttatttgtaaaatatatttcagatttgtgacatgactaataagagatttaggatttttaaagacacttatgtcttaaaactatgtattaagaacatctaaaatttttgtttaaatacattaagcaaggaatatagaagatgcgaagaattttggaaatttaatgaagtaatgtttataaggtaatgcagctagaaattgtgtggttttataaggcaaacttttctcaataagaagcagtttaataacttatcaaatacatattatgaatatgtgtttcaattttctgcattttgtcaaaggaagggagaagagttgattgataatcctgactgatctttttagcaattctagtatataaacaacactcatcatttttaattgacaaaaatttaactaaatttgaaattaggattgctaatgaatcacaatttattatgaaccagcagctattttatgttttccaaacacctgtgttaattttctatgatcactcagtttatatgccatatataccatgttaggcaaacatgatttttgcatagtttccttagatatttgtggtatactgaagaaacaagaaacttaagacccgattcatgtttaaattagagacagccacatatgtaaattttcaaaatattcaaagactttatggatgttatgatttaagtcagtttaagatactgtgacacctatttgttttatagaggtaaacaaaaatgattcatctcactgtggcatataaaaaaacttttatatagtgtcttcaattgaacattagtcctgacatgtaaatttaagataatctaatctaagttctcagatttttagatttgtacttcttttggacaaagaaaacaatctcatgccttttcttaatgtaatttgaaatttcaaagtgaaaacatcattataaaagtaaatgtaaagtatttataatttaacaattatttttagaaaaattatatatgctactgcctctgttgagtaatgtgatggatggaaatgggcaataaaatgatttgcccatatcagacatcaacgggagacctaaggcctaaacccgtaggagtttccagtacagagagggaaatccactgatgtcaggaagctgatgcttttcagtaccattgtttatatctacatcttctcaagtatgcccttcttgaagccatatttttatttttgttattatcccagtataatgcagcacaagtgaaacgtcaaccagtcttcagtgtttattcatcttttaatacagaatatttagtaaatatttcatgtttcagtgttttattcattgtttggatatttaactgaataaatatttctggaatatctacctagtgaaagatatgtaagggaatgaaagatagatttttaaaatctagtcagaattaataaatgggttcaatgcctttgtcagacttatttttcagataacactttttcttaacagattttcttagattttaaatgaaccttttcaaatatgtctgaacaatattttaataatttatcaattcacaattacatatttaatttccaaatatgctgcacataacaagtaagctcatatatttttactgagggaagtgatagtggataatcagtctaatcattcctttgcttaaggcatttaaatattgccatataagaatagcacttactagctttgttcacttactggaaattagatggagctgaatacttaaaagtcaattttagccaaaacccttctgctgatattcccactgcctataattgccaaattaataatgaatatgtggactttagaattaaatgtcattccttgcttgccttaagattttaaaatattaaaaacaaaataatcctttaaattgtcaaaatgtgaggactatcatgacaaggaagaggagtgattttctttttttccctatgtagaaaattttccttaactgagttttccagaaatctaagaaagttttgtgtttttttgtttttgtttttgtttttgttttttcaaaaaatccatttggtgaaatgtcttacattacttctgtttactccgtcacttccagcttttgaaacattactaccattacatagctgtggaacacagtggtcttgtaaatgagctttgctacaaaagaaaatgagactaactggaaactcgtcacggtgctgccactctgaaagactggtagtatcaccaaagccatttagagatattaccactcttagaaaatggaaattgtggagtatgagacctagtctatttgatttcagccttaatagctttcaatatatgatagcatacatttggataaaatgtggaaaaatatagaacaactttttgtgtagtttactcatggccacattgattacagatgtttaattcatctatctaaatcttgcagaacattcaaaatgtttcttaggtagacagtttctgaaataactgccctgtctgctgtttcacattttgttagtacataccatgtgccaagcttttttcttccttacattgcttgcttcattgtttaaaaaaaaaaaaaaaaaaaaaaatctgtaagttctgagtctccttatagatgaggcagcagaggccttttacaaatacctctcttgttccagttacacaagtcataatttactgagcacgatggtaaaatcctttaaaaatgtagtaaaaagaacagagtatgcatatgcaaaggaggagattggggaaagcaaattagaagtctatgcattctgtagacagtgaaagctggttcaagcagaatgaataagaaagtaatttaaaaagaaggcatcacttattgactaaggtcaaacaggaggaatacacataaaaaccagaaactaacttcaagcagaatgaataagaaagtaatttaaaaagaaggcatcacttattgactaaggtcaaacaggaggaatacacataaaaaccagaaactaacagcaattatgatgataatattccaaaaaaaatctgagtgaagaagaagaagaagaagagtaatagcaaacccttgtgataataagtgccaggtgtgtagtatgtgctgctattaaagtaaatgatgttcaattatttaatttataattctggtttcatgatagtcctttaaaggaagtgctattttgatgttcatctttacatgtgaagaaacagataaagagagattagctgattctccagggtcactcagctgattgggtggtggaaattggctttggaaccaagcagtctggcatcgtagtcttagttcctaaccattgcactatactgcctctccaaagggtgaaagaacatatccaggaaaaagcaaaatgccagaaatgaaagaatactgagtgagacacagtgttaagaaacactaagattttttaaaagccctagaaacataggcttggaaggcccaaagtggaaacactaagacagccgaacaccccagatctggacagtaatgacagtccatctttcagggtcctagagggagttaatctgaaacctgagatgagtatttctaaagtgaaaattagtaatttattaataataacttattaatatttatatgtagtttatatgtactgatcaaatttgtatacattcggctgaaattatatcaacttataatgttcatccaatactcttgatgggctggtgatgataatcaaggaccttgtaaactacataatgtaaataaattcacatatcaaatagccactggtttccaggactgaccaaacttggacacaagaacagggtgatgaacaaatttaattaaatactgtcataaatgttatacatacttacttgtaattatatattgtaattgtatattgtaattatatattgtaattatatattggcaccacaaccgtgactataatttatataatgctatgatgctattataaacccttaataattaggcatctttattataatattatttggtgctaaaatggaaaaatagtggtatcagatggaaaaaaatgcattccttattcaataaattaaatcttttaaagtattcaatcaatggaggaaaaactgcaaaaaaaagaatctcagtggtgagaacactcatctttaggacaaaaacataaacataggttgcattaatttactttttattgattgcaatagtacactgtggtcataatgatggtattgtatatgcttgggcctttgataaaatagtttttaacatgtagactattctgttttgtttccatctgattacagttacgaactgagaattaggggatgaatgaagtatttagtactggtttattgtaattgttaataactattgtaatctacaatatattttattctttcttttttaatttccctgcactgtttctcattaacattggctaacagtttatttatcttcataaaacagcatcataaatataaagaaatgtttaaaatactgctattaatctgtactggtgctattattgttttgtatttgattttatagctttattgtttcttttaaaatccttgcaatttcatatatatataattttttattaccaaaaaagtgctggtagaaatttctgtatttaccaaattttgatttgatttagagactttttcattattgttctatatcatcaaaccagaatgacctggttaataattcacagtttgttttttataaagtgcctaaaacatatttatcctttgaaaaagtaatattccctatgggaaaatattattttgaaatatacctctttagtaaattagaacgatgttattttttcttatttagtttattttatgatacagatttctagatataagcaaatgctgtaataaactgcagtgtcccctttatctgagtaattgtctgattttagaagtttgtgcattctgttaatgaactacacatagctggctagctggtttgtacttgaacttaccatccacttatggttccataaccctggattatcaacaggaggaagcagatatatacttgtagtatatatctgtggttaacctctaacaaaacctctaaacaaaatctttctctgcaaaattgtagattttggaaaagaagaaagttttggtaaatagaatatccaaaaaccaaatcaataaattcaataaattaatctcctcatgctgagaattagacataaatttagttctttaacattatggattttattgtcttggggaactgtggctattatggaaaaaacactgggttgaagtaaaggaagctgaaagtagtgaggaactccaatggtgaaaattgctaaacgattcagtaacgtcttttctaaaggaaaaattgtgatctgttagtttagtatgaactggaaaaacttgtataagaagtttttctacttcatgcaagtcttccaagatgataaaagccagtattttggagaaactaaaaggtctttatagaaaaataaataatgagtcaagaattaagagcacttgacttctaaatcgtagtattgacacagtcttgctgaacagttttgaaatgctgatacattaaaaatctagttttcatttgcagtttgtaaatttattgtttcacaatttttaacaacatactcctctgtccccagacaacctaattttcgtaaactttaacatgaaattatatgatattataaaatttttgctcattgttaacaagttgacccaatgatgttctttaacggatttccctttcatacaggcaagtaaataggaccaaatgtgtaagtctttgcactaagtgaaagatattgttgagtaattttatgtgaaaatgtatattttatattacattagttttgtatcttctattcagggtgacagctgtatcagagttcttttcaagctattatttgtatagctcttatagtgaaaccttaccctaaggtgttcagtattatctactttggtttacattctctaatgcaataatttaattgccagtatgaacttagaaacaatataattctttgaaaaaataatcaaattataatatatatttatttgtagatttgctaaatttatttagacttgcatacctaacacttacataaaacaagattggttcttgttttgaacacctatcccttctcattaaagagctaccagcatctctctggatagaagatccaaggcaaatgcttggttctggtcatgtttatctttctgacctgtcctctctcctttgccaagattctattctcaaaggcctctttgtcctcaatatgctggctattatcttctctacttagaagcacactggttttagggattcttagactcgccctgtgactgattcattgttcagtttgtgtattgcaagagcttactcagctaactacaaagagtcccttgtcactgcccttggttcttatttttctctcatcagcactactttgctgtaatctatagtgagtaaagtcctgaacttctgtttaatgactcctggactaccacaccacccattagtctctgaattcctcctttgtggtgggtggctttatacacacacatagacacacacgttaatatttatgttttgtttgtatgtacttgaacccccatgcctgtgatttcaaagctttatagctttccaacagtgatattggggttgggggaagctcttcctttccctaagaaataaagacaaatactttctgcatgttatttttctgttcctatttcaaacctcaaaatgcttcaacttagatcaaaagtctttggcaccactcctttgtgaaaattatttcccataaagttttgcttaaaatgggctaatggagggaaggaagcaatattaaaaggcagttatgcaaaagtaattgtttgcttaggccttaattagtagttgattatttaggcagaagatatgtattttctgatagaaagagataagtgatagtgtataaacatcacaggatattggccactcttgccaccgtttgtttagattagcgatattcagaactgctgagtgacccgacttagggaaattaccaagatagattatattagattaattgcaccaaatagattaaacagctcagtgtatctgatagttcttacttttccagtacaaaacaaatgacaggttatttctcacagggaaaataaccatcaatatttgtgtcatatcaggttgctaacagatatgaatagtaatgctccagaaaaataaacttatgttttatttcaatatatttaatgtgttcattttgttaaatgctataactctctaaatttctgacataagtatatacagttctgttaataacctgctgaagacataataaaatttttggaatattcagccagatgaatggatattttcatagagcgctaggagtgttttaaatacttgtattgtgcatctatgtttttgatgctttttaaacatcataagtatttgggtaccccacccaccagcattctaattaggaataggaagcaaataatgggaagccaggagaatgtgggaagcatttaagtgtgaacttgccttaagggcaaaaaaattgtcagagcctggttgttcaagaagtgctgtcaaggccaagtaaagtagaagaaaaaaggacctagcctcctgaggatttgggggccctgagcaaccaagcagacagcttgtattatcagttggcattggcatattgtgctgctctttggacaccagtatcttgggtaaccaagaagatggaggatggggaccaatagtaagtgaatattatagccaggcaagcctttactctgtgtgatgtcatgggcccagcctccatccttttgggtatctcctggatactttagtatgttgaccactttcttcctgaaatttgatatcaaaatggtgaatgagataataggacttaaggataaatcccttatcttacagctgaaatatccaaggcctgagcaataaatacaatgaaatacccaaagacatgtggtgttatcagccttcttaggttcatccctccttcctagatgccatcaatcacttacgattctttcatataatagtgaagtcctaatctcacagcaacctagaatgagcaatgaaagaggttgcctttccagtgttcatctcctccacacatagcccctgtgagggggaccatactagtacacagaatgaaggctgtgtgtgctatgagaggctcaaaagcataggtgtatttagtaatactgaataggtaaggatagatccaagagcttgttagtgaatctgcatctctggagattctgattcagggcccataaatctgtagtttcaaaacctctccaagtggttctgatgtagagttaggtgggaaaacaaccataagatgtatggaggttccacattctaccccagacttgctgcacactgtattgaaacctgtgacttaaaggcttaaaataagcacaatctcagataagttgaaggcctttggtttccatcaaagcaaactccacaaacttgtcaatctctatcaatcacaagggtatctcaaaatctctggcctcttagttgaggattttcaaattaagcatagcgtaggcccaatagaataatcctagcacagcaggtgtttcttgtgtgcctcctgggcacacaagtgtctaggcactggggatatggcggacaagactgacaagttatccagcttagcagtggttatatttcagtgggaagaatcagagaagaaacaagcatgcaaataaatcaattagataatgctaattgtggcataattactgtgaaggatgatagtggagggagtttgctcctttgtacaggatggtcaagaaagaccttactgagcatgtgacgtgtatgtgagactttatggatgaaaggaaggtagcctatgaaaattcgaggaagaaaatacctccattttttccattatgttttattttgagttactgttttgttgggctttgaatttttctatgattatatgcacgtcattttcctttactgaacattatgataggtggtctttctatagcagacctatggctattctaaggtaaagtcagtgacagtgtgatgatatgtgtagctagatttcagggtattttgttttccatgcagagtttacagcaattacttttttctattttatatcatcaagccaaaatccaattattgcagtgatattgtaaatcattgagattatctcttatcacaaagttattatagaccaggaagaagagattaattttgtttttgtaaaactaaattcatgataatgtacttctatacttaagcaaaagaaaaaatatccttataatatttgcattgtctagagacatttttttttcattctggctgccagattatgcttcagttgtatgttagtgtctataactgcttaatgcctaacccgcagtttacaacctaaattaatgtcttggtatttatgtcatttacatatacagaggtaaaaatcaattatccttgaatcttcagacatggccaggaattaaaatggaagagtaaaaaagatacaagaagctagaaggggagagaaaggaagaagatgctttagaatgtctccagaatgccttccactccttattcctcccacctccaagcaccggagttctattctgtctgggaccttgacattttaaatacagccattttgaaatgccattttgatacagcatctgttaaattcttattagactccagaaactcttctaagcttgttacgatattaacacatttaattcttacaatagcccaataatgtaaggtaccagtatcacccccattttatagataaatacatttgaagctcagagaagttgagtaaattgtccaagttcactcagatagtaagtaatacagcaagggttggagcctcggtagtgtggatccagagactaggcctttaaatgataccccacaccgcctctaatgcctttgattaaccattttgtcttggggatgttttaataacagcctaaaatatgactgttaaacttgccatagagattccaaataatgtctgaagcctatgtcttagcccctcacttggcttcctgttgtccctgagcttaacttacaaatgtttgaccctcacctctctgttaggcagcaaggagagggagagagccagtagcaagacatgggctatacaaagtgtcagcgtcacacccattgacatgtgaagggctgcataaaattcgttgcaaggaaatgtcttgcttcataatttgtttccttgaagttccttccttcaacttccaaacctaatggagggcacgtgaaggcatggtttccagccatatattttctgttttgtaatttttggtttgaaacatgtcatatgtatgacagatataaagtttcctacaatttgagagaaagtggtgcttgtgataagtaatccataccaactataatttcaatagatacataggtagaagagtaattatattattacttgttagctaataagctttatccttgcctatttaaaaatttggtaacaaaaatgtgctaattaagtttttaagatggatatttttaaaattattatgctcatatcttatatgtacacacatatataaaatatataaaagttttaagaagtgttttactatttatgttagtttttacagctccaattatagctgtggaagtccccagagcaggtactggcatccatgcctggcaatgcttggaccatcccatccagtgttctctatttattcccccttggtttagatatcacatatgattacaagaaagcacatatgtctctcacaaaccaacttctcaatgcctcagaatatggatttatttgctcagctctaagaataaaaaaattatttataaactatgttttaaaacatattttttcaaaaatggaagaatatgtttctggtgtttctactgtgtatctcatgctcaagagagggaagaagctatatgattggagtctaccaaagggatgcattagtagtaaagatccttgttatttacagccattttgttagtatttaagattaccaagtgcagacattctaaaatggaatccacctgtacctacttcatgcttatagtgctgtgggttcttagtagctaattcttgacagtaaagacaggaatttatagcatgtaacatttttatttcattgttttataattatttcatcattgaacccacttgactctttttttctatgatcttttgtcaagtaaggaaataaaatttaaaacattttaataacttgcttgtaattgcaggatataatgtgttaagatctacttttggcctcctgatttcttattcacgaatgcgttcattctgtgtaactcttagtgttgcagaagcagccacatcatgttcaccattcaagcacaaaatttttaaaatattacacaatatatatacacatacacacatatatattagtataaatacataaaaatatcaaagataccataatgtggtggctgacaggaaaagctttggatcaggtgaatctgaatttaagccctgggtcatttatttttaggagtgaccctaccaagccacataacctctctaagctatattatttcattatctgtataactgagataaaaatattatttttagagttctgaaagtggaaacgaaataagtattaaataagtgagtttttaaaagagacaaaatagctcttccaagaaagttggtttaaaagagaaagtgagaatgttaagaaataccaattcccagtaattttttttgtattatgtgtcacagcttttaataattgtagtttttttcactttaacattttgtaaaaatgctcctttataatttaagtttaattggagttttttttttttttttttgccttagtggtacgtaaactaatgatgtgtcttacaatggataacattctagattcagtgaaatgcaggttttatgatacatatctacatttctttctcttcaggaggcagtaatgtgtagtggccatgtattcagacctcagttgtacatagattatgccaaattcctgaaccattctttggtgtcgtcttttacctgcaaaatgaaaacatatctcatggcatttttagggttacattaaaaaatgtgtgtaaacatcctggcagcgtctcataaagaatttttaagtgcacaatgatagccattattgttattattctcttcttttttttttttttttttttttagttaatctgtatactagtggactcagacattagagccaagtttgccactaattaaatttggaaacttgagcaaaatacttagcttttctgtcgtacttcttgttctgcaaaagaatgttttggctcagataaacttgaaattaattctggttctaaaattttgtaattttattatttaattcaaagtcctaacataatatgaccataaaatgaattttgtttctttcagtttgtggggacattcatggacaattctttgatttgatgaagctctttgaagtcgggggatctcctgccaacactcgctacctcttcttaggggactatgttgacagagggtacttcagtattgaagtaagtctacatcatgtcttctttgctgttcagttatggattaacagtatctcaaaaaaataaaagcagtaaatgttattgccttatggaaacctctaacaatgaaatttaattcacttaattcataggatattacatattatattttcagttgattcccatgtgttttttgtttgtttgtttttgagacggagtctcactctgtcgcccaggctggagtgcagtggcgtgatctctgctagtgagcagaacctctgccttctgggttcaagccattttcctgcctcagcctcctgagtagctgggattacacgcgcccaccaccatgcccagttaatttttgtatttttagtagagatggagtttcaccatgttggccaggctaatctcaaactcctgacctcagatgatccgcccacctcggcctgccaaagtgttgggattacaggcgtgagccaccatgcccggcgtgattcccatattttttaatagagatgccaaaaaatggtaaatagtaagattttgccttttgtacattttatatatttgcaaattttcaaaaattacgttttgctttacaataaataattccattttccattgaaagaaataatcaatgttgatcaaataagcaggaatgtatttgcatgtttatgccttataattgtgagacagtaacttacctttgtaaattgatagcaaactgcatgtgtctctgtctgtggttgtctatgtgtgagtacacttacagctgctgtattttgtcttttttggcacctgtcatctaactagggtaatttgtcaaactcattaattaaaacaaaacagataacctttgaatagaggttcttccacagcctcccatctgcatctgctttaggtaagtaaaactacattcaaaataaaggcagagaccttgttttattcatatctttgttcttcctggtgcctaacacgttgtgttaataaataatttattgaaagaagtggtttgaaattgaataagttttaaagaatcagacctcatgtatagtagctgacatgggctatcaaaagagatcattaaaaaggaaaatgattattcttaattaaagagagaaatcaacattattgtctcacaccaacatcatatattcataataatcatagaaaaacattctatatttcaaaatttttatttcagtgttttatttgctaaagggatatttaaggttgaaaagcatgtcatccttaaacagcttttgtttatacaattatatcagttttatttttcggttatttaattcacctttagtcactgactacacgcagacacagaaaagtttatgtagacatatatgtatttccgccaacataataataccgtctgcatttaaagatcacagatttcttaattattcctggtgatgatgagggaagaaggagtggtgatggtatataaatcccaaaagagaagttaaattcttggtatttcctccatttgataaacaagtatggtcaagcatataaaatgtatatgcaccatgaataggactgtgaggaatttaaagaaatgtaacatacattcttgctctctagaaacctaaatctacgttgcaaaacagaaccataaaaatctgtttagaatcagaagcctggaatatgtgattatccagaggtcagtaatttaaatggattattaaaaccttgtgataaaggagatacaaaatagtaagtgtgattggattagagaaaagtgaaagaatattgagagcacacatgttttgggaagactgaatcaaagaacaagtaagttttagctaggaaggaaattaaagtgagcaaaagtacagaggaagaaattagtgaactctgctaaccttgtttttttgttcttggggccagcctgaccagcttaactgatggaaaagcaattgagtactaattttgtaagacctttatatcacattaggactggtgtctgccaggattaacaacaacaaaacaaaacccctacataatggtggtttggacaagatagatatttttctgtgtgtaaaagcccacagacagcaatccaagactgatgtggcacagcgtggtgccagggcctaggctccatctgctttcttgctctgattttcatggcttcattccacagacaaactagtaacccaagatggctacatcagtttcaaccatcatttctccacataatattcaacaaggaggaaagggagaaagagaagggtatatcttcttgtttaaggatgtttcccagaaatggcccaattccttcaacttgtatcccttgagccacagtttgctgatatggccataggtgatttcgtatgtggccaggattaaggaagactgtggtaggcaataaacagcaatgggaggacaaggatttctgctcttctccttgaattagggttatatagaatgttttctttctttttctttctttctttcttttcttttcttttcttttcttttcttttcttttctcttctcttctttctttctttctttctttctttctttctttctttctttctttctttctttctttctttctttctttctttctttctttctttctttctttctttctttctttctttctttctttctttctttctttctttctttctttctttctttcttttctctcttttaaatgagacagggtctccctctgtcacccaggctacaatgcagtagcacagtcatagctcactgtggcttcattctctgcagtggcacagtcatagctcactgcagcttcaatctgcctgtctcaagtgatcctcccgccttagcctcccaagtagctgggactacaggcacacaccaccatgcccagttaatttttatttttagtagacacagggtcttacgaagttgcccaggctggtctccatctctttagctccagcaattctcccaccctgacctcccaaagtgctcagattacaaagtgtgcaaacctgtattctggcctgggttatgtagaatctaagtgaatattttaaaaattattttagtaactcttaaattcatcttattcatttaacatttgtagcactcctaataaagtttttcaggatgaatgaaataggcatcctactttccttgaagcttgcattctaagtgaggaaatcccaagactatcatgttggagtgattatttttgtcagtcaaatgatgttgtgctgcgttggaaatttttttttattataacatttgtgacttttcacaacttcctatctttctaaaggtaatcaaaggtcacaacacttgcttattaattttataataaagtacgatactacatcatgtgtggcttgagtaacagctggcatagttggacttttccttctttgtgccaccaactccatctttggataatattctttaatcttattgttctttatttacctttttttgtttgttttttgttttttttcttgaagagtgcaggcttctgaatctctgtcctcaaaccacctgaaattttctaaactttttctaattagagcattttagaattcttttttttttttaagtaaagatgttgctgggtgtggtggctcaacctgtaatctcagcactttgggagtctgaggcaaacagatcacgaggtcaagagatccagaccatcctggccaacatggtgaaactccatctttactaaaaatacaaaagttagctgggcatggtggcatgcgcctgtagtcccagctactccggaggctgaggcaggagaatcgcttgaacccaggaggcggaggttgcagtgagccgagatcatgccactgcactccagcctagcaacagagcaagactccatcttaaagaaaaaaaaaaaaaggaaaaaaaagaaaaaaagacgtcaagaagcagtttactaatttgttcctcagcagatttttttaaagtctacaattaatctagatatttgaactatgaaatttgctatgttttgtttagtatgctccttttgaaattcaagcaaaggatcaaactggatgttggtgacatatgaagtgtaggaattatggggcatttaaaagttctaagatgcatgtattggagtcctcatcttcaaaaacagctctttaattaaacttcaagagtctgagactacaacccagggacttgccacatacatacaaaaatgacaaaatgactcatatgtgaaatgttccattttgattagactgtgacctttgagaggctttggaatggctcattgatatcgtatgtaaaatagcatggacatttatataaaatgtacctactgaaaatactttaaggattttttattgtggattaaggaaactgacattgttagcatgttgtaaatgctgttgtttcaatagtttgaatgacctcatttattcttgacagttttgcaaggaacatgtaaatacgttccttttatgagtgcagtaactgaggctcgggggtcacacgtggtaaatggcagtgctgggattcaaagcctgtgttcttccactaaccccaggcctttgccatagtatattcattacatgtaccacaaagcaccacgaaaaaaaaaaatcagtaatgcagaaactggtacacactattatattcacccatgcatgaacaaacgtacacacagccttctccctatctatataatctgaagatcaaagcattagatataaaatgttctctgtgagtatgatactgttgttttaagaaaaatcctaaaataagagctcagttttccagcgtgtattatcctaacaggcttcaaaaggatctcaattcatctcaataattcagggctccactgcaggtattctcctttggctatcctctgggcaaaggggagcacttcagtttaatttttaccaagtcagctttgaaggataatttcagatttcaaacagtctctgctgggtatatttataagcactaggtaatgtgctctgggcagtacacagagctcattttatgcattacccccaccccagtcttctccttttgccaaaattagaaatcatttcccacaaagttagcccaaataagacaagcaagcttttgagtagtgatgaaagaggtaattttgttttgagtaataatttgtcttacaccaaatactgctcttgccgatgattgcattacagtacctaatctctttgatcaagcatatgtgtatatataggtctgtggctgagtgtgtttctctgagaacacaaggaaaaacttagaattgcaaacagaggcatgcacagctgtttccttctattcacttcctcaaactccctttctagccgttttgcactacactgccttgagctggcttctcaacttagatccagatctcaactccaggcctcaacaagtttaagtgtgaagaggtgttgtgtttattagctgtgaattcgtagaccagaatgaaccacagcaaaccagacaatgttccatgcttctgcctgagaataacaagcaagtggcacaacaagagatgttaggtgacagagtaatgccacagacatgaagaagaaattgcctggctgtctccctgtagccagtcgtctatatagtgcattgctcttccactgctgcctgtctacatgcttgtcagaccaggcaagtgatgtcttagaggagctacatttgatatttcaggagtttggatcttttcccaactgatgcaaatcctttacttagtttgatgatcgagaggcagcacttttgattggaatgtttcacagtacgagtagttactttaaagagctgattaatatgtacctaaagctgtccattttcttttttacttccttgcttcctcttttacatccttctttacttctctatgcaattttcaagactacttatcattaaaagcataaattacaaagtaaattattgcactattattatcagtgaaccaattaacgaagaaaattatattcttagtgctgcttcattggggaagataggagaaaattaaacaggagaaagctatgtctgtggcaaaaattaattttaaaaatagaggatgctccatctttcatattgagtaacctaaactaaccttaaagtgtaaatatttgtttaattaagagtcagaatagaaagacaatagcggtccagttgaagtgattagcgcacctcatttacatctcaccatgcagaaaaggccagtgtaacacagccctttgtttctaccttaaccaattaattcactgaaaatttgattcaagttagccatctgataccacatagacaaaaataaacaattaactaattgtatttcactgctttcattgattgtgatttttttttacaagagacttcccttttttaaaaaactatcaggttatgatttgctgaagatcttcagttcttcagaatgttagagctttagatggtaaaatagttgccggcaagacagtgttgtacttggcagctctctcccaccagatgttgagggagaatgctggcagggctccacctccagtccacccttgccctttcatttaccatgccacttcttccatattggctgcctttgtggttttagtcaatgtttgggaagatattttattcttgttacagggaagaaggaaataaaatgtgaaaagaagacttatttttagggtattttgagccaagaatttagaaattgagttatattctctctctctctctgtctctctctctctgccttctatttctcattctgtctccctgcttctctcccctccctctctccctcccttcctccctcccttccttccttccttcctttctctgcctccctccctcctttctttccttcttcatttacagaaaaggaactaatatttcctcaactcctgtcatatactaggtactttacatccattaaataatcagggatattacatgtatgttgcatcatttaaaaggtgtaaatatataggatagaaatatttagcatcgtgcatttatatatcccgctttgaggtttcagttatgaaagaactatggtaattaagactggacgggataaagccacatgctaatgtcagaaaaaggtctttaacagatagcaaaaaaagaaaatgtgggtcctagaatgtgattcctctagtggtatttgagtggggttacaaagttccagtttagattttaattggagaggtagaactttgccttaaaacaaattgttacaggcaaaactaatctaaagaagtcagaattataatgacatttccaaaagaatattgactaggaggaggctgaaaggagccatctgaatgctgaaatgtaactggatctgggtagtggtttcatgggatttgtgtaaaaattaattaatctgtgatttgagttatggacgtttcactggatatattatacctctcttaaagaaaaaaaaaactttaaaaaagtagcctaagtgccttcagaacatgtattctctcccccagcatataaatgaaatatattcaaaatagcaatttcaacatgcaaatgtatttttaaaggagttttcatatccattcatattccaaactagacatcctaaattaacgaccaatttggaaaaatacatatattactttcagattaaggtatagccttagacattttaaattggggacagtcctcccattgacattaataatagtttatgaatatcttccctgaaatgtgagacaagcttgagtaatacaaactctttttattgaaacatgtaagtacagctataaaacccgatctgtagcagagactcattaagctaccggactactcactgaggtaacaggaaacgttacatacatcaacagatcatgatgctttaaggatcgcttgtacaggccatttggtcaacttttcagacatattaatatcattagtcacatgaactttagctaataactataatcagaaagtggtaattagaaacttaaagtaacatatataatttaatgtcaacctattgtttatttcaatcataattacctagagataatatcttgcttgaacaacaaaataataaacatttgttctgataattagtattttctccaaaacttgggctgtatagtcaaacataattagttctcactcatttcataaattatcatataagctaagagagatgattactctttacaagtagtactacaaataaattgtcagcagcttttccctatagatattatccaggatatctactgtattggaaagccaattattaatgtataaatctcattgattttgatttcagattttagtaaccagaattagacttgtctcaatatttttgtagtttttatatcttcttagcttcactttgggaatacaggttttacgaggataaaagggcatacttgtttttcaaagcctgattttctgttccctatggattcttaacaaatgtcagttgacgataacaaattactgatgttaatacttgaatattccagttgacttaatgctcattccaggaaggctgtgtcaaatgtagatgtatccccaagttggtgaatgcataattgaccatcatttttacagactgcaatgcccaagaaactaagttgagaattttaaggtatatcaaatgtatcctgtagcttttagtacaatatgattaatgattaataagtaaaataaggtcacttctctttgtaaagctaattatttttaaaaatcaggtaacagaaatggaaaaattggaaagataatgtacaacaaaatgaggaggcaaagcattgacaagctcagcctaacttgaactgcgtctgtattttctattacttttccccatctctagctccctgccttcttctctcccaacatcttgtcttttctgtcagtgtctttggtatataaatctgaagtttttgatttatgtatctatttaattaaattgaagttcagggaatctcactacacatagcagtatttcttctcatctttttaaaccagtatatttttatttctagtatattttagttaagtttcttcccttccatttttttttaaactcccactctcctcaggtcacataattctccttctgttgaccatatgtaatccattgttttcttgtggtatatgatcctcagtgcgtgtatgtatgttttaggtgtagatggaccttggctttttaccaaagtaatgtttcctatttgattgtcaatatcttctctactaagttccagccttttgggggacttttggtcatggtaatacattttattcatgtctttatgatatgtgagcaatgaaatgcataagtgttaaggaaaaatatttatttttatattatttttatttttctcagtgtgtgctgtatttgtgggccttgaaaattctctaccccaaaacactgtttttacttcgtggaaatcatgaatgtagacatctaacagagtatttcacatttaaacaagaatgtaagtatacttcaacctccttcctttaacactatatgtgctaaaaagtaattttaatcaataataagatacatacaatatgatctattgcctaaagtcaaagacttaaagtgacactctttcatattatcctatatttctttctaagcatggacatttatgagaattcagaatttctttttaaattagaacttctttataaagtgattgaagaatttgaattaagatttgatgtaatttatcctaagaaacaagtgatttagggatgctactgtttggaacaataattctactcattaatctcacattactcaaaaaacgcaaatggagggcaaattcaaccctatgcctctgttttggacccaataaatgaatactagcttctagtgaatcttataaaactgaagatgatgtcattctttagacatagacactaggagtgtggagtgcttttttcaatttctttttcctccttacaatttttcttattattcactgaatcttacaaaggtataaaaccttacatttttgttttatgtataaatacagttaaatggaagagctgggaatctctctatacatatcaatatttttctctttcatttagtcctatattcaatggagcataaagacttctcctcttaaaacattagatataagtcatgggaaaagcaatgtgcagtaagatagaaacagctttaggaaatgtcttgccatctgcttttctacaaaatcgttaaggaatatcaagcagctttatggctgtttttctattggtcttccagttgttcatgtacatttttttggtgagacgtctgcagataaatagccagaatgtatataaaaattctcttgctatacaaaacgttatgaaaattataaagtatgaattaataaatgacaaaaacaggaaatactagatataaaagattaatatgttactttcagaaaatcttaattatgttttggaattttgtagtatgtgcctttatgttaataatagggtcctagcaagaaaacttctcaaaaaaccaaaactatttcagtgaaatgatcctgcctataaatcataagtattcttttaatcacttctaaaaggtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaagtaagttttgttattttccaagtctaatcattttgtgcgctacagtaataaatagaagacattaattaccctgcctttatcactgactttattcttttgagttcaaataatttaaagtggtcatgaatcgctcctttgtgttaaatttttatctagaaagagagatatgtttatacttggaagaatttttatctctacaacctcagggttggtcttaccatctgacatgtgtctttggaaatataaaatatttgacctctaaaaaaaatatgccttatcatttccatttggcttttttcaaacaatccgttgtatattcatgatgtgttatgctagaaatgttgctttgcccttgggaaaatatcataacataaccattaaactgtgctcattttatggttttttaaaaatctatttgttacaacttgagacttttaagtagcaatctaacaaggacagtgataatattttattaattttactgagtggctgagtgaaaaactggactttttaagaagtatttgtaagaagtttttaagaaatactccagtttagcattggctattaacagttgtttaaaccagcaaaaagatgagttacattgaatgtggaagtggattgtgtctctttcttgagtaaatctagtaacatgggatagttttatgtagtacaatagatagacaatcttttatttctttggtatgtttctaactctgattgcaatgatgtaaaagatagagagtaataaaaaatcgcagtgtatttttcttggtgccaaaatcggaccaaagggagaaagtgatgtaaatgttttcttaggtcattttaaaataatattacttggaattattttaaagtatgataatttcttcacattgatatttataacatatgttattgaaaatttgtgcccaccattaagctttctatctaggaaatctaagccaaattttttctggaggaattataaacagttgaaaactgtatttatcttctttcctctacttttagagacctaagaaaatacgcttgtacttatcccatagaacagaggggtgaaaataattctaaccttttattattattctcaccagtaattttagcaagaataaattggtcacattgttctaaattactgtatttgaactataaagattggaattttgctgagatttcttctaaagatacatactactcagtatatatttaagcctaatgtatgataggtagactttggcttcaaataagtgatgcactaatctcaaggtgtacagaatttatttcttaagttataggttcacttaagaataaccatgggcacagttcaaattctagatcttgcttatcattaggggcattcatacaaagactcccttggtgtcacttgtttgattgattgccatttaattgtttttttccatttcttctgagtttggaaacttgattgctaagtctgagaagtctatatgatgaacatttgcaagttaattctatcagctgccataagttattaaattagtaaacagtgttttcccattgtgttcagtggagaaggaaagcaaatattttatctattcatgtatccatgtatcatattaacctgataaccacttattgaaataggtttggaaaatgaaaagtcaaattacaaataagtatagtagtttctgttagcaaatgatgggcatgaaagacatgcatttatgttttattctcttgccttgatcaaatttcatggccttggatggaagatgagaaacttactaagtgtcctccttcaaagggggattagtgaaaacttccctcaaaatagtgttttaattatttgaacaaaactgatacactgaatagagttctatactgtagagaataaatagaaaggataaggctattgtactattttgtttaagacgcaatcaccagcaaaaaggttgtaaacctctactacaaaatgaataaccattttcatatagctctcatttgtagtgtttctttaatacttttgttaatgaaactcatggttttgaggaaatactttagtaaattatgaatgtatttgcataccataagtctctactaccatgaactcaatattcttttaaagttcattagtttttagagaaaaattattttcaggtaaaataaaacattcaagttcttcctatcattgaggttcaagtgttcaagtataaaaataatgtgtttactttcctattggaaagaaaatgcatgctttttattttaaaattcaagcgaaagcacaataaataaaccttgtttcctgctctgtgtctttgtgtccatttttgcaagacactatttcacacttctatagagcatagagcattggtctttgctctatatttaaagtacagtagagatgtgatgctggttcagtataaaattgtttctttctgggccaagcatggtgcctcacgcctgtaatcccagcactttgggaggccgaggcaagtggatcatgaggtcaggagttcgagaccggcttgaccaacatgttgaaaccccatctctactgaaaatacaaaaattagccaggcatggtggcgcgcgcctgtaatcccagctactcaggagtctgaggcaggagaatttcttgaacctgggaggtggaggttgctgtgagccgagatcgtgccactgcactccagcctgagtgacacagggagactccgtctcaaaaacagaaatgtttctttctgcatgaatataactagctcattctgtaatctgatggattttttttaagtaaataaacttcacatcgtaaattaagtagattttttaaaatatcacctaatatccctaggacttacttcccaggatattttagatattatattcaattttcatacatatcattaagctctgcacatggccagaaaatgatttttaagtttttatcttgccatatatcaagtttttttgtatttgtttatttttactgtcaattatattaacttttagaatgcactgtatactttttccagaataaatgttatattctggtagctttgcagacctttagttggggattcatattaatcagaaactttcccctcctctactgtcctacccttaataagttattgtttttcagaaagaagttctgtatttttagggacaagtattatttttcttgaatgtattgttccaagagcataaattatttaaatctcttaaacaagtttaagtttgcaatgaatattttgtggctaacataatggttgaaatgtagtcttgttttattgaagtttttcattgggtattgaaaacataaaatattgcctcattctctatagatactaataaaaagtagtgtgcaacaaaaccattacttacatcttgtatgtcccagaaaaaaaaaatagacaatttgattagttgtaagcaaaatatgttcacttgtcttcattggatttttaaaaatatcaatatgaagaatatcaattcttaatagattttcaaagctattgcatgcttttattcaagagcctttataatatctgctgattcaccaaagatcctttaattgcagttaaatcaggataaactaaagtgtttaaaattgatcgtgatatgttatttccagtgatgatatttctaatatgccttctaaatgcaccttttaaaattgaaatgtgacttcactaaacatttatagctggaaaattgatttcatatgaaggcttcaggtaaaattataaagcttagaactgtgaactgaagaatgacccgctaaagttgagtttattttactgcttatcattactcatatttgtacccactaagatcaactacaggaggcttgtagtttatcattagaaacctagatagcccataatgaaatagtatccaaaatatcatatagcaagtggctacttttaaagtaaaagccatcttttctcaaaatcatgttcttaaatataaaaaaataacataagcatgaaaactaggagttgttttccatccaaacttctaaatcacagtttaatagaggcagtaataggaattttcccaaagaaagtaattctcaataaatgaaacaggggtagagtcataataactggtcatgaaaaaaacatttggatagataaagtaagtaaggagagaaggataaaatgtagaataggagaaatgagaaactgcgaaatctagagataatagaggcaagaggaaggtaaagggttagatgaagatagatactaaatgatctcatcagaaggaagctggaaagaaaattggagagagatgaaggataggaaaacgagtaggaagaaggacaggaagagagagagaggtagaggacatttcaccctgagctgtagctggggagaagaggatgggttctgcacagtgcttgtttcttgtattgtcagaattctaagtttccaaagattagtattttgctctctgtcttctatttttcttagttagaccgattcaaagaaccacctgcatatggacctatgtgtgatatcctgtggtcagaccccctggaagattttggaaatgagaagactcaggaacatttcactcacaacacagtcagggggtgttcatacttctacaggtaagaatagagaacttgctctctggaacacgtttgcatcataatgctaggatttatcagtccatgtgtttgatttatttataatgtttgtattacttctttaatataaatgaaaggctcactagcatttataaaatgaaaatataaataaatgaataagtgagtaaataaatgtgaaatagatatgtatacatatacaggtgtaccttggggatgttaagggtttgattctagaccaccacaataaagcaaatattgcaataaagcaagtcattatttttttggtttcccagtgcatatagaagttatgtttacactatactgtagtctattaagtgtacaatagcattgtatctaaaaaaaaaaaaacaaatgtacataccttaatcagaaaatacttcattgctaaacaatgctcatgatcatctgagccttcagctagtcataatctttttgctggtggaggatcttgcctcgatgttgatggttactgactaatcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagcactatttacaatagcaaagacttggaaccacccaaatgctcatcaatgatagactggagaaagaaaatgtggtacatatacaccatggaatactatgcagccataaaaaaggatgtgttcatgttctttgcagggacatggatgaagctggaatccataagaactattatttttgccccaatgcaacaaagtatcacaagaacagaaaaccaaacacctcatgttctcactcataagtgggagttgaacaaagagaacatatgggcacagggaaggggaacatcacacaccagggcctgtcagggggtggggggctaggggaaggatattattagtataaatatctaatgtagatgacgggttgatgggtgcaacaaaccgccagggcacatgtatacctatgtaacaaacctgcacattctgcacatgtactccagaacttaaaaaaaactccagtattaaaaaaaaaaaaactgtaccaaaaaaatccaacaccagccttgttttaattcaattatgttatcacatttaaaagttttaccagtttctgtaactcagatcagaaaaacaactttacattggttaaatcaatcatttaattccttcttacatttgtttatcaggcttcctggataaattaaaataagcagctttacagtatataggaaccatagtatatttatttttaggactttgacaagccaagttgaaaatatttttataataatttttacattttacaaatcgctagagatttacccattacatgacattttataacacttcagaaaggaatctgcaacacgattaggtttctgcatgacctcactgtcttcctatcgtgtcacctcagttttatcctcccagatgtgatcttcctcagtttcactaaagtctcttatcattatacatacagcttatgtgaaaattgcgagagtgaaagagaaaagaggttatgaagaagatgagaatttttaattttagaatacttactcctcctcttctcctccttcctcctcctcctcctcctcttcttcattattattattattattattattattattattattattattagatactgaagaacttaacctgatgttccctgaagttaatgctcaattccagccctggcagctaagctaatggcaaggctggaagaattctgtaaaatacatccagctgtgtatcttctgtctctagagtaagcaaatatccttctataggacgttgatctgatgcctatttagtagtaggacattttgttccatatactaagttttcttatgggggaaaaaaagtttttctatctgttgatgtgattgataaattaaagttcatgaatagaaaatctagtgcactataaagcgtctttcaaagtatagctttctttatatgaatattaacagagaggtttgttctaagcatatttattttaaaaatttatagttcacttctatattttggaaatgtggtttaatgaatccattttggctgaattaaagacgcatggtataatatttctgaaaaggctaaaatttattttcagtaattaatttgggagtaatcttttattaaagatgtttaaatttatagtgaaaagttggcattgttaaagtacgtcaaagttatgtgttcagttttccaaagctagtgttaactttctaattataccctagatgtttaaattacctgcttgatatcacagagttatacttcagtaacataatatcaaacaaaattcaaactcttgattttgatattgagtcctgttgcattaataatagtatagcattctattcgttttcgtgtcagctgttcaaatcatattctaagcagagtcccatactgaacttatataatactgaacttatataatattatggcattagacacagatgtgtatatattatgtgtgtatattataatatagacacagatatgtgtgtatattataatatagacacagatatgtgtgtatattataatatagacacagatatgtgtgtatattataatatagacacagatatgtgtgtatattataatatagacacagatatgtctatatattacggcattagacacagacgtgtgtatatatttgtaaaataaatatatagaatatattctagaataaagtctaccatctttaataatagaggataatcagagaattaaacatattttcacttttgttttcagcattatgattatttcgtctcattaaacatccttttttttttttttttttttttgagacagagtctcactctgtcacccaggctggagtgcagtggtgcgatctcggctcaccacaacctccacctcccgggttcaagcgattctcctgtctcagcctcccgagtagctgggattacaggcatgcgccaccatgcctgcctaattttttatttttagtagagacggggtttctttctccatgttggtcaggctggtctcaaactcctgacctcaggtgatccatccacctcggcctcccaaagtgctgggattacaggcatgagccactgcacccagcctcattaaacattcttaataaataatgatttttagctatggcaagtatagattatgtgaatagctgaatatctaaatctgtggcctatatatagactgactaatgtcaaagcagtctggattatgttttatctaaggaggagaaaaatgtttctcattctcctacagctttttggtccttttgtctttagtgccaccttgaaagtatgaaggcatcctctgggattatggtttataaagtggatctagatgggcacaagcaagccatgaaattggtagagaaccttagtggcaattaccattttgaattattggcaggtattttgatccacagctctcagttttatttaacatttgtatgtgtagtttgtgtgtttactttgctatgccagcctatccactatctaacatgttatctgggccattatttaaataaaataaagttatgcagaaaatatgcatcagtcagaatttaacactgttcctgagttatatcagataggcagtgtgacagagaggaaagaatccataagatctatgattttgccccaatgtaccattatctttagaatcttagaccagagtttgcacactcaaataatacctataatgttcaggcagatagttgagatacttggagcagggcaagtgttagattctggaaattagtgaggatcatgacaaattttcatttcatgtagaccaatgaaaactggcagctggatttggtgtttaggttatcaatctgtatttctgccttggatgaatcatataagctttgtatcctgggtttaccttgcttcaaaatgagtgagttaaattagacaccctaaagctcttttaaactctgaaattttaggggcatcttgacagtgattttgaagtgttttggaagctacaggtagcaactcactcaaatcactactggtcccttaatcacaaatcagcagccttctcttctcacactgcccagcttctgtgcagcagttgacactcttatcagccgcttccatcttgaaatcctctggttccttgtttatatatcctgattctcctctgacttgtcagggcgatcccttctcttcctgatgcctctttttttttgtctttcttctgctttggcatttttttcttcacactttcctctaggaacctcacctacacccacttccctagattcactgtaaactgtaaactctatggccagttcctgaatctatgtctagcccgcttcatctcttttcctgagctcaattcctgtatgtctagttgtctgctggaacttcttttctagggattccattttcaccttaacctaaactcaccatgcctgaaagggcttaattactttcccacttgcttaatccccactgaaaattcctcctgttttttgtttgttttttgtttactgttcattctcccagccatgcagactaacaggtgtctttgctttttcctcgtgtattgaaatcaccaccagtcatcacatctttataaatatcacaagcatctaaaccatgctgcctttcctctttcccactgtgaattcaagacctttatttttagtctattgaaatcacacctgagctctctgcttccaatttcattagtatcgtccctcttccctctacccaatgcatactgttccattcatgggtatcttttttgagaattttttcactcattcagttatttagcacacattagctgagcatttactgtagtatattctctctactaagtttttctctttttttttttttttttttttttggagatggagtcttgctctgtcgcccaggctggagagcagtggtgcgatctcggctcactgcaagctctgcctcctgggttcacaccattctcctgcctcagcttcccgagtagctagaactacaggcgcccaccaccacaccaggctaattttttatatttttgatagagacagggtttcactgtgttagccaggatggtctccatctcctgacctcgtgatccacccgcctcggcctcccaaagtgctgggattacaggcgtgagccaacatgcctggcctctctctactaagttttatagatgctgagtccctgccttcaagaaaatggcagtccagtagcagagctcacaaagcagaaacagacaagtaaaatacaaagtgaatagtgccgtcattataaatgtgcaggctattacacacacgcgcacacacacaggttggtggggagggggagagagagacagacaatctgagtgagtgtgttgggaatcctaaccccaagggggaatggattaggttcaagggactattcatgatgaaggcattagcagacctgagttttaaaggattagtagaacatatccaaccagagtcattggggaagatttttgcaggcggggaaagcggcatcatgaaaatatgaaggaatgtaacactgggaattctgcagagaaggtcacctgatcttacttcacctctactcccaaattacattagctgcttcattatctgttaaaactgaacattcatattaccaagctattcagcccctattttatatcctttagaaatgtctctataagtgcatcaaacgacatgtgcaaggttaatcataacagccaagaaatgaaaactcggatatccatttagtagaatgaataataaattctaatatatttatacaactaaatacagcaaatgagaatgagcttactaaaactacacataacaacatggttgaagatcccaagcataatgacgagtgaaagaagccgatagtgaccagtagatactgtatgattccactgaaataagagttcaacatcagagaaaactaatctttcatgctataagccaggatactggttacccatagagaggaggtgacagtaagagaaatatgaggagtttctggggtttgataatgttctgtgtcttgatcagagtgcaggttccaagggtgttcactttgtgaaaggtcatcaaattaatttttgcctttttctgtatagatgttttactttactaaaaagtttgccttaaataaaaattgcttgccacttctgaacttaaattctggaaaagttctgtcaggaagagttggccccttaggacttgatccccattggacaaaaatgaaattagatcaagaaccctgggacaaaaaagaaacacagcaagtcctaggaaaaggtaggtctgacagcatccaggtagccccaggacactcctgggctaagtacccattcccaggccccaagaagcagaggaggagttgaacaatcaggcagggtcttccctattactggatctggaagaggagaaggacaccaaagagactgtggcttcctccttgtgtattggcaggggattgcaggctgcctgcctctgctttgccaaagcactgagggaggagggaaagaaaccctttgcatctctcacctgcttgactgcccctattgaagctacttcagcaattgagcataagccccaataagctgacagattgctgctaagcatttaagatatgaaaatgcaaatgaaaaagcggtgttcctctcctaaggcattcactattgctggagcacagaagtagaaatataatttacactacaacatgataagtgatatattagatacatatattgtaggaacacagtggatacagcagttgtgtacaccttaggtgagatagccttgaagagaatgcttcacaggtgataacttgtgaagacttggcagaagaataggcctttccaggaggaaaaactgcacagggaaagtatccataaaggcataaaaacatttaaaaaaaaaacattttaataatgcccactagctatgtcatggctaaagagtcttacatctgggagattaaactcaaggttgaaaatatagttcaatatgatatagaaacaaatacaagagaataaacagaattaatctaatagtaactgtttgctctactgccaagccaatttttctaccatttattacatttttttcttttctaccttccttatctttgttcctattcactcagcttctgatgatccctcttcttttccgagcagaattctaacccctttcctatctaccaatctgcatacgtcattctctttaatatataacaaaagatagatatttttcaaaaagatttctctgattaatttcagatgctttcttgcttgctttataatatctttataaaacttctattttatcttcaatgtgttttataatatagtaattttttaaaaatattttttataatgctttatgttcctaagataataaatacccttaggacagaaacctgccttgaacttataccgcccctccctgtagctaatactgtcttctaacaaatggaacaatcatcactgggcctctgctaaattactggggaataagtgatttttcatctctttggggtgtttaggtgttagcaatatgcttttcctgccgttctctctctctcgctctttctctctctctctctctgtgtgtgtgtgtgtgtgtgtgtatatacgcagtgcttttcagcttgaacattttgtgatttgtgataatttccattaaaaagcataaaagtggaacagagtttctgtttctcttttctaatactattagaaacttctgtatatcctaggtaaatagttcagcaacagtgggaatctagatgatattcaagtattgtctagatctatgaggaaaatgttggtatttctttgaaaagctgagtatatgatggcatatgttttgaaaatgtctgaagtttttcttcaaaatgaattccctccaagtcaataatgcaaatactcctcacttaatgctgttaacctagcaaattggcacttgattaattttatttttttcagatttccaataaaaatcaggtatatattttcatggggaaaaacttagcttaaacacataagggtatcaaacttagtgtgacgaaaatattttaaaattattctttcttaagaatagtgtaagttgttccaaaagggcaaataagaaagggcaactaagtcgtttaccaagggcaaaaaagtgacagacatagtcaggcaacctgtctgacagtggtaacaagacagtatacttctatacagaggcattgcgaaggcacaaggaatttaagtgaaggcctcaaaaaaagaaaaaagatagggaaggaacatttattgagaacctattctgtgccccttagctgggccttttatagctaatatataccaaacaaatctgctgtttttgaaagaccaaccagtatctctgaaagtaaagtggttttttctttgtttttgtttttgttttttttctctgacacacacttacctggaaaggtcgtatattcacttttctttaagcagaacagaagcctttgaagacacatgttggtcaacacctgattctgggtaccagatgggcatgtttccatgcagagactgggccatcctctccagtttctaagatacactcatgttcatcagttagatgttttatttattgaattgactggggacaactaggaagtggaggccccatgattatctcctctttttctccctttctcttacaaaacacactacacatgggcacatgaacagagactgttttcagtttcagatccctttttgccaaagaactgaatcttttttatagtcagtatctctataactgtatgttatctttctttttttttttttgagatggagtttcactcttgtcgcccaggctggagtgcaatggtgcgttctcgactcactgcaacctccacctcctgggttcaagcgattctcctgcctcagcctcccgagtagttgggattacaggcgcccacccctaagcctggctagttttttgtatttttagtaagagacagggtttcaccacattggcaaggctggtctcgaactcctgacctcaggtgatctgcccgcctctgcctcccaaagtgctgggattacaggtgtgacccacgatgcccggccaactgtatgttatcttaatgataattttttcctgttggtcagggaatttgtacaaaatgtgtaacacagaaactatcttttcttttataataaattatttgaataacatacattactagaatgtttccctgcagtgctatttttataattgatgaatgttttcaatggtatatagtttaagttctagtgaatatttgcagtttgaatattggttttctgtaccttgatttgcattgtcaaaaatttatttttataatacacatttgtttcattaaaagttcttagagcagagacataatgactgtaaaaggtttttcaggtttaatttatgatttgaatttcatttataatgaagttatttgagtttgagactcttaaaagacaaacataattgtatattggatgttttatttagtcaagatagataagtcttaagataaagttctgctgatcatatttaaaggacaaattctaaagccttgtgaatatccataattttgtttaggttttgaatgatataatcatcttattgtacccataatgttagataaagcaataacttgatttcccaccgtatgggaggagtcttaaatctgggagattatagaaacaaaaataattaggaggcagaagagagcatatgtattctcttctgcctgcaaactcagttatctctgttgtatacacatacatgcacacatatgcacaaatggtgcaatatttgagaaaattgagacttatattttaaattcattatcttgttatagttatgctccgttcactttgtctttaaatgtagacttttaaaaatttatttttctgagagtggacactttcctaatgttttataatggcttatgttttttcccccagttcatgcacctcaacccctttctgattatgtaaaaagtacagctgtagatgctttttctgccacaaggataaacttggccttagagtcaagaggcttgtttcatgaatgatgtatgtttgattatctttgatccagtcacatagatctggatgttagagataaatgtgctactcctgatgatttcctaacagatgcttcccttttctttttgtctctggcagttacccggctgtatgtgaattcttacagcacaataacttgttatctatactccgagcccacgaagcccaagatgcagggtgagcagttttgagcatttataaaaaccatgcattgtccattttccagaacttcctcactttgcttaggctctgcaggttcccttttaccaggctcactcccaaaaggaattagagcttaaaattatcttctgatggatgacacaggtatgacagagtcctagggaatgaatggctgcagatgtatcgtacagtctcccgtaaagttcttacatctttagcctgaacaagtccattttcagcttgatttcttaagtactgtaagggcacctcctcttattcctctcaattgttgcatttacactgtcatataagtgagtaaattaccagctacttttcagtcttgttgaaaatatgaatgagaattatactaaatatttaacaggtattgcacattttactgttgttttaaagaataccattcctaatcctgaataccattcctgatccctgtaatatccctgattttaaagggaaaggaatagggacatctttaaaaacagggaaaagtttatgttctaactagcaaatgattaaataaagttgattttgtctcacctggtaagtttctaagatgtagaacaattttggaggtttagaaaattatgaaatttcagatgttcactttaatagtatattaaatctacattagggagaaattagactacttttaagatttgaggtctgataccgtttcccagtaggctccactgaaaggcattgcttccctttgaataattaaactcatcccttcatagtctaggttttctgaaaagtagtagcacttctttttataacctgtgtgctgaaattgggaatatagatacctgcattttgaaggaggcccatgtctatgacatccctgaatcaaggaagataccaagttcatttcacaattagctgttttcaagcaatcagtcaacaggtgtgaacggatccagtgttatatactcactgttttgtagctgatgtttgaagtaacctgtttatatacccaaccagtcaggtcttcaaataattgttctcacttgtcaaggctatggtgtcactatgctattttggctgtgttccagtcggctgactgcccatttttggcagatttatcctgattgcactacctacccataaccactggcttacttgaatgtgtgttaagtgcatcagttaatatcaagtatttttgtttaaaatgagaagttgattgattcattggaaaaattgagattatgtcatccagtttctttgtttttgtttgttgtcaagtaggcatagtcaccctctgtctataaagtcaaggtactaggattaagagtgaaactgtctttcacatggattttgtttccataacgaagctcagttccataatcagaatacatacttttagaacatttcaaaaggtttttaagggggcattttcttttatagtatgaccaagttccaaaaagagaggactcacagtgtttttaaaattataaatgttaaggtggctgtttatctatctaaagatactttttgagctgcttttagaacctaactatattaggcacggttcagtctaccagaaataaatgacacagatcaacgaagaaatgataaaatgttgttttgaagaggtatttctaaactgatactcctaaaattgattacacagaagtcatgagatacatttttatccttatgtaaaagagacacagtcacctgtatttttaattgagaactaaagtgttacattataaattatttctgcttagtaactggattgttggtttatttccaaagttcttgtgcatgttctgtttcattactgattgattaaatattaccctgctgagacaataatctttgacctgtagacaccagcagagattggtaataaataaaattctaaaatagaaacagtctcaatttgtaaaatttcatagatttaaggggacattctttttaaagaaaattacttagtctaggcaaaaatgcttgtatatactgcatctaggaattgcattaaatctatgaattaaatctaattattaatctaaaaattcataaatttaaggggacattcttcttaaaatcacttagtctaggcaaaatgctttacagaatattgtggatttatcagataattggcctggttattagtggtaagtctttgtatcttgctctacttatttggtctttttatgtcaaaaatgttgacaacattttgaaaattttgggtgggtacaaagtatctgtgtgcactaatcagccttctgttgaacacatggaaatgaattatgattttccaatgaattccaccctctcttgaggtttgctaacttagaaaatacctgtttggaaattttacatatgaatgtatgttttcatacccacccccctgaaatgtattaatacctgtgtataacaggcttcagagataaatttttatttagtgttatatgattggaggccctttgaatgatggaacttgactcatctaattttctatttctcaatctatgatttgatattatcttttttccatacaagctttgttttgactgtatttgttctttttaggtaccgcatgtacaggaaaagccaaacaacaggcttcccttctctaattacaattttttcagcaccaaattacttagatgtatacaataacaaaggtaagtgtttttaaatacctcttgcagtcttacataatatgtgtaataattcttaagccgttttattttggtttggtcttaagtattttaaccagtctttttttttaaaattttttcagttattgtttcatgcatactttgtgattatcctcaaagatacagattcaaatttggtcagagattgggcttatgcactattaattttttaaatgttttctaggacattttaatttttagcagggttgacagctgctgctctagtagacaaagactttaaaagaaataataattggaaataatccaaaatcatgcttcttaaaaagaatttggatttaaatagaataagtgtgattgtccatggaaaggatcaagaaaaataaaaaataaacccagtagcttgaaattcaaatttgaattgcatttattgagtatctaccatgaatcagttcctatgctaggcaagtacatgtttatttctttaaaaagcaaaaaaaagtaaacttcaaggtaaatattattagctactctacctcctccttctttaatatgcagactgagttcctgtggttaattgccttgtccaaggtcacttaattaggaagtaatgaactaggttcaaatccatacttctggttcagtgtcctgtgccttttttctgaaactccatgcctgaaagaaacatgaaacaagagggcattattacttactacagggaaaagaagaagagcaaggggtgcattattatcttgtttcataaatgtaatctctttatttggaaatattataaagtgttccacatgtgtcacatgcgtgataaaatgtgaaaaagcctttaactctatgtagcattggtctggatattatataggcagcatgtccgagtgtggctttctgagattaagagaaatggatcacgaagtcaggagatcgagaccaaactggctaacacggtgaaactccgtctctactaaaaaaaacacaaaaaattagctggccgtggtggcgagtgcctgtagtcccagctactcgggaggctgaggcaggagaatggcgtgaacccgggaggcggagcttgcagtgagccgagctcgcaccactgtactccagcctgggcgacagagcgagactccatctcaaaaaaaaaaaaaaaaagagaaatggaaacaggaggaaaaaagcgtcaaataacatatctaaggtcaaatatagcccagaaggggtggtaaaaggcagcctagtttctgcaccagtctgaaaactcctggaattaggagccatgccccttcataaatgaggtgtgatgggtgtcttcctggcccaggcctggtgtccaggatgcctaatatgggccttggccacctttattcccaagcacctgttgaatgtccttagtcctttgtttcctttcatgtattccactttcccatagcccagagaatgacatctgctggatggtgtttgctgttgccatacggtcttttacattgccgttttgaccatagtgggtcctcctctatagtgaaggagcatggttatcagtaaggcatagtgcagtttttgttgtaaccatggggaagaaaggaggcagttcctagaaaagaagtgctgccattagtagtctatggcaagaagaatgcaaaataaaataaaacatgttctctgcttgccacgtgcttttaagtatgtgggagtgggagtcagtgattcactgctaaagtgaagattattgtatttgaataaaattgatgtcacctagaattttgaaaagcactgcaataaaattgggtcacaagcacctttaaaacacaatcaatggaaaaatagctgtgaagaacctatgagttaatcatttgattgttagaaacaaatgatcataaaggaccctagaattataagctgatagttacagtatgatttgatttttaaaactactgtagagttgacaaagtaagacatttgggtaatttaactaaaaatataagacccaagatgattaagtgtaaacaaagagagtcaaacacgaaatacatttggtaagggataattttctagaatggtcagagaaggccttaagataaaatatgatctggatgttaaagaatagtgaatgtttgattagaaagagaaataaatagtatcagggccaatgaatatttttaaagcagtaaacatttattgtataaaactcataaaagctaatctctttgactggatgaggattctcaatcttgcacgagagaaggaccctgagatacctgcagggaatgcaggaatttagtaagtcatattgtatatcccagtctcaccatgatcctataatttaccaaaagtacataaagtatgcttttatatattttttataaacatgagtgtattgttctatggcattaagattttttactattaaactgagggaaggaaatgtccctaaaagtcattttcttgccaaagactgattactaaatagcatgtactctgcttagaagtttcccaacagtttctaaaaaagaaaaccaaaacagtaaaaacggaataaaaattgggattttactccacaaaaacaaacctagactctttcaattcttcataatgctaggtaatgcagttttgcctgagaccagtagctatttctcaaataaggtgtctatttcttctttttgtatagttctgatttaacaagtttggaacttaaaaaaaaaaaaaaaaacagataccagtgcatcactgactttgagattttgtagttctttcactgtgttcttgcctttggggtagatcagaatctctcaggaaagggagtagaactgtttcattttgggaaccccttcataaaagaaaatattctccggagagaaaaagataaactgatagggaagagaaagatgtattctttagtttaaacaaaatttcaaaagacttttatgtaaaatttctgaagcactttaaagctattatactaacagtgtatacagtatgtgggagtgggagtcaattattcactgctaaagtgaaaattactgtgtttgaataagattgatgttaactagaatttttaaaagcagtgtaataaaattggattgcaagcaccttcaaaacccaatcattggaaaatagctgtggagaatctgtgagttaaccatttgattgttagaagcaaatgataataaagtactttggaattataacctgttagttacagtatgatttgattcttaaagctcctgcagcttaagacagcagtaatactatctggcaaaatgaaacagtgagaaaaataggtttattcttgccatcttaaaaccaataatagttgtgatcagattcatatttaaatgcccagtatttcttattagtagttcatacttatctgtaattaacaaatagcattcagaaagttatgaggactaaatgttccatctcttggtatagcccacattaattcattcagtctcatcctttccagtctgcactgtcttcctgcctgtctccctgcctctgtgtcttcactctgacagctctgcaagatgccatagcaaaagatgtaggtttgaatctcagctctgccattaagcaactaactcatgtaaatttattggacatgcagtggcattgctatgagatgagaaaaaatgttcgtttgtgaatactgcatgaaatcgctttgaaacaaaatgctgtgcagtattaagacattatcattattgaatattttatgttgttattattttgtcacatgttagtgcaaagcttcacagaagctcgcaggaaaattcccttattcctcagtttcttatttataatttcactatatgcctgaaactaccattatcacctgtctctctgcttatcttggagtaaacctcattgccctgagcaactttggctttctgtttctccactttttcacctgcatacttatttctatccaaaatatttgtctcattcttctgcctaagtggactagacccactccagtctgcgtttccataaagacttctgttggtggtccttctctgaatgtctgcaatgctaatcattttctcttgtatttattgtttacgtttttcttgttagcttttgcatgcattcctgttatttcccaatgaggttataattagtttgacacatgaggctttttggtacacattgtaaagccaagttgcatgccttgtacgtggtaggcagtcaatacatgcattgatttaagcatttttttttttttttggagaattaacagcaagactgtgaccagaagtatcctatcaatattgacccacagatctttatctcactttaaatcactcctataaccagtgctgataccctttctaaattggagttaaacatttgcagagcactttgcacatctggattgttgaattttctcctgtgaatctgtagacctaaaggaaaacctatttcctaattactcaaatacaccaatcaggtgaaaattacagtaatgacacatagcttcaatttttaaaaaaattatttgccccctgtaaaagtgattttaactatacccactcaccaatacaataaacctttattgagaacttactatataccaagctccatgctaggtgttggggatataaatgaaacaagacagacatggtctttaacctagtgtgcttaataatctggtagtatgatagacattaaataaataattccaccaatgattatttatatgtatttggaaaaagcaacaaagaaaagagtggtgtgatatgagagtgaaaattagtctatggggactaattggggaagtgacatttaagcaatcagtgagagtaaaatctctctggattgagaaatagagtggcagatgtgaacattggcttaaacaactcagtttggccaaaaattgcaatgaacctctgggaaaatgtattttataccttgatgtaaacacttgaattcattttctctgtagaggtacacctgtgcttcaaaagaatctaaagtaaacgacagtaggtttccatgtggtacaagttctttgtagttcagatgagttgttggatggacgggtgattagatgagtagttagatacatatgtagagaaatataaacatatataccaggggtatgtaacttagttccagtacacactactgacagtaaaattaaggaaatttgttaaatgaaaattattttggatttgagaggaaagtctaatggcaacgaaactaatttagtaatcaagaccaaacatttaaatgataaccaagaaacaaaccaattcaatattaaagtagttaaggaagagagaggtagaaaattgcttttataagatgcacatggaaagcatctgatgtggttttgctgtgtccccacccagatttcaccttgaattgtaataatccccacctgtcaagggcagggccaggtggagataattgaatcatggaagtggtttcccccatactgttctcatagtagtgagtaagtctcacaagatctgatggttttataaatgggagttcccctgcgcaagctctcttgcctgtcaccatataagacatgcctttgcttctcctttgacttccaccatgattgtgaggcctccctagccatgtggagctgtgagtccattaaacatctttcctttaaaaattacccagtctcaggtatgtctttattagcagcgtgagaacagactactacagcatcatttgctaaaattctgagatgcaaaagtctatcctttttgatagggaaaaatatgatgttttggactcataaattagcaacttgatataattgctgataaaaagcattttactcttgatgttttccatatcctcatatattttccaatcaaaaaggagtcataggcttcaagaagataccatttataaataaaaagagaatttctggcttggcaggaagataccattgtaagagagaatggaattgctgctgtaatgaaccaacataagaattttgttggcagtcatgatgtgaacagaaaggagcagatgtaacatatccgatgccagcttgacttggtctcctgacttctggcgggaaccctcagtgacactgtctacatagtgtggtatggccagacctcagaagctcattccatactataccacaatttttttccactaggaggttgttttatcattcaggaatatttttcacaaacttatagatatctgctacccctgtggttcacaagccaaattcagaatcagctagctcagatctttctgagagggagatgaggggtctccgaaaggaaagtggaatctatacccaggcgtctccaagtagcatatctgtttccaccacagcacatcaaagagctcactcccctacaaagttgaaccatattttacagcaaagatccatttctacgagcctgaggcttgtcttaagcatggacataacttttagtattgacttttaaagcactttttttgtatccttacaaccacaggttaaatatgatcactggttgctttaaaagttggataaaattaatccagagactttgccccgtaacaacagttttcccagcatatgctttttccctgccatcatctcaaacctgaagatcctcttaatgggtcctgagcacttgtttgccccagatcacttactgcagtataaaaaacgtaaacatacagtcagggcagtatatttggtactttctagtaattgtaggccaaggttgttttacttttttatttttgttttttgactaaagtaaaacaataagacatccccccaacccctaattcattccttcatttatttgataaagattcttaaagccatatgggtatgatagaatcatacacactagaagataatttattcttaatgattattaagcctaagagagttcactgagaaatgttatgaaatacaataatttatatgaaggaataaagtagaaattacaaacaaaacctcttagtattcttttattatcagtatgaggtggtacataggccgtgtgcatcccagcactttgagaggctgaggcgggcagatcatgaggtcagaagttcgagaccagcctggccaatatggtgaaaccccgtctgtactaaacatacaaaaattagccaggtgtggtggcccgcacctgtagtcccaactattcgggaggcagaggaggaagaatcgcttgaacccgggaggccgaggttgcagtgagctgagatcacgccattgcactccagcctgggcaatagagtgagactccatctaaaaaaaaaaaaaaaagtatgtaagtgtgtatatacactatacacacacacacacacacacacacacgtatatatatatggtggtagaaaagaaatttatgtaaacatttaaggctgaagagaacccaagggtaggaagttttgattggcttttagaaaaatcaccctctgagatgaatgattaaaattcactgcagagaggtttcaacagaatgtctcctctcattgcattttatatccaagattcaatatgtgtaattaatccaactgtaatattaatttcatttaccattgtnnnnnnnnnnnnnnnnnnnncaatctcggctcactgcaagctccgccttctgggttcacaccattctcctgcctcagcctccggagtagctgggactacaggcacccaccaccacgcctggctaattttttgtatttttagtagagacggggtttcactatgttagccatattttttaaaatcttcagttggttatatatttagcaaatataaatatttcccttcagttgtgatagcatactatacttatgctgttcactttgttcctataaatagcatataataataactaacatttttgagcacttattatgtgccagacactgctcagagtttatgtgtataaatgcatttagtctttcaacaaccctatgaattactgtataatcttgatattattgatgaaaatctagggcacaaaggaactgcatatttttcccaaggttgacacaagctgataccagaaagcactgagattgaaactcagctgactgactgcagagcccacatgcccatatattaacctctgtctgtactcttctgccttagctttgttgtgtgaaatgtttgtgaacgatccactaatccacccttcacctcatggttccattatgtttaggtgactctaaccattcttcaataagaaaagaaagcttttgaaatgaagagtcatttgttatcactttaaaattacctgagtgttatgcatccaaatacatgcattattaaaagaatgaagttagaataccttgtacatttttctaaaataaataattcatttctccctttaaaatgtattccctaaagcacttttgcttttgtttattcagctccactgtgaaagtgtcattgctggaggccactttgtaaataggttagttttaatccagtagtcacttgctcacatttaaacatttaattaatggaagggatggtagaatataaactatcccattaaaatttaatattgaaagattccttgtactatatattttaattgaatgaatctacacataatctctgtatctttgtgccaacagatgaccttcttgatttcttaaaaatcactactctctaattgtaaatttagttaagtagttgtgaaacctcaacaaagttaagacacagtgtgtgaggtaattcttgcttttcacaaagctttgcctatagaattacaggatttcagatgtcagagttaggggagaccttaccagggaacaaaggaggagtcaatgctgaatcctccatacagattcattgccaagtgctcttctgccaccagctgaaaagggtcaatcaaaaaatccatcttaaagtattgaattccgttgtctgatagccctgatagttgattcttcagttgaactaaaacctacttctttagaaatctcattctctataaagcattcaacaagagaaaaacagtaacaatctgaggaatgttaaaaacttgaattaatgggttgtcacttgctattcattatctaggaattctagacctgcaagagactcttagactttactcttacagtgtcaaaaagtctgtcataacattatttccatggaaaacaatgttgatatgaagtgtaggaacttaaaactaactcagtgccaaggatatcttggagataacctagaatcattgcaagctatagctcaaggcctgatacaaagtccaagcttgaagttgaaaagggtcttctacgaatgtgtagtgataacaccagtttcaaaatacctcccaccagagtacagttacccttattaggcttttggagctgcactgaatgagagcaaggtgaaggcacagtgtttgctatgcccgtgccatctccaacagcttaaagcttcagctaagactctctctctctgtttttagtctagatttgtgtaagcctcactttagcattattataatacagattagaacataaatgaattcactagctgaaactgttaaggaactgataattgccaatgtttcttccttattaacaaaaaaaaatttgctagaagaaattcaaatactctatgcaaaattgtaatgttagaaatgattcacaatgtttaactggacttgagctacatacaaagatcaattatcagccccaaattccctggatcctagtatgtaggtataacacattaggtgggaattataaaatggcaaactatttaaaatagatagccatgcctgccttgaggaatttgaaacagacttataatacatttctcagggacaaaatatttcatctgattattatgcatattaatcatatgtattatttttttccctggcccattctcagcaattggattatttcatctttatactttaaaagtgagagggcagatattattcctattttataagtttggaaggtaaagactaaataaggagaaatatttgcccaagttcatgcagttgccatgtgacagaactagtatcctttccactgttctttaatttacatgctcttacaattttaaaacagtttagcctttgaggtgacacattgccttttacctgaattgctttatgtttccctcagatttctgtttatattttgttagttatgtttttagtatcctgattagttatatgctttgtgtttctttcctctctttttccctcttctcccattttctattttcattccttaggttttttcttcaaacaacacaattaagcatcaaccatatgccagatatagtacataacactataaaaaaaagggatctgtgcctccctcattccttctattgtcttcttcccacttactttacccaaaattctatatatgaataataacctagttaagaatttgctaaccctatatcaagaatggaaacacatacagaattgaccccggagcaacacagaagttaggggtgccaacccccactgcaatcagaaatccacatataacttttgattcatcaaaaacttaactactaatagcctactgttgctcagagccttcctgataacataaacagtcaattaacacatattttgtatgttatgtgtgttatattctgtattcttatagtatataatacacaaaacctagagaaaaaaatgtcctgaaggaaattataagcaagagaaaatatatttactattcattaagtggatgtggattatcataaaagttttcatcctcgtcttcttcatgttgagcaggctgaggagaaggaagaggaagaggggttggtcttgctgtctcaagggtggcaaaagcagaagaaaatctgcatataagtggacccatgcagttcaaaactgcattgttcagtgctcaacagtacacacacatgcacacatgcacatagtcataagattacctcatattgtttcacagaaatatctattgccatctctgcccttcatgtaggtaagataatatgagtattttatttaggagacttgtaacaaagtttgaaaaggtgttgtaggtactatgaaggatgcatgtacaagttatataaagtatatagaggttgagaatgtatttccatttccacctagtgagtaagaggagtggggcaagggctagaatggacataaagtgattatatatagtaacatatatctgtgtccttgatacacacaaaataattctcatagcttcaagtaagtcatatatacctactatttgtatccactaataacaaaatatttcagattggctgaaatttagtcattatgagccaggcatggtggtgtgtgcctgtagtcccagctacttgggaggctaaagcaggaggatcacttgagcccaggagttcgaaactgcagttagctatgattgtgccattgcattccagcctgagcaacagagcaagaccccatctcttgaaaaataaagacagaaaaatttagtcatttactgaaaatttgcctgtgaaagaccctatattaggtactggatgaaacaatataaacattaactttcccatactgaagaatatcatggtcaaattacctaaaaatttaaggcttgaagtctatcttcataagtgacttgaacacataactttcacttaagcttatgatctaaagagtaaaagttatgaatacagtccttgctcaccaaatactgtcaccatcatgaattagtacatttccctttaagttattaataatattaaaataatcttttgaagacagaattcatccagcaagaactaggacattgaaggggaaaaaaaggaggtggaagttagaagtcagattttaaaatggaaggaattgtagagactgtgttcatgaatgctataatatatactacggaaaagtatgcatatatgtgaatatgcatatatgcatattcacacaatcttaaatgaaaattgtacccccaaaaagtaatctttatgagaaaatacagatttttgaaaactaagtagcatggctcccagaatttaaaaaaacccctgcatgcagcataccagcataatcttcaaatgctgccatagaacattatgagttgcatgggtcctgcttcaggaattctatccaccaaggcattatgcctcctttcgtgatggtaggactttgccaaaagaacacactgatgctagtttttctgctagggcatctgcgggtggaagaattggaaggaaaaaacatcctgggtctattatgcaatttatttgtgcttttgctatttctggatggattatgattctggaatgcccccattcggtttcttctcatctttgtttcttttctctccctctttcccatcttctgaaggtggaagaggatggtcagttagagataaggagatgaaagacagtagcaaaagggtgagaacaggaataaaattcaagtcatttttcattcttttgacctcttctcccctgtcttaaaatcaggactagtggtgtgaagaatgcctgaagtatgttggaatcattacagttacaggtttttcagaaaaagaactttgtattcctctggacacccacttgaaaagtgcttagtccatgtgtggtttggtaaactggttaataccacttgttagcaataattttgatagctggtctttaattagaagctttttattattattattattattattattattatactttaagttttagggtacatgtgcacaacgtgcaggtttgttacatgcgtatacatgtgccatgttgctgtgctgcacccattaactcgtcatttagcattaggtatatcacctaatgctatccctccccgtccccccaccccacaacaggcctttctactcttgtcattcattgctttgtctctagtttccctgggtgatggaaattgtagagagcatgttgcgaaatgttttcatgttcttatgaaatactagttgtttttttttttgtctcatcaaaatttcaaattaaagtaagaaagaccccctgttttacagatttggatatggtcaggcaacttagtacatggcttggtagacagagcagtggattaagatagagattctattctttggacttcactatgtacagggaaccagttgtgttattagaaataatcgaggttcagtccgccttccccattcaccaagtaggagcaggcccttgattactaattttacatcttttacagcatgtctttgaacacagggttctacaggtactataaaaatgagtggattgtctttaagacagtaattttgacatcagaaaaaggactggcagtcagtcttccagattcgtgggattagtattcttttcattataccaaatttccttccagctgttcttcatacctgcaactacaacagaagagcatttatttctgtggtgtctggtgtgctctgaatgatggttaataatgtcaggcctgcatgtatgtcacagtctctctgttacaattgttaagtgacaagaggtcatgtggaattgccagtagaataaaggagctccttggtagtagacttttgttctttttttctctgtttctcagacaaggtctcaggaggtggtcttgagtgattattgaagtacaactatttgtattatttatattgtactggagataaacgtctttcaagtacttcagagaagagcgcactgttagggctccagttgggttttgtaatcccaatgacagtcggaggcaggtggcaggggcggaggatgtgggaggtggaagatgaaacgttaactgtgaatttcgtgactgcagatattttggactgttttagtttttttttctcatgtatttctgtgttatatatttattttacaaaaatatcagaattttgagtaacttactaatgtaaggttattcaaaaagtatttttgcataaatgtgttgctgaagaaaaaagaatacatattgttgtagtttcatttttaattttaggattttttgagctagagaaaaataaattctatttataacctatagaactactgagaatattattttttgcattagtgatgaggcctttcattgttaacagtgaagtttgttaacatcattcagatctggaagagactttataaattatctataaacccacgtagttaggtaactgagacttaaagatattaagtaccttagtctggtgaataattagtgacagattccatcttgtagtctggcctcctggctttccagtccagtgctcttctttaaagagattaaacatggaaggagaaagaatgtgtgtccaaaacttgatagacactgaatgatttatactattaggatgagtgtattatgatgtactagaaggatcagagactttagactcaggccaaaagtgagatttacctctttctaagtgtgactgtgggcagataacctctctgtttgcttattttcaaaatataaatgataagaaccacttttgaggaatattgtgaagatttgtaattatgtttgtaaagggccacacataatgcctggcatatatcagatactcagtaaataaatgaaaataaaatctgaaaacaatatttgctttatcagtaggtactcaagtaaattgtattgagccaaggtcaaatgaacttttatctcaccaactgcaaaacagaacttctgttttatctattggatgagacttacccttgcttgtaaattgcatcctgtttcactcaaacgtgtattttggcaaaagctaaaacctctttaattatgaaatccatattcaaagttaaattattataacagctaggactagaattcaaacatttataatttatgagagacagcagggaatgaaagaaagggaatgaatttggtgtcagaaaaagctgagtttaaataatgagtgagatctgtcacttactggttgcatgatcttgagcaagtttctccatttctcaaccacaattcctttgtaacataagggcagtcacacctgcttctcagatttgttgtgcggattattatataaagcctgtctgtttcctccagggcactgttaattataatatttactttccttcctcctgctataccaccaacctaaggttaataaaaagtgggggaacttagaggagaaattactcttcaaaaagacaatttagagccttaaagattcatctgaagatatgaggatgcatttctgctgtgaacattcagtgttctgaaatagtaaaaaccttttacatggagctagaactctggtagcacttagcaaagatgggaaatacttcacctttttcatactgaagatcaaaagtattgatatgatagtttgccttgatttttttattttgcatgtttttagcatcatgtaaatgtatcctaatggcataaatgataaagcaatgtaaaagggaatgggtttacagaaatatatgcaggaattagtattccacaggaagaagaggataactaccttcatatcagtattgcctacactatctacatttcttgtccccagagtgtctgtgattatatgttccctggaaccatgttggtcagccagaaatagcaattcaaagcaaaggccttaccattcacaagtacaagtttagttaaatgcaggctgctaaaaacatcaacatattgttaggctacaatatgatatatatagtatccacaccacagaaaatgatatattctccccatactctgcactgttcaaaccaacctagatgattatattacttctgggccacattttaacagagacattgccaatctggcatgcattcagaataggttgagcaggctgagctaaagcatcaagaagccatgtcatattaaagagggcgaaaggggataaaaataatttgcttgaaaaagattgtaaggcagataccaagatgtgtctccagctcctgagcatccattctgagtaaaaacaaaaaagtaaagaaatgattactttttctgtattttcaaccccataacataagcaagaaaagatcatatgatatcatataaaatctgttggttactgtcttctaatgtaatacaaattatgccctgaatagataataaaaatgaaatcttgccaaagcctaagaaggtatgcttgagtatcatatttaatatttaaaaggctgtcattcagaagcagaatgacattaaatattaaatatgaaatgcatagcaaaaccatgatcagtgactggtaaaggcaggtttaaatgcaacctgagaatttcctgcaacttcaaattgtctatccatagaataggtgacctcattaaaacaggtgacttttcctttattgaaagtactcacagagacatgaagcatgcagatttgtcttcctgagtcatggatggacatctttttcagaaatcaaggatagagtcagatagaagcacattattttatgtgggattcaatccaaacattttattttattaagtcaagaaagcagtctactatagggtaactatagttaacgataatagattataatttcaaatagctggaaggagaatattgaatgttccaaatacaactaaatgataaatgtttgatatggtatttaatgtatagctaattaccctgatctgattactgtgcattatatgtgtcaaaacatcactatgcaccccataattatgtacaattattatattaatttaaaaaataaagtaaaaattaaagcaatctaacttaaactattttgtacaactgttgggagttctattgaagttttactttttaaaaataaattcattcaaatatttgaggagattattatgtcaaacttagctgtgccacttttattagtgtcatcagatatcaaattttaagaccaaagtattcttggctgaaaggggagcttgaatcagttcctgacagacattggattaactattttgtgtaaatattttccaatttgttacacaattacatattaattattcatatattgtgcagttatatattaccctgagtaaggtttaagtccataagttgtataagcattctgggatgcctaaggtgtgagcctggatgttttggaacttcagtcaaatggttgaattttcttgatgagctaaagccatacatagaagcagaaatatgttctgtgttcctaacatcctcttttggttatttttagctgcagtattgaagtatgagaacaatgttatgaatatcaggcaattcaactgttctcctcatccatactggcttccaaatttcatggatgtttttacttggtcccttccatttgttggggaaaaaggtatgttgtggaatcctgagatgttcttcttaaaatagtttaggaaggaaggaaaggagattaaacactcagaaagagaagaactttggcccagccaataaaattcacaagttgtacaatgaaagatgtgatttggaagtggcagtgtgtcactctgtatcctattaacaggacacaattggtgaatgagggggaagcaaaaaaaaaaacaaaacacaggaatatttaggaaatttttacaatcttattagaataatataacgctttaaaaaataatggaaatacaggtttacctggtttcaagtaatgtctaccctttttccttacccatttgtactataatcccaaaggactatttaattttacaaattatctgccaaattaaaagattaggatagccatgctctccttacatttctgatgttaataaattattgtacgatagtgcttaatggctacaatattttgaagaacaacatgtacaacagcaaagtagttcatcaataatgtaggcattagcgcattataaggtacagaacaggagacaaatttacattttagaaagttatttgttaactttcttcctaccttccttctttcctcctttgttttgctttcatatgttgacttaaaccccaacaaaaattttggggaaatgtctgcaccaattgtttttcattcaggaggcctaacagtgatacacggattgattctcatgtatcttctcatactttccatgagaaggtgaatgggcattgtaagaaaaataaatgttcctataagtatcagagtaatgatgttctatgaggagtatcagagaaaagctaaatatttttctgaaaccctaatggttgttttccctttaaatgccctaaaatgattaaaccagtcaagttatgagttgttggcaaagaagccttccctttgaatatcaaaataatcaaaagtaaatttttaataatctctgataaatattcccaatactactccatattgcaactttcttgcactgatcaaattggagtagtgtcatctgttggcttcgctggaaacagaagcagtgtggatgctgacaactatggggcaccttttgaacatcctttatttgggttgtttctattaattattaaaatttgggacatttattagaaattaacatattaatctattggtacacaaaatccagttttgataattaaactgaaactctggatcagtgttggctctattgaagtttgactctctatcattcatcttcaattctagaaggacatttttttaaatagcatattactttaaaaagtagctctcaaagaagcagtagacaggcttcttttcacatgcatggtagaatccaatctaatttcaaaaaatattaaatgtaaatagcatggtttatagtataaaaataatgcagtactaatttcctctgtacaacacttttatgtaatcctattgtaatctattaagtaaatttctgattaaactgcaactgtttaattttttaagcatttttgaaaatcaaatttaatgatatttctgtcaatacatttttaaaattagtattctgaaaaatacttcaaatatattagtttatcaatcaacagtttgtattaaacacaaaaccacatgcctataatggcgtgaagttctctaggtgattaaaaatataagaaaaatcatcattcttagtccctactgaacagaagtttgtaatctgatctagattaagccttatcattgtgtgactaataaaaattcaaaaaaactattttctctttcattgatttgtagtatattcacatccacatatttgatttgtcattgtctattgacctagagctagtaaatgttaccattagatatcataagcatcagctaatagtttcataaagtctgcatagaatcacaaaggctgtcttttatgatctggatgtttactgaaactgcttctatatacaaactaaataagaaatgttattgctaagtttgctcattaacaatgccagagtaatagttaaggttataacagaaaaccctgacttttctttctttgctttctctctttagtgactgagatgctggtaaatgtcctcaacatctgctcagatgatgaactagggtcagaagaagatggatttgatggtaagaggcttgagcctttgtgctaatgctatttgccagataattacttagagtctcattgctaaatctaagaataaatttctaagatttggattatgtttaaaacgtaacattattgagaataaaagatatgatttcattttctgtttactttttaaaagtataagaaacaaatatcatgagaattttctcattactttaaaaacattgttaaagtagtaaactgttttaataagctttcagtagctcacattgctaagtgaccttttttggctttttgatacaaatttaatcctttattttctaacagatgttaccaattactggacaattattttttcttttaccaggcaatttaaaaatgtcctctaatggggttgctcacatcaattattcaagttttgatgtttatgatgaaaaaggcatttacatattgatatattggtatttatttcaatcccaatatttcttctttctgtagtaataggtaatgaataaactgtgaggagttttttatgttttttaagatattacttggtgtttaattaccctcaaagggtatgctttttctgcaagaggcacagatccatgaagttaaagatgaaggggaaaattaccctgagtcttacaaaagcacctcaaaatgaatggaaactgacaaaaatgtacttagagaagaaaagcataagagcaaactttactgcatttaagaagtacagttgaggccgggtgcagtggttcctagcactttgataggctgaggcagatcacttgagaccaggattttgagaccagcctgggaaacctagggagaattcatctctacaaaaaattagccatgtgtggtggtgcatgattgtggtcctagctactcagaaggctaaagtgggaggaaatcttgagcccaggaggttgagactgcagtgagccatggtcataccacagtactccagcctgggtgacagagcaagatcccatctcaaaaataaaagcagtacagtcagccctccgtatctgagggttctgcatccatggattcaaacaacctcagattgaaaataattcaagaaaaagttgcatctatactgaacacatacagactttttttccttgtcatttttccgtaaataatacagtttaacaactatctacatagcattgacattgtgttcagtattgttaagtagtctggagattaaagtatactcagaggtcctagattcaggacacccagggctacaagatgcattaaaaacctattctttgaagaagttgcaaactggttggagagactgatgcataaactaataatatcaataaaatgacacaaattataaataaagggtgaagagggcaagggaaactagatattatggtgagtttaaatggataaaatgtatacctttaaaaactgcagttcagtaaaatgaaaagagaatgtggtcctttctaaaagttggtttccaaatgacatgatttaatgtttacctgggcttgatacaggtcatgggtataaatgcaaaatacctaatgctgcaggcaaaagtataataaacctgttcatacactcatgtaaatagagtctatatactcaggtaaatttaatgtatgagatttatttttaacatctcatagtttttctcctctataacttctcttgtctttattacttgtcttcatatactatttttgagtcatataccacatcgcaaggagatgtgcaacatagggaaggaaaggggaaaatggatatatttaaaaaacaactttactgggctaaaattaagaatatataagaacttaaatatattggcatattttgaaatatgcaagagatcaatggacattttgtgctttatctaaattctagatgtttcatatgttatagccacagtttgctactgttatcttttaaatgatagcactgttttcagaatggcagaaattttttcctaaaagaatactaaccaaatggaacctaaatcataaacatcaacaaacgtttttcagtatgtacctttcactatattccttttattctttaaaagaaagattaacattaatacaataataatcccctattaataaatgtttgttttttgcaaagtccactggccagtatttatgatatagagaacaaaaatgtaacatactgtagagaataagaatgtgtagacctacatatgtttgtaatttttatgttaatccattcactcagcaaatatatattcagtatctactaagtaccaggtaccatagccaaaatgactgcacatttcactggtacatgttattcctgcacagttaccaacattaccaagactaaccctgtgcttacttcacttctagtaagttccctttactcaccatctcaattacttacatgaaaggatttgttttgtcagttactttattttaaaataattagttctaatcaatgtgctgtgctcaccaccaattgctttttaaactctgttttaattccaattgtaggagtgcatgtttgtcttaaggtccttggaagaatttttttctttctaagcagacccctgaattccccctttaccactctttaagttttaagtcagtcctgcagagaaattttgtcctaccaggtgcagggaggaagatggtcaggaatgcctaacctgctcttaccagctagaaaagatgagctttatctctcacttttgtcaacttccttcagtggtccattcctgtcaagttaaacatcattaagttatttatctttctgaacagtttcttctgctttaatttatttctgcttagctatattaacaataagatttgtgttttcaaaattttaagcaaaatttacacacaggctaattaaagtattcaatgcatattaaaagtcctatgtgtctataacttatcagattgggagctagcagaaagagataagattattgctatataatttttagggatagacaatttaatttccttggtttcctgtctcatggacctcacttaaccagtagtatgtgggtgttttttctaccttttttctccatcttatttaaaatttgttggtgtatttcccttagtcaaactaaagagaaacaatcatctaatcttatgttttatttcttttgtatatgtacatatgagaggaggaggaagaaagagatgaggagaggtgaaaagaaaagatccttctgcctgattgggctttgccagcatatgatagcagtgcaggccttggttccatgagcagcatcagattcaaatttcatagaaaaagagcccagaggaattgaaaaagagaaattaaattcaacaaggagaggcattgtatacattatgcattcacgataggttatgattgagaagaagctggtgctttgggaaaaacatattaggttctacatttaccctttttgaatagttttctcctttctaaacagggtgataataggagaatgctgaatgcctctccattgaatttggaaactgccgggccagcattagtgtggtattgtctgcccacacttttctagatgcaagtttaagatcatgttcagtgtgaacattgaggactttagagatcggagtccgaaatgtgtcaaagttaatgttaatagatgctgtcctcattttgtaactgtgacttctaaatgtgaccttttagttcatatctcataaatttgccatttaagaagaaatacagaaatgaaagttttaagttttaattaaaagtatatcttgctgggtgcagtggctcatgcctataatcccagcactttgggaggccaaggccggcagatcacttgaggtcaggagttggagactagcctggccaacatggcaaaaccttgtctctactaaagatacaaaaaaaataggtgggcatggtggtgcacatccgtattcctagctacttggaaggctgaggcacaagaatcgcttgaacccgggagacagaggttgcagtgagccgtgattgcaccagtgcactccaacctgggtgacacagtgagactgattcaaaaaaaaaaaaaagtatattctacttaagatattatatatttcagtataagcaatcaggagtcctagcatttaatgtaacatgacatcaaaactggatttcctcaaagggttagggttagggtgcttaaagatgctcaaagaataatttgtaaagcttctcagaaatccttggttttctttgggaatactgtttattgacaacgtatattgaagtgagttgttttttttttttttttggtaacattatttccaaccttaggataaaatttccaattgcggcaccctgtccttcctgcctgcagcctgtagcctgtctcccttatggggctggctctctcctgctgcttgccaggctccttatttgttgcctgaaaaggcaaagcagaaatcagaagacatccaaagacttaaataaaagtcttccttaaattgttgcttattttaagtgggctatcccttcatgagtcatttatcaagcccttctcaatatttcattccatttccaatgtcagtgggaaagtcaaaggtaataatagttactctacagtccatgactgtcttttatcttatcagcttgactttttagtgtctgtagtgcctatagcaatttagagatgcgcctatagcaatttagagatgctcctcatttccttcagaatctgtcaactcctgtttactatttaatgatgatgttagtgacagcagctaacacttacgtgttagggatcaagcttagttctttaatttactcattttaccttctggccaacaaaagatttgttattattaactgtcctttatgttaagtttactaggcaatttatgtattatctttcatcctcaaaacagcctattgatataggtactattattatccttattttacatataaagtgatccagactcagtaagttgaaaacctaagttcatccagctagtaaagtgcaacagagcctggattcaactaatgtctgcttggttgtcaggctcttaaacttcccaccacatgtggttacaatgtttgaaatcttgttcattcagtgtgatgatttttttaaaacaaacaaaaaacactaataagcaaatataatatgctttaatttgttctgttaaatatactgtaaaataaaatataaatataacacaaatataatatgctttaatttgttctgttaaatatactgtaaaataaaatataaatataacaatatataagtatactgtaaaataaaaatattctatgaaatgaagaaatagattttgcagtattatttggccatgaaagtcaatgcatatgaaacaatatcattctattattttaacataggctaagaagaaatgtgtttcatcttgtaaaaaatttaggtgtatctgagcagacaaaaagtcttctggctcacacaggcttctggataggaaaccatgtcatgattctctcttcgttagcttctgtcttataaataaaggaatttgataggctgtctggaaaaagattgctgttttaaattggcctctggtcttctatgttgaaaataaaatttaaaacttctgttatcttgtaaagtttggaagcagtttaatgccaatgaatgtcttttgatgatctaatttatatgtaatagggtctttgtttcctgtttccacttcttatttcgaatgttaaaatgatagtctggtttcaatttagggttgttattcactggaacactttagagaaaaaagaaatccaagtaaaggtatctcatttggcagataatgctcattaatgaagaaggctcatttcagaccaaggtttagtaagtgattccaaagtagagctaacagaaatcaaccttcattacaagagtttctttattgttcattattataataaggaagtctggagaaacagtaagcattagcaacctagtgatagttttgtaagttaggaatagttatttatctgggactgtcttttaggtcctaaaatcataggcactgagatcacttttttaaataatacaaattatgtttgagactgtgatatgtgataagtctcactcaccagaaaaaactgtggaagttaaactgaagccctgtagaatgagaaaggaaagaaaaaataataaagtgaatacatttcaagccaaatatagtttcaggctgcactggaaagacttaatattaaattagaatttatgtgtctgcttttatctaaagagcaaaccacatggtagaactcttatcctttgtcaacatttttgccttatcctaatgttaaccataagcaagtgaatatggaatcagagtagctttttgcatgcctctatgaaaccatctatgtcctataccagaaaattatcttccatagtctgccttgaattagataattcttcgtatctaataccacaggttccagagtgtctccctacctatttctgtctagctgttaacagttgtacagaacttaaagtgcaaagttgggaattagtgtgactaatgttgtatcttactggtccttgaggaatacttttctaagggtatgaatatattattttctaccaaaactgtatttatttgccatgatgaatgtttgacctagcaaaaagcgtttggcactagtaattcctttgtagaaatgccttggcaccccaagcataaaggaattacccccaaatcattactttcaaatagtcacagaatctaaatgggtttggttaatttaaaaatctaaatggaattaataaattaagtttaaagatttaaccttagaaagtcccatcactttgtgcatttagcagcacatatactaagagccattagcttggagctttttttgtgctgtgatttttatttctgagcaactcattttagcatcctatatttcagcttcctcatctaaaaaaatgatgttatagcctgtacagtttagggggaatatattaatctttaatataaaaaatagaaaaaaaacccatttagatatacaaaagaaaatatgctctgaggaacacagtggtgataagattcttgttctgtcaacattgaagcctaacctaaagttagtaagtcaaggaataacataataaaaacagtatttgagaaaaggcaaaaactttttcaagcttagataaatgcttggaaaatgaacaaaggatgagtagggatataatttaggaacttaataaagtatcttgaagttgcagtgacaagatctgaacaaaaatattgttaagaaaaacatttaaaaggaaccgttcaaaagacctttccgaggacttatgacgtagaatcaacaggtcttagacagaggggcaaaggaaacaaaagctgagtttgacggttcaaacctaggggcataggagggataataacatttatggaaaaagtcaccacctccaggagaaagatgagttctgttacaggcaggagtttgagtaaaactgacgtgtaattctagaaatgcccaagcaggatttggaaaaggagtcctagaaattgagaaagaaattggggctagtgacagaggcataggattaagtaataactgaatttattaagagtgaaataggcctccaagttgctgacttagaataaaatctcacaaaattaaggactgatttttaaaattagcctgcactgttaaagctggagatgaaagaaggagaaaataggagtgatgacagagcacaagaaccaggtttgtgtagcagttcaggcaacagctacttaaaaatatttgcacccagtgcagaaaaattaatatgagatataagtctggccagaattaggaccataactttggctatcagacatcagattgttgaaagagatgaatagcaaaatttatttgatttttacagtggcacgtaaaattgaaatcattgacaaaaggaaaacactaaaataaaattcagtgtgccctattctaatatcacattgtttttactttacatatttttatttctgtgtattcattaaaagcaaatattgacataatatattttaccatatattcagtgatgaacagaacacatatggtccctgccttcattgatcttggagtcaagtagaataagaattaaaccagttttaaacatgctagtcatgcagaggatataggtgtttaaacatgctagtcacaggatataggtgtttaggggaggcagcaggaattgggataaaatattgaatacctaaaggaagaacatgggggacatctttctttttctacttctgaaaagccaaaaaataaacttttatgaattttgatgttttagaaaatgtggccatgtgataagtccatattattttttcaaggaaattatatgcaagggtggacatccgtttaccagttttgacatctcttatatttttataataactgagtttgcctgatgtaattagggtacagggaaagaaagatgtgtaaaaaggtaggttatttaatatttttaaaagactaaattcttctcaggctttttttttattgttttcccagtttattgttggtttttttgtttgttttcagttgcctaatatttttgtgtctaatttaaaagctaaatcgtttgtctttataagtttattatttatttcttataccctttataaagtacagaatataccctttataaaatacagaaaactgcttgtttcattatgctttcatcttaaaaagaagacaccttgttatagctagtatatcattaaaactaaaagatgtctgaaaaacacatgggcatttattagatgtagtttggtatgattcttatcgtatttagggctattgacattttgaagccttgactatcaaataagcttttacctggttagctatcatactttaattagtttcatcaaatctggccttttatctttggtcacaattattaaaatcgttttaatttagcaattaaaatggtgcagtaatataggtatcagaagtactgccttttcttcatattgtactactatgattgcacaaatgtgtttcttaattatctggcataattttcacattgcatggaagctcgtaatttgcagaataaactaaatgttaaaaaaacagccatatccctgttgcagctaattggctggataatgtccaccattggccagcatattatactcacagtaaggtaatattacaaaaaatactccagattttacactgtatttcaacatgcagtattatatgcatgtataatatatattttatacagcttttgaaagaaatgatttttatagcattagtttttattcaactagtggtgacattagccaacttatactaaacattagctattgcatatctaagcataaatggatttataaaatttattcgagaaagcaaaccatgttgcataagggaagtaaacatgtggccctataaaccttaatgcattctttatttgaaaggcattgaaatagagagctctctcagtgaaagcaaagaatctctgtattttagaacactttacttctcgcaaacagggttgagataattggcatgtgaaagaggcattctttgtagaaaggcctgtagtaagtaatgttaactagctgaaaactaataccaaaagaaaataaactttatttttcaaacttttctggcagagcttttctgattctctttgtactaaagcattaatggattcaggttcttaacttgaagattgtacttttattagagtaattgataactgatggaacaactgcaagagagttgtgagtccacagtttctaaaacattctttttagagtaacttatctcttatggcaggtgtaaaggctgtacttaaaagttcaataaatgtccacaaaatttaaattttaaaagtatttctctctgagattttcctattttcattcttctagaaatctgtttaattttttcctctttattcttagctcatgagaagatataaaagctgtcctcccgttttgtctcagaactctgtagaaatagaaatgtagtttctattttatcaaccgcatctttttggagtggtctattttgttctgactgcaaagccagcagcatcctggctgctctcattgtctccaagtgtgtttgccataatctggggtccagcctttagcctggctggcacaaaacataaatgaggccacatctcagggcagcttgatattcaccaagatcacataatacatcatttaatttacagagagaaatctaactgtttgaaaaactggaatgttcatatctgcacaagggtttcttcttaataataccaagcattttacaatacttcccatataccaaagttctgttttacgtgcattagcaggtagcaccctgactggcacatttattttttgaatgttgagaatgaatgagcacattacttatttaactctgccaccacgagtgaagtaggtcagtcagctggtactgtaatgaatccttgttctgaatcacctctagctaaagaccttaggcgaataatgttttgttccttagaattattctctgtcaaatagagactagcagtaccatctccatgtggttgttgcgaggattatatggaaataatgcatttagaacatgcctcactttatagataaggaaagtgagccttaaagagacttaatacttgcccaaggtagcacagctggtaaatgatagtgctgggacttagaccaaggtcttttattctaggcacaagttctttacctctgttctattctggctttcaaatgccaatttagttatatgtcttaagagaagtggagaagccaagtatttgtgatctgaagctttgcagtaggaccagagcacctcacagccatttggcccatggacagtacttcccagaacatttcaaatgtttgcctcagctgctctactttactatgcgtctgttgcaaaccaacacattttcaactagcacatccgttctcctgataagataataatatatttataataatatatttaagtgatgttaaagtctcatgacttggggaccatctactttctgaagttgcctgtgcatgggtcactggccagaacctagtgcttgttttctctacttctccttcttgggcaaaactttactacatctcccacgaagtaacaaaacaccgtgcctgaattgtgaatagcaaaagacctttgaatgacttctttcagataagctcattagatgccagtgcctcagccattctccacggtcagatgaaggagttgtattacttctttccgtctgctttttattatgctgtcaagtggtactcaaattaactttttatctagggtaaaacatatgagacaatcaaatgtaatatttaatatgtttgtttgttttctcccttcactttgttacatgttatcatgcagagataacatgtaaatgtcattctagtatttgataaatgtataaatccatatgggcccagaattaagttccagtctgaatgcattcttccagcacttatcacgtatgcacaattatgtcctcagtaaatcctattaaacagttatatcctcatccatgtcaagagcaatctttgattagacatccaggcattatgactgcttcccttttagataataaattgatattattaaatttagatttattcctttttgtttttattttctgttattactttataaaattgatgtgtttttgtcacgataaaggggttgagccaaatcagattttatggctcttaattgcttccttggtaaatattaaaaaacaaaggcggggggagcaatatcctctgtaaggcatgagctgaatatgtgaccgtttcttgaaaaatcaatggaaagttcctaatctactgtaaagtctttcattttcacccagttagaattctgcttatagtcagcttctgcgactcaaccaaggagtcattaaacagacggaacacaacatcttagagaacaaaagtgcatggaatccaattagagtttggaagtgaaagtgacttataattaaacagaaaataaccaaataatgacagttattgggcatttgagtgtagtctgtccatttttaagacttcctatccaaagaatttggttatgttttatgacaagagaggtggagaaaaatttaggctcttctggccttccttaaaatccattgaacacttaaaatccgttacacccttaaaatccattacacaggagaaacttttttaaaaaaaattacattttaaaggctcttctgttgctttcaaagtgggttgtaagacagaatagccttatgccaaatatcacaccattcattgcaggctcttaatatatactgagattgtagtcaagttaaaaaaacatatggaagaaattcagaatatttgctttagagtgatttggagtgagtggctattatgtcccaattttatcacctatgggaaggataggtaatagagttaggatccatattagaaagatattctaaatattttagtttgtaatcttcaaaaagatgaatttttaccaggatttttttcacttgttgtcttgaatgtgtttctcttttgcccaaaatagtaacttatataggcatacatatggcttttttttttttttttttttttttttttgggtgagagaaagcaaacaatctctggattcacattgactgcactgaccctaagtagaagaacagtgcaggattcccaggtttatggctagttaaggagttcttccaatagctgtcaactctagaaatagagtaatctaattcttgatagaacagcagtcttcaggctggaatatttgtactgtcgcgattaccataagacatttcaagaggagttaaaaggaatccattttcacatcctcagccaccataagtcttattttcttaaaagtgatcagcctgagaaggcaccttggctggaggccttatcgcagcttctcctttcccgcctcctctttctcaaatgccctttttccattttaacagaaaggcacaggtctccttagacatagtcactatgaacatttccttgagctataaaaacctctggggcacacacaaaaagagacattggaaaacttagtgtctaggaagtctccttaatcaagggagcaatgtaatttccctcccctctttatcattaaagagatgcattccaataaaattttatttctgtgcattttaatatttatgaataattatcatatgttagtgctctctatctcagttaggaactaaagagttgataattgtgaactatctataataataattatattatttattccaaaggaatttttgaacacttaggacccatcacctcaggaaatttctaaaatttagttaaatctctaaatataacatataatgtagtgacaaaaatattttaaagtttagcatacctgtaacctcactggggagactgaggcggtaggatcacttgagcccaggagtcctagtccagcctgggccacatggagagatcctgtctaatttaaaacatgtatatattttaaagtttataatgcactggagtaaaattggggaaatttaaagtggaactcaatttcaaagaaaaaaagaataatataagatttctaaatatcaatgaggattttattcacggacttttctctaagtgaatgatagtgggactcaaattgctgtgatatttatacgccattggtaacagagtaatatagccatttcattttaatctcataatgtttacaacattatttacaactatttaaacatggaatgggaatagtattctttggggatattattttgtagctacatgactaaaaattataaaggctacaattttgaagccattccatcagagtaaacaattatccattgcttatggtgctttttttaaatctaggactcaagcgcctggtggtgtaggacaatgtactgaagcacttgtcacaattcatagccaacagcaaaactgggtggatatctaaagtaacttctgcataacatccctttgctgggatataagagctcaaggtttgttattgttaagttaggtcaggaaagaaaaagacaagataaggtttagggattacttcaactgttggacatgtattttcccaaagaagacagtctttatattcataattttcgtcatctgtaaaaagctataaagaccaattacacaagtttcttagaggtatctgaagtctgttctgtcttatgcattatatcttctatttcaaaggtgctgattttggatggacacaaaacccatttttatctttaatatagcacaacaaaagatactaattatctcaataccttatgcttcatttcatcaagaggttttattcaaattcagtaattgctctgtttggcaaaaaataaaatctgaaggaacattgaaactctgtttaataatattgacccatgataaaaattttactttcaagtagaataggaatgaactttgtcaagttttaacaaatttggaagtggtgagtggtaaaaaaaattttctcagaatttggattaaatgtttcaaaacatttgaagtctaccagcaaaatataattttaaagatatatctttccttttaaaacacacaaaaaattttagtataaatatactttttatatatatttcatttaaatacatatgctgtggatacacttgcattagttatacgtcctgtaaagaaagaagcctaaatgataacaaaaagctcatggccgatataatgatcaattgggaaaggtctgctagtgtttctatcaaataaaatacaactcaataacaataacaatttttaaaagcagctttttcacattctaacgtaaaaatatttcttttcagaagatatttaagtataattttttcaaactggtcgtttttatttcttacagttgtaaaaatgtgttgaaactaataagaatctgttggattagacttttaaaacaaaatcccgccagttcagttttcttctggatttggtggagaagagagatggggagaatgtaactccagtgagaagtcttcattgcctttttcagcaagctcatgcatcctcccctgttacataaaggaagggcagggcaggacatagagacttctctccccaaagctgctatttttctttccccacaaaaccaaatttcttccaagtatagtttcattttttgacattttattacaaaatattttaaacatacaggaaagtttgaagaactgtatagtttatacttagatactcatcacttaactttctatagctaataattgactatatttgctttatcacatgtctgtctctactcattcagcaatctaaccatttctttcttttttggtatctggcaaagtaagttttatttaactctgttgcatacatgctaatatctaaacttcttgtttgcatgtactactatgctaaagcctttacaggttagaccaggcatttcctgcttctttcccaccctaccatcttccgcgtttactcaaacttcattcacatcaaacttcttacccatcatctgaccataatgtggagttttgctgcctttacacatttaaaaaatctctatggagaatgtcattcttctttctttttggcgtttatttatccttcaagatccttgactgtcaccatttcactgaaaagtttttcttgtacctgcaagcagtttgcacctgtcctcccagggaaaatggccccggtttgtagcatttgcagattttcatggtataaatgtttcccctacagctgatttgaagctaccaacattactgaccatggagttaagaaggaatacactcaatatcctcttaccagctgacagaagccagctccagtgtaccactgctactttcaatataatatttgtcacggtctattgttgttgttcatgtgatctctgaaagcagaggcaatgcctcattcatatttctattgctagcacatggcaggctgtatagtaaaggagtcacaagaatatttgatgaaggaatgatttggatggtaatttgtactctacataacactttctgcacactactaattcaggtgtaactgaagaattcacagtagtagctccacagtggtaactgagctggaagtcagagccaacatctgttatgtgtggcagataccccaggtggtaagaatctctcttcagccaagcacttgcccccactatctgtggtgcaaatgcctttttccagttcctttctaaggctgaaatctaccctgtggcgttgcaacagtcacttagaaggccatttgccatagatatcttaaaacttcatgagaagttagcaaggtgctaagttaagggcaagaaggatatgtattaaaagcaaatctttaaagatccccttggtctgtgtactagcctcccccatgttgaggaaaaattgagttttcagggttgcttagattctggaaatagtaacatgataccctaggcataaaagaagatcagaacttaaaaaggtgaaaggagaggccaaaaaaagaagtgattattatttgaaacaaaatgaaattttacttaaaattactattttttctaacatatgaaatactacctttcagttttggacttccaagttgaaataagtgattatatgtttttttaagtggaaagaaatcaccacagttttcatttaaaaggtattttatgtgtcttcattatttaatatactgaattttaatttgagctactgtggtacattttcacaacttaaacagaacagtaccaagaatgtttaatatgacattatctttgcatgttgcaggtagtaaaattctgaaaaacatgtacttattcttgatctttctgtttaattatggactgtgaggatttggaatgaaataagtttttgaaaaagagttttaatgatctctggaaaataccgaaaacctggaatagcaatactaagtatagtataccagaacatttacatctgaacttaattctctcctgctgttgttcagctcctttacactgaattacacatcaatccacatattttatttcagtattataaatctttgtgagattatatatgtgtggttagagctaattttgattttgattatatggaaaagattgaaggtacttttcaggataaaacatttagagaatagtttaatgtctcttcttactgtccatggtcaggttattttactttttgtgtaaatatatttcagttttataagagggataataaaactccttatctgggttattgagaaatttttttttttgaaatggagtttcactcttgttgcccaggctggagtgcaatggcacaatctcggctcaccgcaacctctgcctcccaggttcaaccgattctcctgccttagcctcctgagtagctgggaatacaggcatgtgccaccacacccagctaatttttttgtatttttagtagagacggggtttcaccacgttagccaggatggtctcgatctcccaacctcgtgatccgcccacctcagtctcccaaagtgctgggattacaggcgtgagccactgcgcccggccgagaaatttgaaaaggagagtttttttttttttttaattaagaaaagtgctagagtgtgttgtgattcactatttatggggagcacaactacatatacataaagtagaatatcttttatatgctctctaatcattcattttatctgaaaatataaggaatagtatactcactgtgagaatgttcattttacatttaaaatttagtatgtatttgagcatttttctgatcatcagcttataccaagctaagaagcacagctttacataatttatttccctccttttccagcatagtttcttacttttcattgctgtagttatgatttttacaagttttttatcagaaatcttctgtgagattattcttcatatatattttttacttatttgattttatatgttcctcctctcacctcacttaaatacatgaagttttatttttagacgtcttagccactcctatgctgcttttcttgttgtgcttctaaatatagtgaccagttttggagctctcccagtttccattctttgtgttcattgaattgatttcatgatctggccatattgtttattggagagagccagaatattttcccttactcagcacatcatgacccctgagttcacaggtcagttgaggtagggaattttaaacatagagtagtaataggacaatgttagactgaaagcatcattgaatggaataactgaaatatatatatacatgtataggaagaccaccctaaggggactatttgccatcccactttaaaaaaaaaaaaaaaaaaagaaaaagtcttttcatggtctcttgttcattaatcatctaaaatccaagcacagagaattcaattttagatggtctccagagcagaatttgatgtataatcttaattacaaatcatagataattaatattgtttacaaaatcagaatacgattagaggtagggatcctgcacacaccctattttcctccccagtgttctgaccgagagactaattaataattcaaggaacttacagtgaatgagaacccatggttttgcttaattatcagaacagctagatctgagaacagctgtctcccacatggatagacacttattccacccatttgcaggtagaatagctggcaataataagtccttcccattggatatgttgaaaggtgcctgccatggcatagttgccacaagagaggaagaaatggacacaaatgtaggctgttttcagggcagagggaaggtgggaggaaaccagcttgctggttttcacacaccctctggggaacacccatgcacctatgagatgggtttgtgttagcatcacctctgaaagattacccacccaggcaaagaaagtgacccatatgttttcactttcttggagtggagggcaaaaaaaaaaaaaaaaaaaagcaaagaccttttttctagccatttcaaaattgtgtgtgttgtacaagttttctttctcatggaaatgttggcatattaattgatccacacaatcaaatagattagaaatggtgttcataaaagccctctaagggaaacagtagaaatctttttttcaaaacccttctgtgaaagcttgctgttaccacaaattataataaaagaccaaaacacataccagttatcatctatagactaccgtccctgagcaaattacttgactcaaactgttcatttggattaggaacatttctgttattatttgaaaagaatattctgttgtatatctattagaggcagtagaattagacgatctgcttgtgttaatgctttctataaaatcccacataatgaataaaaaggatagcttatccattttaccttggattataaaaatcttgaccaggtgcggtggctcacacttgtaatcccagcactttgggaggctgaggcaggcaggtcatttgaggtcaggagcttgagaccagcctgaccaacctggtgaagcctgtctctactaaaaatacaaaaaaagttagctgggcctggtggcacatgcctgtgccagctacttgggaggctgaggcaggaaaatcacttgaacctgggaggcagaggttgcagtgagccgaaatcgcaccactacactccagcctgggtgacagagcgagactctgtctcaaaaaaaaaaaaaaaaaaaaaaaatttgtgaggtattttttctgttttatacttcttccaatgtacctcgggaattaaaagaaaaaataaaatgggctcattgaagtattactttaaaacattattttaaaataatatgtttatttgtaacaataatctatgtaattaatttttttaatttagaaaatgtaacaagtggtaagacttacccagaaaaaccatgcataactttcaaaaatagtactaaaatgcaaaccatggtgccattgtctcttactaaatccaatttagcagttctctactcttttctctagaactcatgaaccaaccagaagatgaaagagtatcaagtactcaaacaatcatcatcaaataattatgaatgatgttgcaaggcagatagggaattaagagacttcttagtttaatcacatcaaaggagaacttttggaaaagcagtttcctaaagtagttttcccagcatggagactgcaaatgaatagaagatggtgataaggtacttaactcttcctcccaatgcgtggtctctgtataaatagaaaagaaggggaaagtcaattggaagaggaggataggaacctacccctctctgctcagtgattttccagttagcttcttactcacctcccctctggatatctcaaaagtttttctttggcactatggggacctctcaaaaatcacatcctagtattggtggccaaaagcttaaattttcaaatttgatttacagataaatcctcttaagggggaaaaaaaaaaaatactgattttgcttactggagtctgttgtatgtgtaaatgtgtaaaatcaattacaattagataaaaaattactgaccactgaactctgtttgaaaatacaggtgcaacagctgcagcccggaaagaggtgataaggaacaagatccgagcaataggcaaaatggccagagtgttctcagtgctcaggtgggtgcattcgtactctgtttttgtttcaaattgtattatgtgtcacctaataaatactttaatactttcatctggtaatttaaatattttactagagaatatttgtctttttttccttttagattaaaaattgaggaaaattaaatgagaaattgtcagtttctcactattttagttaaattgcaatctactaaattatttctgttaagaaagtctcgaattgcatcacattttattcctctatttgctataggactttaaaacattgatttcacggtaggttgaatatcttaggaaacaggaaaagctattgtaattttttttgttttgtttttcgttctggctcgtggtgaaagatgtatttatcagacacatttcactagatttctaggaaatgaacatcagccataaagctgttcatgtgaatctatgttattctaattattgagagaaaaattactgtttcaatttccatatagtagtatattttgtagattatgaatcatattattattattaagcattaatttagaaaacaaatattttcttgaaggaaactccagttatttctaaataatacaatgtaacatttctcttcaaaagattactttaaaatatgatatatttatatgtaaggagtctacagtcaattcaaaatgatacatattagcgagtaaataggaacaccttgggaaatattacatctacaattggataatttaataatcaaattttttgccaaatttttgccccaactctttctcatagagtatcgacactggctcttttgatttcacctcttgctatttctatcctcttcctggtacagtcactaaagagtaactgaatgacttaatgccaaaagaggtagccatgagaaggatgaaaagcattatcatgctctctcagagacaccacatcaaaggcagtgagaactctgtggtagccagcacattcacgaccagccatgttcaagcggaaaatagggcatcattgctcccttccgttattgaatgaggctacctttgctctattgctgtacgtttccaactacattttcagggcttattcattcatgccataagtaaatatagtgaaacttaaagcattgattatgtaccatggagaaaagaaataaggcaatgtagagatggagcaagtgggagataaagaacttcttttagtgtgtggtcaacaaaaaactttctgagtaatggtatttgggcaagcataggtgaccttcatgaagaaatgaggtaagggagttcaaggcaaagacaatagcaagtgcaaagatacttaagtaaagacaaaactggcagttttgaggaccacaaggaggcctgtatggctagaaaaatgttctgtggggacaaaggcgtatatgaaggtcataagcttaattggaattctgagtaaacacttgtttatttattgtgcctcagatttaccaataatgcttttatttcttattctgtctgaagtctctgagggaaagtaaaaacagctctagaatttccatgactatcccgtgataaatggactatttgaacccagtgatgagtgacttgacttaaaattgcacatgttaatagaaaataaaagcaagctctatattattgtttttctataataaaagcatccataacacatatgcagaatatagagagatcctatccagaaaaaagtaagttaagcttagtaaataatgattgagcattaactgtataccatgcactgaattaggcaatctagataccaaattggaatgccagccagatagacaataaactaacaaaagaaaataaagtggccgggcgtggtggctcacgcctgtaatcccagcactttgggaggccgaggtaggcagatcacaaggtcagaagttcgagaccagcctgagcaacatggagaaaccctgtctctactaaaaatacgaaaattagccgggcatggtgacacgtgcctgtaatcccagctactcaggaggctgaggcaggagaatctctcaaacccaggaggcggaggttgcagtaagccgagatcgcgccactgcactccagcctgggtgacagagcaagactccatctcaaaaaaaaaaaaagaaaaaaaaagtgtgtgctaaataactacatgaatagataccctgctgtggcattagacaggaaggaaccttgtgtttcctgactggagtgttcataaagaggttaaaattggaggagtgctgtgaaggataggctggattccagggcagggagagatgtggtgaaggcattcctggaagtggaaaaattatcaggagcacagccacacaatcctaagagcactatcaatggcatccttttatggggcacttgctaagtgccaggttcatgccccatgttatgcacatttgacaatcatcgacacaggaagcttgcaaggttgtggtgacttcactttgctgtgaggaaattgaatctgagagaggctaagcagagtgtccaaactccctcagttggggagcaacactaatgagagtcttactcaaaactgtgctatgtagtctagtataaattcttagcaatactagtagtctagtaatgaattctaaatgtattaaaggactgactagcaaaagacatgaaggtgagtgaggaatctagtttaaaaggagactgaaaatatactgaagtccatatccttgagtgttttgaatagcatgttaaaacatttaatttttgtgtgtgtaggcaatcaggagttgtagaattattttcgtgagattagaggcatgctctaacccatgtttcactatacatgttaattgcaacgtgaagattggctagcaaggtgacgtatggataatgaaaaaagtgaataaatataaaataaaatgtaaattaaaaaaaaaaaccatttaggaagcttttgaagtaatcccagcaaaaggctggaccaggctatggggagagaagtgcaaaggaaaggacaaatacaaggaatttgggaaaacaggacgtgattaatgaatgtggaatgtggtacaaatttgtcaggtatacttgcccaacatgtttcttacgttttggaaatgtgcaaccttataagggaaccagaaaactgtctttcagcagtccttgcagataaaatacaagtctgttgcctagggtttgccagtcagataaatgcatgtaagcaaggctttgtttcaaattgagcatcatgaggaagcagcaaggcaggacaacaattgtcctgtcaggtgtggaatctcatgggccagcagtggaagagcttccacctcagcattttgggagctaactacacagcattagtatgagctctggcattggctgtgaacatcagtggcaagcctttcatggagcccaccccacagtatgaacaagtactgttacccttcccagctacagagcatcgaagcccagttctctggatctgtgagctctctaatacctttaatatatctctttcctgttaaaattagccagaatagatttccggtgttggctgtgagaacccttacctatatgagaggctacaagagagaggaagtattccagaatattctacaggggttccagtctatgccattgataggatgccattgtctaaagaagaggaagtacttttcaatttaaatacctaacaggtatttatcgggaagagtaggatgcactgaatttggcagagcatttatgtagaggcacttagaaattctgccctggaggttcagagagaggcgagggttagaaatgtggacataaggctgggtgcggtggctcacgcctgtaatcccaacactttgggaggccaaggcgggtggatcatgaggtcaggagatcgagaccatcctggctaacatggtgaaaccccatctctactgaaaatacaaaaaaattagctgggcgtggtggcaggtgcctgtagtcccagctactcaggaggctgaggcaggagactgccataaaccccggaggcggggcttgcagtgagccgagattgcgccactgcactccagcctgggcagcagagcaagactccatctcaaaaaaaaaaaagaaagaaagaaaaagaaatgtagacgagagtaaacaacacagagacaagagtacagcaatgtaagctgatggtcttgctaaaggatagcgtgaaaagtgagaggagaaaaataaagaattcttcagaacattgctttccaatagaaataaaatgtgagccacatctgtcattttaaattttctagacaccacagtaaaaggggtagaaacagaaactaaagaaattattataatacagtctgtttaacacaagtctccaaaattttatcactttgacatttgatcaatataacacttattaaagggacattttctattcttatatttgtactacatctttgaaatcccatgtgtattttacacttacagcacatcttaattcgactagtcatgtctcaggtggttaacagccacatgtaactggggcctacatattagaaagcacggatctggagatagaagaaaaagatcagcctaggaactgaaaagatgtcagagaaggagaaggagaagcaggagaaaaaagcattacaacacctagggcaaagagtctttcaggacggagggcatggtcatcagaggaaattactgcagagatatcagtttgaatgagaattcagcagagatagttggaattgaaaaatgaagaagctgctagaaacctttgagggcatggcttccgtgtgaggcaggaatggcagtcacaattaagggaagtaaggaatgtggttgaacaagaaagaaaaaaagagcaaggaaggaaggaaaatgaccatcttctatgctggggcttttgtaacagtgtatcatttaatcttcatggaaatcccataattacagttgtgattttatagataaggaaactgaagcccaagaaagttaaatgatgtcccaacatcagtcttatgactgagatgttagcctgagtgtgacccccacaaagatgtgatttcccaaaaagatcttcctactgttggtacaaaattaaaattttgaagattaaaaagaatacttcagattaccagaagagttttgtaggtaaaaagctaataatttacttggctttctcagagcattatgggttgtaattgttttttttgatgagtcccatgtttttgggggggttttgtttttttgttttgttttgttttaagacggtctcgctcttgcgctctggctggagtgcagtggcacgatctctgctcactgcaacctccacctcctgggttcgagcaattctcatgtctcagcctcccaagtagctgggattacaggagcatgccatcacacccggctaatttttatatattttttagtagagacgaggtttcaccatgttggccaggctggtctcaaactcctggtctcaagtgatctgcccacctctgcctcccaaagtgctggaattacaggtatgagccacggtgcccagcctgaatcccatatttaatacaggatttgacaccaagattttgtatgtaggaattataatcactcatgaggcaaaagccatattttgaatatgaatgtaaaagaaaattgtgttcgttctttagaggtactcccaattttcccaactcatattatcattcaatgtatttcttcatgggacctctagtggtttgacagaccacagaagcttaaaaagtttgaaatacatgcatgaaaataaacaataattaattatctcaaacctattatttttaagtaaactttgcagtagaggatacagaaatctaaaatatggattaacatttccattctccattcaacttttactgttttatttttggcaaatatttttgaaatgtgagctatgtaccaggtactgttctagtctgggtgctgtggatgcagcagtgattaaagcagacaataacccctgctctcatgaggcttgtctagctgggggagggggtgggggcatggcaggaggggaatggagtggacaggagaccagaaataagcaagtaaacacactgtatcgtttttcaagggtgataagtgccttagataaaaataaaataggcaaagggagaaagagtagagaaagggattattattattttaaatggcattcctaaggaagttcttgcttagaaggcgatattggagcaaagattagaaggcagagtgggagtgagccacacagatgccagggcaggaggatgacaaagaaagtgcagcgcccctcagtggagtgtgctgggtatgtctaaggaaagtggacattggtaggaaatgttgaccaagagatgggtgcgaacaggagagtgtggggtagctgtttattttaaggcctttgtgaaacctccctttcacccatcaggagaggagaagccattagagagttctgaatacacaagtgacaggatttggcataggtatgaaaagcctcaccctggctgccatactgagaacagctgtgggaggagggggcaagagtgtgactcggatggagcagagagaccattcggaaggctcctgcaatccaggtaggtgatgctggtggtgagcaaaagaaggaagtcacagaaggctgtattttgtattattttatttatatgaaatgtccaagagaaacaaatctacagaaagtgactagaagtgatacagggctgaaggaaatagggagtgactgcttaatgggtatgaagtttcttttgggggtaatgagaatgttctaaaattgattatggtgatggttgtacaactctgtgaatatattcaagaccattgattgaatcctaacactttaggttaattctgtgccaagtttatatctcaaaaaagctgttatcaaaagagatgcagtagtagccttgtgagaatggttaaactagaaatattttgagagtagagccctcaatttttgctgatataatggatatagaattaggatgaaaagagttaaagagtgatcccttactcttaagtaactaaaagatggaactgctaatttctgagttgaagacagattgtggaagcagcaggttatggggagaagttcaggaattctgtttgagtcacgtgagacaccttcgtaaaaatttggagtagataattctacatactaaactctctccctgtgtgtgtgtgtgtgtgtgtgtgtgtgtgtgtgtttgtgtgtgtgtgtgtgtctctatgtatgtatatatacacgcaaatatatgtatgtttgtgtatatgtgtatatatacaatttgtattttaaagacttttttctggttatgtaggattgcaatattgctatgtggaaagagtgagtggttatttagtcatggttatttaattatgaggatttaacaattcaaaatgattaatagtgtcaagtaattaataaatataattaaaataatgatgtacttaaaactgattgattgtaaaacaattgtcatgctgagtaagaaaataattttatattagcaaatcagtggggaaagtgactgaaaaaaaaaatctgggaaattttaccagtaggtttattggctgcttgccattattttatgtgtttttcatgtaacatctaaattactaaatgccttaatttctcaaagtccactgaatgtaattcctgattccctaatccacaaatcagattttttttcaatctccatatgctctgtttttttattccgtcaaatcaaatcacttccccttatttttgctgagccttggctgaaaaacttaacatcagcattctctatggctcacttttaacatacagaatgcacaacaaacactttgtattgagatgcctgattacaaaatcaaaatggttttctttatctatctagcttcgatactcaaaagaaacagaacctccctaattggataatgtaaactttatggtagcaatcgtttatggaacattactggtatataaataaattaaaataaagtatgttaaaaaaaattttaaaaaaagatccggagagccaagatagagggaaatgtgggtgcttatatgcattttttttcctttcagtcatttctttctttttcacaaaagaaattaaaagttaatgtcgcccctcattgtgccttccagagaagagagtgagagtgtgctgacgctgaaaggcttgaccccaactggcatgctccccagcggagtactttctggagggaagcaaaccctgcaaagcggtaagcaggctgatgggtatgactgtgtgctggggcatcgcagtcagctgtgtcattagagccctgatttattcattcatttaagctctgtcttggtcttcagttcttcttctcagctggcagaagggctgaaaccccaatcagtttgatcagtcatgtccaacataatagctccctcattctctggaatgtggtctttactccacctttcccccattccctcattcacatgttaatctacgtattcagcctagctacaggacaactcatttaggttgcctacatgcacaataggtttgactactttgagccactccgttgtcaaaaacaactttttaatcacatttttaataagtattctggttatgtttcatttatgagataacacatacacacataaccactaaaatatacctgtatgtctagattttcaggagatgatttcattatcctcttgaatggaaattggaagccatttgtgtcttttctctgatttatcaattgaaaacaagagactgaatagaaccacattttatttttgaaaaaagagtaacatttcctttataatacagattttgtgttaaaatgtgtagctttctagaccttagacctgtgccgtccagcagagctctttgtgatggtggaaatttctgtatctatacagaagccgcatatgactgttgagcatatagggaatataaccaagaaactaaacgttttcttttatctaatttatattaaatttaattaaaataagccaggaggctagtggctaccatgttagcagcacagtcctatatattctttcacttttgttacatttgttatcaattttaactactattattattacatacaatacaattttaacaataggagattgctattagatgaggctttaacagaaaaaaattaaaatgaaaatatgctataacatttttcaaaacattctcggcctcttgcttattttcctgtatctttctttgaatcttttttgtattttcttttctgtccctgcccttcaacctagaagactcactattctcatttatattattcaataaacttctacatgaagagtaatgatcaacttcatgaatatagtattgctgaatgatcacatcatggctgcatcacattaattgtctttattttcagatgaatatattccgaatcagtgtctttttttttacaaaaagacaaaaatttttaaatgaaggtaggaagatacatagtattgagaagtaaacgtcccctttaaatttacagctaggaattattttaacaactttaaaaaaaaaaacacacaaaagtttttctaccaaattaaatatcttactaaaacattagcataaatggatcatttacatgtccaaaatgtaccatctacctaactgactgaaatctagtttctgataagcacattttaaggcacagcaagtgtattatcagaaactgtgggctttagaacacatttaatagtgttcatttaacattcgctttagaacatttaatagtgggcagtacatagttctaatatgtcagtgctggtgtgattctggatgttttgctttacttttaaacttacgttacttaagtttttccagttctttgtttcatttccagattttcacttgtgtttttacttaggttatttggttttattttattttaaatccattggtttgtgtttttctatggttcaacctacacacaaacacacatacacataaaagacatatgggttggaacctttctatatgggtttgaaaacttactatatattttaaaccacatacattgatacgactccaaaatgtattgcctgatgcccttcaatttgtctaaaagggtagactacttacaactttgctatgtactctctctctccatggtgataaccattctccatttttatcataaggaatctcgaatccaccgtaagtaagttatagtgcacattttgcagttgctgtagttttaaaatcttgaattataagaaaaatgcaaattaaagtcaaggggtagaattttaatattaaacattttggagttacagagaagttttgcattttaagatttcattagggaagtataaactaatcttaataacatagaaagactcatatacttatatagtggaagtttagaccctaaccttattacaaaaattgctgataaagcagtgggcttttcaagttctgcctctgaaatatgctgtttctgtatattcagtatttaggctgcctattctttaaaatgctgatagaattattgccactactggcacgttaccacttgatttgtaacattttaagaattttacttccaaaaaggatattccactaaggaaaagaaaacataattgggcttgctggaaaacgaagtccagattatatcattcgtttccttttttccttttccttcaccctcttcctacccaccgacccccagatctagtaatgcctgatgtgtttatctttaaagagtcacatccattatctccttagacaccctgacttttatttttcctttaaatttgaatctccctgtttttccatcacatcaggaaatagtgctgtttaatattaaatagtgtgaatgatcccactgatattgtggcactgcttcaaattctgccattttgtctggcattttaaaactaaatcaccaagcatagcagaggttatatagtattctgtgtgagtcagaagcacagttgagatttacataatctcttataattcagtccatgtaaaagaaattttcctaagtgttttcctaaagggttgtttgttatttatttagtgggcaaaaaccaaaacatttaattcagataggcgtacccagctcataaattaaatttataatttctgtggcattttttttcttttttttttttttttttttttttagcatttctgttttgttgtctgtgccagaatctagcacttacaggaacattagttctcttagctcctttgatggtcactgatttgttcttagagttaaaaaatcctctgctcatttttctcattcattttgcaccccctttcttctcttcagctactgttgaggctattgaggctgatgaaggtaaattggccagtcccctttctgttgtacctgcaacagataagggctctgctgggtgtattcatttttttgctgtagcttgtacagagtgtgtgggtgttgagctaacagttgtggctcagtattaaccaaaatgttcttgctttaaaggggaaaatgtccttctatggtttgtttgtttgtttctttcccttaaagctatgtttgacttttgtatatgatgaatactataatcacagaaaacaaaaggattatatattttgaatgatgtggggtgggggttatggcagctgttttgaccagtagcttataaaacaataatctttgagctgaaccatgtccctccctcaaatcactttcaggcagcactgaagagaataaaaatagccatcttaattctagtcttcagaagtttgtagccaaaggaaaaaaatgttcatttaaatagtgctttgttgtagttcaacattaatttgtatctctaaaaaatattccaacatgagacagctgtatataagatgaacagttctggtaatcttaaatcaaattgtaacctactggtatttgtatgagaattaacaccagcaaaatattataaaaagttcaaaagcatctagtggctgtggaagtggccgataacaagaatagcgagtatcaagtagcactcaattgatgaatgtgtactgagtgtctgctttgtgccaggcactgtactaggagctgcaggggacatcaagaagtgtccatctccagctgtgttctagcactgctcaaggacagtagagtcgaacctttagtatttgctttttacttgactgttgtttaaatatatagttataagagaactgcatatcaaaatagtttttaatatttattatacataccatatcctttggaaatttcaaaaataataatttgaagttcccctttaaaacaaaattcttcagttgtattttgttcttgcaaggtaacttttttgtttttctcaaaattatgtgcatatggtcctttggtgtgatacaaaaagtgccactttagactcttccaatttgtacatgatttggatatggtaggggaaacaatagcactgtaagagaaaatacaactgcttcctaaatagcagtgaataaactgctatttatgtgggaattctctattcctcttggcaaattctaatctgcagtgtgcattcttgttgatagtttggctgttttctgtggtttctgtgactctgtgttgtgttaagtatactaccaatgtaaattgctaatacccattgtctgaccagcaactacagcagagcacattcttccataccaggatgacaaaaatgattagaaatggagccccattccagaagtatccattgttctagctacatttttaacactcccaccctattggcttttaaaacctagaaatttcacttttaccatttaaattaattaaatcatttcataaatgataatgatgacaaacttttatacctgttaattatgatgaaattatattcacagtagtctaaaaaagacagtagagtaccacttcatgctattcttttgtatttcaaaataattgagttagttttcagggtgggtgctcattagacagctctattattttgcaatttattactaaattagagaagaattaacaagctttgctttgggccttggtctttccccattttcgcatcttattcctctcacagttgactaatcaccattatgctaacctttaaaatgcagaggggggaaaaactatttctcatcttttaatgagtattgaaacaactgtgtatatcttttaggaatctcatccatactaataaaaggcactgcacatttgtgtaggagtggctggtaaagtttcagcttgaaactgctttcctttttttttttttcccccccaaataaggttgggaggataaaggtaccatgaaattatccttaatcagccatggtgatgcagcccaattgagcattggtgattggccctgaaatatctggcttgcacttcacagggagtaaagcaaactgatgtcattggttccccatttatgtgttttatttgcagctcaccagttggtgtactcactgaagaaatcattaagttttttgtacaaatgccttacctatcgctgtagcacaccaaagattactttttaaaaaaatcaaatatcattcccactttgagaattccatgttttaattgaataggaccaaaaccagttcaatgcatttttgctaaatattgtgaaaggcatttttttccttgttattatttaaccatcacttacatctacattgatctactgagtttttctttcatttaggcagtaatggataccagatgaacatcagtttgacctgttcactgctgaagggcagacgatacatttctacctagtgaccttatcttgatttttttttttagtttctcttaccttgtcactcactccacatgcttccaaagttaagtggagacaggagtttataatttctttttttttcatgtcatcattgagttgcttgtcaagaagttctttctgggattctgagatggcatggaaatgccccggttaattccttttctagctccttttagctcctgctttaagccctttgctaggtttttaggtatagcaaacatactgattccactgaatttgccattacctagtacaatggaggaatacaaagagggacatgctgcagcctgtctaggttaaggtgtttgatgcttatgatgtggccagttgatgctggttctagaggcttgtccctgaaagcagctttcctctttatgtgtccactttggatttctttgagctaaactttcatgaagacaggagaaatgcttacatcttaataacttcaagaggacattttggttggcaagagacattggctgttttcaaacctttggttacttccgagtatggtaaggagtctgttgtgtggtgtgcaggtcccgtcactttgttcttcactgaaggattccctctcactgagaaatctctaacatcacctgctgcaacagctgtgccctttgttttcctttggataatcctggttttctttttttaatgattttctgtttagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataagcagttgatgtgagtattgcttggtctttctgatgagtggttaggaaagtaatactgtgtatttttccataatagtttggtctctcaaaaaaagttgatagagaactagttatttcttca

SEQ ID NO: 16090 - DNA, 75480 bp, Human
  misc_feature (1)...(75480): n = A,T,C or G
tacgatctaaagtcagctgtaaaattataaagacaggaacatgtaaaataaggaaccctgtaaattaattttgcagtacatttatattttcattccctcctccccatcagtttggcagtgaacctgccttgcatctgacagcgagctctagggtgcatttatgccccctttttgcagatatcactacgtaagacctctgggtttaagatctggcttcaagacatctctattcatactcagtggggatcaacttcactgtgtatgtagtaggaggtgatcagaaaaacccagtctgtctaaaataccttccccttttcctagatttgccagcagaactgctcttttggatttgagacctaattggaggtcttgtctgtggcaattaaatgaattcttaaaatgtacctgctagctgaggagagaggtgagattagttccttcccattaacaccttaactcccaggtacacattcacatggattagtgtgtgataatcttggtgttgtaacagtagaggccccaaagacactgaacaaaaacagggcattttaaaaacgtttaaaaatatgaactgtaaagatgaacatagcattagagaaagttgagagaaaaaagcacaatgttctttgattatttttattaactgtattctttcaatgctcacattttgcttttataacctgaaaaaatatcctaaaacatgctttttaaaccaatattccacatcttgtgtaactactaccattattgtgtccttccttacagtgtgtatataaatatttgtatatggttgggatcagtttgtgatatatttccttttgcaacttaacattgccaaggcacttagctggttctcatactaagttatttaactgtctaataacttaagtagatgaaccttaatttatttagaatcccgtattgcagagtatcttggtcgtttctaactttttagtataaatagctcggtggtgcacatttccacgcataaactgcccctcctcccttcctcccattctgaatgacagggctggagcgggtgggggtctctgaagggtcctggggatgtctttcgtccaagctcatgcccttcctaattttgcttagtcactccttcctcccacccccacacatactcgacgtagaaatggctgggcataaagccaacatctggtgaccagaccaggaaaggggccaggagctggggaccaccgggtgagaggaggttgaggggtgctagcgaatcccacctaccctccaccctgcaccgcagctctgggggcgtccttgcccaggactagtttcagaccagccggcgactcgcaaggccaggctgcttggccaggctgctgacttttccaaaacgcgaggggacagtccgaagagttcccggacggattagcccaaagagctgcgggcgagggtcggttgagggaagaaaatgtgtgcgcgacatgcgtccgaaagctagacttctgatcctcgctccccgcggggctggacccgtgaccctgagctagtcgcctgactcgccgagcctcagtttcctcacctgtgaaatggggataattgtgaagatgaggagataacttgagcacagcactctgtgcagcgccaggcaccgagtaagggctccataaacgctaaccaacccgtgacaggggaaaattgaggctcagggccatcccgtccaagtgttttgccgaggccccagggcttggctagggatggacgccgggtgtgaacggagtcgctcgcagcccagcggccaggagctccgcgaggatcgaggggacgaaactcaccttcttggcccccgggcgtccagcaggtgccatggtgccgcggctctgtgggcgccgggttcccgggcgcgcggccgtctaggagcccgcccccagcccggggggaggatccgacccccgccccgccggccccgcggcctcaggctgcccgctggcctcggagcaggcgcctgcgccctcggcctcggcctagtcatgctccgtcccggcgcgcagctgctgcggggcctcctgctgcggagctgcccgctgcagggctcccccgggcgcccgcgctctgtctgcggccgggaagggtgagtggggccccgtcctgctcagaggcgacggggcggctgcgggggtgggagccagaggctgaggcaggctcaggggttaggagcgctctggcctccaagaaataggccttgatatatcttctcgaattatcttttaattataaagtgaaacagtatccaaaggttccccgtgtaaagtctctcctgccccaatccccttggccagtgaacaattgttaatagtgtcttctgaatctaaccagagacagtctatgcataggcaaacacaggtcagtataggttttcctttggctttttgacatcttgctttttacaattatcaatatatcttggagattgttccatatcaacacgctgacttgccttgttccttttaatggctgcatagttttccatcctgtcaatattctacactatcgttagtctattcattaacatttaaatggtttttggttgtttattactgcaaataacgtgcatgtgaaaattcttatgcatctatctttgagtacatatgggagtcggtagcaacagtttttaaaggtgaacttgttagggaaaaggttacgtgcatctgaaagattgaaagacagcaacacattctccaagtgggtggcaagagtttgcatgcggcacaccagtgtgtgtctttttcccacatcttccctggttcccagaatagcccattttgttatctttgctaaatctgataggtaaaaatggcatgtccttgttttgattggtctgtatttaaatatgagcaatgctgaacatctttcgacttcttatatttgtagattattcctggttgccaggaaaggcttgtttatcagcatcactcaacattattatgagttgattcgaattttattttatgtcctatgacctgaaattctggaatcagaagacctgcttttgagttccatctatccattcaacaaatatttactgggtgttgtgatgtgctaggtttgtctccagtactgggaatgcagtagccaccaactcacagttcctgcgccatctgttacacagaatgtgaccttacacttctgaggttcagtttcctcatctataaaatgaggatactaattttgctctatataactcacaggattgctgtgaatattaaataagagaatgcatgtgaaagtgctttgtaaattgtaaagcaatgcaaaaatatttataataatgatgtttttaatccagtgcaaaataaaatggaaatttaacaaacaaactgattagataaataagatacaaatttcaagactatccaaaaaattcatattttggctgagtgtggtggctcatgcctgtaatctcagcactttgggaagctgaggtgggcagattacttgaggccaggagtttgagaccagcctgatcaacatggtgaaactctgtctctaataaaaatgcaaaaattaactgggtgtcatggtgtgcacctgtagtccaagctgcttgggaggctgaggcgggagaatcgcttgaacctgggaggcggagactgcagtgagaaccgagattgcaccactgcactccagcctgggcgacagggattccatctcacaaacaaaaacaaaaacacccaaaagttgagttatttcaattgcatattctttatatacccaatttcaaactatcaaaaaatgttttattttggaaagcagttgaacaagcatacagtttgtgcttatcatttctaatacagaagataactgacctgggttttttgcatggctcctaagttttatttcaaatactcttataaacatcctcgactacattcagaaggattttaagatagttatccacataatcaaaaacactatacctagtctgaaacctattatggcatgctgggccgaggaaatactatatatttgataatgctttatcatatgttgccaaacagaaccttcacagctccgttttgcaaatgagaaaactttgagacccttgtgtaaatttctctaaaatagctgttcagttggattggggactcaaacccaggtttcctgatcttaagttctcttttgttgttgttgtttcaactgaccactgtcctgaaagaaataattctttcttttgaacacacaaaaaagaacctttaagattattatttttgtcaccactataatggtttcaactaaagtacaagatatgcccagtctgtttaaaaatggatttccgtccaaagtagttgggtcatatgtacattatttttttctcacacagcatacaaagagacattaatagtcatctaaaaaccggtgaaacaaaactgctgaaacatgttgtggcaccaggaaataaggacatgctctaagaattatgtagccatgtcaaaagcatacaggagtcaactgaaagaacctcctgctggccaaatctaggacaatttggtattcaaataaatgatgactagtaatggattagaaaccactgaaaacaataaatatccataaattcatgttaatataaacaaccaacaaacaagggtgaaagaaaattacttccttacagtagaatgccaactattaaatataataggaatgatggggttaggaaataatcaatagatgttaaagccactcagtaaaagtttgataaggaccaggatatttacatggtctcaaagtaacacttcacattattacttatacaaaggaaaaaatggtagctttactagacaaatcagacagacaccaccttaagcaagtcatcagacagaaacaacaccaatatcaggacaaaccaacatcatacgcttcttaatcatatacactgggaaggagtcaacatcagtttcatgatgtttttgccaaaaatgcataacataagtctcatcatgaggaaacaccagacaaactcacagtaagaactgttctataaaataactggctagtactggccgggcgtggtggctcacacctgtaatcacagcactttgggaggctgaggcaggcggatcacgaggtcaggagatcaagaccatcccggttagcatggagaaaccccgtctctactaaaaatacaaaaaaaaaaaaaaattagccgggcgtggtggtgggcgcctgcagtcccagctacttgggaggctgaggcaggagaatggcgtgaacctgggaggtggagcttgcagtgagccgagatcgtgccactgcactccagcctgggcaacagagcaagactccatctaaaaaaaaaataaaatagaataactggctagtactcttcgaaaatgtgaaggtcataaaacacaaaggaagtattaggaactgttccaaattaaaggggattaaagagacagaatcctggatttgatctctgactggaaaaaagtagctataaattgattggaataattgattaaatttaaatatggactatagataatagtatatcaatgttaaatttcttgactttgaaaaccgtactgttgttatgtaagagaatgtcctttttcttaccaaactagcaaaagaatatttagaagtaactgggtatgatacctacaatttactctaaaatgtgtacacacatagaatatacatattataatatacatatatgtatagtcatgtgccttataatgatgtttcggtcaatgatggaccacatatacaatggtggtcccgtaagattataatggagctgaaaaattcctatcacccaatgatgtcatagctgtcataatgtcatatgcaacacattgctcacgtgtttgtagtgatgctggttaaacaaacctactgtgctgccggtcacataaagctatagcacatgcaattacatacagtacataatgcttgacaatgataataaatcactgtgctactggtttatgtatttactacactatactttaaatcatcattttagagtatactcctacttataaaataaaaagttaacagtaaaattggctcagacaggtccttcaggaggtattcctgaagaaggcattgttatcataagacatgacagctctggccgggcatggtggctcatgcctgtaatcccagcactctgggaggccaaggcaggtagatcacttgaggtcaggagtttaagaccagcctggccaacatggtgaaaccccgtctccactaaaaatacaaaaattagctgggcgtggtggtacgtgtctgtaatcccagctactcgggaggctaaggcacaagaatcgcttcaaccttgggggtggaatttgcaaagatggcgccactgcactccagcctgggtgacagagtgagacgctgtctcaaaaaaaaaaaaaaaaggaaaagaaaagaaaaagagatgacagctgtgtatgtgttattgcccctgaagaccttccagtgggacaagatttggaggtgtgaagacagtgatattgatgatcctgaccctgtgtatgcctaggctaatgtgtgtgtttgtgtcttagtttttaataaaaaagtttgaggccagacacagtggctcatgcctgtaatcccagcactctgggaggccaaggctggaggatcacttgaggtcaggagttcaagaccagcctggccaacatggtgaaacctcatctctaccaaaaacacaaaaattagctgggtgtggtggtgcacacctgtaatcccagctacatgggaggctgaggcaggagaattgcttgaacccagtaggtggaggttgcagtgagccaagatcaagccactgtactctaggctgggcaaaagagtaatactctgtcttggaaaaaaaaaagtttgaaaagttaaaaaaatatatatattttgtaatagaaaaaaggttccagaataaggatataaagaaataaaatatttctatatagctgtagaatgtgtttgcatttaaactgttattacaaaaatcaaaaaaatttaaaagtttataaaataatgaagttacagtaagctgttaatttattattgaaaaaagaaaaatacatttaaaaataaacttagagtagcctaaatgtacagtgttgataaagtctacagtagtgtacagtaatgtcctaggccttcacattcactcacctctcactcagactcatctagagcaacttccagtcctacaagcttgattcatggtaaagtaccctagacagctgtaccattttaaatctttttttttttttccttttgagacagggcctcactctgtctgctaggtctgagtggagtggcgcagtcatggttcactgcagcttcaacctcctaggctcaagcagtcctcttacctcagcctcccaagtagctgggactataggcatgtgccaccaagcctggataatttttgtattttttatagagacggggcttcgtcatgttgcccagggttgtcttgaactcctgggctcaagcaatcttcccatctcggccttccaaagtgctgggattacaggtgtgcatcaccaaacctgacctgttctctagattctttgaaaaaaagaagctacttgttcatttctttggctatagtagctacaatggaccagaatcattatatggaatggggctcaaacacccctcccccaaccaggttgcctaaatcacagtttagatgctccaaattattaaatcagtatcatgcaaatctcagtcagtgggtgttaagtactagagaaacgggtaaggggaagtgctttaggccagaactatagctaccattgccgattgaagttcccattttaactttccctcttccagagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagtaagaaaagcaccccaaactgtcataagcgtggaattgtgcatgagtaaagtccatttccttcccgttcacaactcccaactgtgagctctttagagtgcgttccccttcaatagcgttggaagtgcagttgtagtttaactggtgtacttccagatgacaactaatatttatgatgtctttatcttgaacagatggcttctggattcgaatcctggctttgcaattttctacccttgtgtgacttttggcaagttacataagtttccattttctgatgtcttaataggaatattaatagtacttacctaataggattgtgatgaagattgagttaacatgtgcaaaattattaaacgcaaggtattggataataaatgtcagctttatatggaaggacactgtctgggtgagcctggatatgggcccaagatctttacctatactcccctcacctgcatttggtggtccttttatttacttatggttttatttatttttattttttattttttattttttttgaaatggagtctcgctgttaccaggctggagtgcaatggcgcgatctcggctcactgcaacttccgcctcccaggttcaagcgattctcttgcctcagccttccgagtagctgtgactacaggtgcacaccaccacacccagctaatttttgtatttttagtagagacggggtttcaccgtgttggtcaggctggtctctatctcttgacctcatgatccgcctgccttggcctcccaaagtgctgagattacaggagtgaaccactgcgcctggccttatggttttaattttatgctgtgagatgacagtttggccccctgaggacttgaatatgaggactgcaaaagtgtagcacagcttttgtgttacatgagacacaggccaagtcagtcttgcattcttcatggtatgcataattgttccagggctgcgccataattgactaggcttacctggaaagctgcccaggtagatgaacggattgacactgctgtcatattgccaaaccagggatttctgacatcatttagggatgggagaggaagtttttaggactgctggtgcagttttcttttgggcagcgttagcccctgctcatcatcccatttcatcattagccttccttggctgagaagagggaacctcactttgaggggctttttgacatctagtatgtgctcaaagtatagggtggagagtctagcatgaaaaggattgcctgcttccagctgaatctgggggagagtgctgcccagacataaaagcccaaagaccttgcccttgtggaactcacattctggtggggcagacagaaaacacctatcaatgctagagagtaatcaccatgaagaaaagtaaagtacagtcaaggatgcaaaatgatggaggaggagaagaaggaggtgctagggaggatgtttcaaagaggcgacctgccaacagagaccagggagcagtgagccagggggccatgaggctattctggaaagatcatttaggcagggaaatgtaggcaagtggaaatacccttcgagggagggcttacaccctctcaccacttctgaattgttactgagggcatacgctttaatgtttgaattacttatttgctcacttatatactgatttaatgtgacctgcattggattttattactattattattatcattattttttgagacagggtctttctctgttgcccaggctggagtgcagtggtgcaatcatagctcactataagcacaaactcctgggctcaagcaatcctcccagttagctaggattatacaggtgtgcgctaccatgcccagctattttcttaatttttttagaaatgggggtctcactatgttgcccgggctggtcttgaactcctggcctcaaatgatcctccagcctcaacctcccaagactttagaattacaggcatgagccatcgcacctggcctggcctgcattttagaagaggttacgggattccttgaaattttatttcttagatgtcccatgaataaaaagcaacatacccttaatctaaaagttaactacgcaaaatatttttttcttaaacacaaagataccaaagtgagtggggaaaggcattatcctgctttgcatacaaggtattaggctatggtttacaaaataaggatccatgcaatgtgagttcaaggtggaatcaggcatcagaagccaggttatttggcccccttggaataaaagacagttgtcctaggaagttgattctagggttttttgcaagtcaaagatgcctccctctgagcagcagcatgaagaaatccaacatattaggtgtttgtgtgtgtgtgtgtgtgtgtgtgtgtgtgtgtgtatgtgtgtttgagacagagtttcactctgtcacccaggctggagtgcagtggcgtgatcatgactcactgcagcctcaacctacgggctcaagcaatgctctcacatcagcacctgtagctgggaccacagctgtgcacgaccacgccttgctaatttttaaagttttttgtagagatgaggtctccctacgttgtccaggctggtctcaaactcctgggctcaagcagtcctcccacttaagcctcccaaagtgctgggattataggcttgagccactaagcctggccgcattgattttttttttttttttgagacagagtctcactctgttgccaggctggagtacagtggcatgatctcagctcactgcaacctccatctcctgggttcaagtgattctctgcctcagcctcccaagtagctgggactacaggtgcgcaccaccacacccagctaatttttgtatttttagtagagatgaggtttcaccatgttggccaggatggtctcaatctcttgacctcgtgatctgccctgctcggcctcccaaagtgctgggattacaggcgtgagccaccgcgccaggctgatattaagaatttttaacaccgagatatttgtggagtagatctgagaataaggaaggttgcagagccagctaacaagaggcagactataaaaataaaggcagtttccctgaagcacgatatgtgctccatgagagaagtgtctggagagtgtgggaatcaaatgcttggagaggaaagcacagcttgcaaagtgaatcttctaaatggaatcacaaatccataaatcctaaggttttaacaagactgctttgtcagctcatgatatacctaataggatagagcatttcatgtggatgcagggaaacaagagaggatggagtaagaaggaagttttgagcttgggatcccgagaaggggctgcccttggggatggtaccaaagtagatgttttgagagctgaggactaaagattcaggatgatccatttggggtgtaggaggtgatataagaactttccatttgtttttgtctgcaaatgtaagaaagaagttaagctttactgatatttataaataaccctcacatttgatgtggatgatgtgttgtgtatgatttcaaggttgactacgcgggaggttggcacttcatggtgggagtgtcctcattctttctcttgtcttccgtataccatgacatggtgcagattgcgtgctataggatatcaccattgtgattagctttatagaaatagggctttaaataatatcatgtgtgatgaaagggagaggggtgaactttggagtgttgtattacatacaggtttcctggttatctactagcagtagctaaaaagttgtgaatgcaaatggctgccagtgatttctacatagcagattatatatttaaaaaaatagatgcagcctgtcccttcacagaaaaagtgatgctttcagtaggtgagaaataattgccttttgcaaaatagtcctgttgggaaaacagcattttgaaaagggatgtttggaaatgttggtattattattaggttttctgccccaaaatgatatgtatcacatagaaaaactctcatatatgtgagaaataaacttttaatccatttcaaattttttctaaatgaggagtttcaacaggatttgttcccatttacttaaaatacaaaaaatgcaataccttccaactagtttgtaacaacaggcagacacaagaacatgaaatgtcatagtcaaatgtgaagagaaaccttcatatgggtgttgactgaggtagaggaaggggtgtcaggatgcagagacacagccaatcgtgcacttctctcacttgggtgtgtgcctcactgagcggtgtcttctgcagctataccaccattgaaagcagtctcaaaataacgtaaagccagaaccaggccttcacatcgctgtattacaaacgttaaggtagcacagatattttaatagtgaaatgtattaatcacatagctcttgctaaaatgttcttaataagcttcatattcaaaagcttttctacacagtatataaaataaaaagtgtttttgagtacttcacttattctcagttgttttgtgtgtttatgatctctattaatatttacatatcacatgtaaggaaagaaatacacgtattttagtggttatattccaaactttgtattgggtgtaaatgtatgagtgaaagatttggagccactggaatataggatggtttgacatcagtcactggactttttgaggtagtagaggctcctgagagagggagaggtttgttaaggagacaggggaagcactagttagcatccgttatgccatccattatttagcatccaggaatgaattttctaactccatcattccttctatcttattaattgtcagtctaaggaagacctttacattctcctgtacttatttgtttatttatctcaagaaagatttacaaattcttaatttatttgaagggttgtaattcttaatgattatatctccgtttcatcttcccttccttatcttctctaccagctacaatcactttttccaaatgacagctaaactcctttcctatgacttctgtgacctttctggcatcttctctttccctagtttcatagttactatgtgtctaggactcaatcatttacccttgatttaattgtttcctgtatgaaagtttcataacctcagactataaaatcctgagtgataagaacaatgttttctccttctttcaggcttctcatttaatatgtcctcgttgaagtcacagaagattaaaacattgtgccatcttcatattcaagcctggcacttacattaacaaaagataccatgtgcaatatcactttcaaataatttaaatggaagcgctaatatgggtagccccaaattttaaacacagattttaaaagccaatatataaaagaaagggtataaaaattaaataatttctatgtctgagtgagaaaattgagtccatatcttacttctgactatcgtagcagcaaggaaaagagggtagtgtaaattgtttagtagaactgggtatactgttgcggtaagggagactaacttttccttgacaacgaatttctaaaataatttgttacctacacaaagtacattgggctaaatgtcttcagtaagagtttttgaaaaaatgaaccaatgtgaccttttcacatgaaagagaattaacttaaaatttctggagtgagggagaagaggattgcgtagtgtagatagataattttccagtggtctagcttaacccaggtataaagcttacaggatcttgaggagtggatggtgatcagtaccctaggccagtgcttgtgatgaccagatttctcaactgaaaatatatattgtcagttttatataggacatatatataggagatatgtttaagacaaaatgggggtcactagcagatacctgaaggccagagattctctattattgaaccaggaaagtttgcatgcacactggataccaacatgttaaagcagcagggcatgtttggccatgaagttgaagagtttggcttacaggtgcattgtaatggaatcccttctctacttccacatggagctgtgctactggatgacctataagctgggccaggatttttcttaaaaaaaaaaaaatcagccatggatatgtccagatgtttgaacaagtactggatggaagcctcagggttttggttataaaggatgattgacaaactttaatggcatatttgagtgcaggaggatgaaatgcccaccactaccatagaagtaccttataaatactcctaagtagattttactgtgaacagattgtgttctgatgagctttccaggataaattagctgcccagtgaggccccagatatttgagagaacctgcttcaaataattgcttagaattctttttctggattccacattacatctgccagatttgagaaaaggagttttagtgtagctaatatttagatacttttttctgagaataatcaatcaatatttattcaacaaagatttgcagtgtaccacctatgtgctcatcaaacaggttaaactttgacaaaagtctgttcacctattcttcaggctccagtgataaggaattttctaattcttaaattttgcaatttcaggaaagggccaggagggctgctccatttaagagaagggtggagactgggtcaaagaagatcctgtgctagtccatggtccttctgcttaagggaacacacacatggtttgctggcttgaatccacattgtatgccattcccccattacttttttctgttcttttttgagacagagtctcactctgtcacccaggctggagtgcaatggcgtgatcttggctcactgcaacctatgcctcccgggttcaagctattctcctgcctcagcctcccaagtagctgggactgcaggcttgcaccaccatgcctggctaattttttgtatttttagtagagaaggggtttctccatattggccaggctggtctcgaactcctgacctcaggtaatccacccacctcggcctcccaaagtgctgggattacaggcatgagccaccacgcctggcctcccccatagttttatttatttatttattgagatggagttttgctcttttgcccaggctggagtgcagaggcgtgatcttggctcactgcaagctccgccttttagtttcaagcaattctgctgcctcagcctcccgagtagctgggattacaggtgcccgccaccacgcccagctaatttttgtatttttaatagagacggggtttcaccatttgtatttttaatagagacggggtttcaccatgttggccaggctggtctcgaactcttgacctcatgatctgcccaccttggcctcccaacatacttttctatatagtcatatataggactatatagcacatagtcctaaaccttccatctaaatcatcccatttctgaatctctgtacaacgctatccatgttaacttgtagggacttaacatgtatgtttattggctggctctcactttactcacatagttcacattgcttcttaaaacctgtcatgagccttatgctctggtgtgctcaaactggtgctgatgtgttctcatcccaaaggactggctggtgcttctcagtttctttccagcattaaattattgcttaacagataaactgtcaacattttgagaatgttaattttttttcagtatttcttttcctctctgcttttaaggcaggtttaacaacttactttcatcctggaataaacttgaagaaaatacattatgatagcatcaaactttatgagaaactggaagaagaaactgggcaggtaaaggcatttaacttgaaactgtctgttaggtcggcttctcagaaacatgtaagatttctgaaggattttgatgcatcattgtgtatgaccgtgtggagtgcttaatgtagtagaggaatatgatgagagtttaaggtaagaacctctagagtctgctttaaaatcaacttaatttctcaaagtatattattcatgtcatgaaccattctttattttttaaatgaagaaagaataaaaagcagctttcaaaagtatctttagccagttactatatctagaaactaagaaattggagtctttcagcaattgcattgcaaaggatctgacgatagaatgtaccagattgtcccatgactctgaacagtacttcattaagagcccctcactttcatgtttatcccttctcatatttactcaaactctcaaaataaaatggcaggcaaaagagtatccataggctaagactgaggtctcaaattttccatgtcacttcccttgcctaaaccatccaatggctccccacagtctaccagacaaagccaaaggattagcatggccttaggaacatgacctttgtcagctgacctctgcctgctgtcccaactgtttctttttccattcttccctctgcttatctgcttcagctactctcaataacatatagttttggaatgtgctgagctctctcaaatcactgctttttgtttttgttgtgttctgttttctgctgcttcccctggccccatcttcggcatccaccttccctggggtcaccacctttgagaagccttccttgacttttcctgcctgctaggcaagtcaaagctggaggtcccatctcttggttctcagagcatttgtgcacacctcttttataacttgaatctctctctattgtaattgttgatttacttgttggtcctccctacaagtaacttgagggcaagggctatatcttttatctctgtaactgagtgcttggcaaactgaaggactttaataaatgtcaaatgaatgtttacttcaattcagacaatctaagcattgcaacattttgattctacatgatctctccttaaattttttgtctttctccttttcatacagtttttgttcacgctgtacattaacactcattccatgctactgtgattttgcatttagctgtctgtcttcaactgtggggtataaattccacttaggcagagtctttacctttcttgttcacccctacacctgcggggcttagaatagtgcctggctccgaacaggcacttagtaaatatggtagttgctgaataagtgtcttttaataagatgcaaatattttaatagttatttctttcactcgtaataaatctttttgtacagctgcattttcattatactggagcagaaccatgtttgagtaccaaacaatgacttatttatatgctctcactggaattattgtcacaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggtatttatcttaagggcatttttaccatttgttgacttaagtaaaaattagaaaaagttattaagaagttaactaaaaacagaaaacttggtacacacattttaaatgtgacaaaatcatatgattaattttggaatttgggtaacttacaagataggctgttatatacagtaaatgatatataaaaaggtaatgacaaatcttgttagtttttcacctttgacaattgattaaacattttcaatacctttccattattgtgtcccccagatctaagggtttccatacacaaaccttctgtttgagaactgcagagagaatgataacctgatatgataaatgtctagaaagactgtggtattaaaatgttttaaaaatcaaattaagaaatgccatggtacgttgctctacaaatatcacctagcttatagctgtactccccttacagactctgtgctaggtacggatctagatttataccacatttgcctgagagaacctacttgacatgaaatttagtgttttttcctagtgggtaataattccttttgaataataataacaatggctaacacttactgtagcacatatttatgtaccagttagtatgctaagtccttacatgcataatttcatggcacgtatttatgtaccagttagtatgttaagtccttacatgcataatttcatgtaatcttcacaataatagtatggggcaggctggatgccatggctcactcctgtaatcccagcatgtggtaaggccaaggtggggggattgcttgaggcgaggagttcaagattagcctaggcaacatactgagacctcgtctcacacactcacacacacacacaaaattaactgagtgtggggtagtaggattccgtctgtagtcctagctacttgggaggctgaggcaagaggatctcttgagcccaggtgtttgaggttatagtgagctatgattacactactgcactccagcctgagcaacgaagtgagagcctgtctctaaaatttcagaaataaaaaaaaagtttatatctatatctatgttatgcggtatatattattgttaaacaggaaattttagctcagacagtttacatagtgagcccaagctcattcactagaaagagctggagtagagatttaaacccatgctctctgactcccttgcattatacatcttgcccaagtgtatcagatggggctgttggggaaacacatgcttatttccctgctggtgaccactgcagcagttcccatctctgagggtttgtatcattgacttgggtgctagggttgtttgcctttgcgagtcttcacaggctgctggcactcccttgtctatagttgtgtgtgataccagtgtgatggcagattggtgttgcactgcattgtctgcattgaaattttacctccactaccagtaaggatatacttacatttgtttatatgtcaatcctgaatgctttgctggaactcctcactatcatgaatttttctcaagggcattcattaagcaatgggaatatgtgtgaagggtattctctgcatctgggagaaggtaccaaaccaaacagatgtgggattactacaacgaggtcctatccattataaaacacctgtgtgacatttggaagtctttagaaatgtgaattcccttaaaatagaaagtcccttgcacaagacctataataaatgaaaggattgaattcgtaatcaaaaacttcccacaaagaaaaccccaggcctggatgacttcactagttaatttgaccagatatgtagagaagacttaatgccaatctctctcaaactcttccaaaatagaagagtgaatgcctctcaactcattctatgaggccagtattgccctgataacaaaatcagacaaaggcatccccccaaaaagaaagactggtatcccttttgaacatagatacaaaaatcctcaacaaaatactagcaaactgaattcagtaacatataaaacagattatgcagtatgaccaaatggaatgtattccaggaatgcagggttggtttaacatctaaaaattaatcaatgtaacaataccacattaatagaataaaggacaaaactacacagttatttcaatagatacagaaaagacatttgacaaaagctccttgcttgtatttggtgctcagccaatttttgttgaatagatgagacccatatataatatttcactgatcattctatcaacgtatcccatctgagtttcattcttctttgttttccccacagtaccttgcctgaaggcctaaaacaaagtagatatgcaagaattaattgttgaatgattgaatcaaacataaatttcctgacaccagatatattatttaacgtgaatttattaacagtattaaaaattaaatataaattataattgatatatcagttggaattagatttgtcttcaaatgtcagaaaccaaaataagaaggtgtaaacaagatagaggtttatttctctttcttttcagcagtccaggacttgaatggtggctttttcatgaagtcttcagggacccagtcactttccagatcaagaaacacttttgaagtccagttttactaaacgtttactagcaggatatatttttactgagtaataagtatatatatatttgagtattgactctggtatgattgatttaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggtaagcatatcatttttttgaaattagtgttttttaagtgccaaagaaagaagatatttagccgtaatgtttcgtacgatggacattgtcatgaagcactgtgatgctcccaagttaaacattttgtctgtttctaagtgacaaagccctccctctatcactttgctcttggtggatgcgctatcactctgtccttggttatccaaaaaaagttgcttattttctccattctgcattttattttgctccagattgtgtttttccaaattatgtttatttttccttcctgtattcactgtttctctatatgaataaccagattctagtgttgaagttcataagcatcctctttgtgtccaatttgctttttagggcagatttgatcatttgggttctctctcatccatttctgatgacttttgactctagttgaaaaagtttttaaatgcttttccttctagaacattattaaacatatttcataatcttctctttttgttgttctgttacgtttggactcagagtagtgaagccaaaagggatatttgggataatccaacaacacactcattttcatttgcagaggcaaggtccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaggctggagtgcaatggcgcgatctcggctcactgcaacccggtttcaagcgattctcctgcctcggcctcctgagtggcaggaataacaggcgcctgccaccacacccagctaatttttgtatttttagtagagacggggtttcaccatgttgcccaggctcctctcgaactcctgacctcaggtgatctacccgcctcggcctcccaaagtgctaggattacaggcgtgcgccactgcgtccagccgattgatattatttttaacaaagcatttttagtggtcctagagaaaaagtcatgtcttcaatatttaagtgtctaaattagttatttccgaatttctctcacccatgcctcctatttgaaaagccataaagtctcatgctttctttaatataatttgaaatttgcaataatataaaataacttgcctaaaaaataagagcagtggtacaatacaacgttgcattgtttttaaggctcactttccctccagtctccatctgacactatcctctcttaatgtccttaggaatctctggtctaaattctgtcagaaaacttagggcaatgaaataattcagacttttttctaagtagcaaggattctttgtaattttgcaactttttctatagtctcatgaattcaggccctaaaaacatttgactgttttcatcattatagcaaatactaaagtaacatactgagacttccacatccagcacctgtggcagacattgctaattaatcgctgcactcatttcagatggacttggacaaagccccaccatttttctcaacacagtactttaggcaatcatacattcctgattgacattttgagaaataacatagaagaccttaatttaacacatttatgcattgttttcctaaaatggataaacatatgtacataatgaattgtcattgtaatacattttttttctaaactacatactgtaacaaaaaggaatcactgaagaggaagatagaatgatctccaaagagatctgacctaaacccgtaacactagttaccagatgaagctttctctgcagctgtgaaatcttgtggggtgatggggtgcaggagggcagggaaaggaggtccttgagaacagcttgtctcgtacgagcctggaaaacaagtccctggtattaggacagtgtggccctgcatggagtggtaatgcctccctttttcccttgttcttgtgctttttgcccagccacttccaatcccttttcctagtaactccaggcatttctttgctgaaacttgtgggaagtagcttatctcaattctttatctcatttagaccagatctctgctccctaatcttttttttttctttttctcttccatcgggcaaaattaccaagaaaatctaactgattacatattagtagtccacaggaggtgtggaggggtgtgtgtgtgtgtgtgtgtgtatgtgtgtttttaattatctgtaagtctgttttcaaaacatctgtatttaaaagatagaagattccccaaagggtaagcctcagtaattgggaacaaaagtttggatatgctcccttttagaactgaagctagcaaagaccagttttatgaacaaaagcaactatctgcagaagtcatcatgctataataaaatgagtggagagtgtgtggctggtggaatgtttcccacagtttctcagtgtgaccagggtatctcccaaattcaggcaaggccctcagaccagcactgaaatatgattaaaggaaccaggatatggacttggaaatacaaccaaaatgaaaaagatgtaaaggctgctggggtctgcagggtatccataaaaagaaaagtctaagagtaaaaatttgtcagctgatgtgttttcggcattgtccatggcagtggcactctgtggcccagagacatagacattgccaactgagtgacttgggtaagttacttatttgtaaaatagggataatagtccccatcttgaaaagttattatgggtagtaaataagctaataatgtaaagtacccagaacggggctcaccaggtagaaagcagtaaaaaaaaaggtataataattattatgatcattgcaattatttccttgatattccatgccgtagtctgggagacactagcatcaggttatgatagcttcttggtaccagacttaagactgctcaactcctttcttttccaatttactagcagagtgggtgcagaatccagcaccgattctgctggtaagttgacttcccaaagagcttggtaatcaagctagtgtgagtaagaatcaccttgggaagtttcccaagcttcaaaaagattctaattcaggtgttctgggtgggttctcagaagctgcattttaaataactactccaggtactgtactgtctgtaccagatgatttgcaagaaaaatctttgaagaaacactattgtgtaggtgtttctaggagagagaatataatgactgtattcggagctagcagaactggggaagtttctgatgcttccgacctcttgatgggcagtagtctaacttgcctttagttaccaaagctttccaaattggcctcactctaccctttccctcaggtacagctcagggacgcgggcaggtactagttattatgatgcaggctttttctccgcatggtgttgaacgtttttctttacctcatttccaattgactcattaaatctgagataactttgtaaaatttacttaagaattttcctaacatggcaaatcagaaatgtgattgggttgtgctcacctgaagctcagtgttcagccaaaaagaattgcttaattttgcctgatactctgcgtcaaagcatgaggccatcattgtcatcatataaaccatctagtagaagtaaacttgtccatgaaccttcagcctgcattttaacctcatttttattaatcactgcatttttaaaaaatggaagccatttccagtagtcatttttaattgactcttctctttagttgtttttcaggtgataatggtagattttagaatgagtcttccacacttgtctctcttcccttgaacttaatgggtgggtgatcaggcaggagttgaagtgtaactctagctagatttaggttaatttgattgacatatggaagaagagaatgctaaaggacaccagccccatagatatctatgggtaaaacagcttgctatgggatttgaagtaatatagtgataagatatttctgcatacatttccactttgtattcatgatgaagtgcattagtaagcaagcagttggactcagaaattcataaatatgtttgaatagggcagaacttatttttttcaatttatgtttttaattgaaacaaatatattggggatactatagcagtttgaattgcttagctaaaaattttgatttttgtatatttaaaaattgtcctagtgtatataactagaatatgtggctttactatatttttgtacacagtcctgacattggtaattcacatcttcctactagcaagagtaaattaagtctcaaaattactaaaagaccaaaacgcctgtacttggggaggctgagttgggcagattgcttgagcccaggagttcaagaccagcctgggcaacatggcaaaaccctgtctacataaaagatacaaaattagccaggcatggtgatatgtgcctatagtcccatctactcaggaggctgagatgagaggatcacctgagcctgggaggtcgaggctgcagtgagttatgattgcgccactacactccattacagcctgggcaacagagtgagaccatgtctcaaaaacaaaacaaaacaggccaagcattgtggctcacacctatgatcccagcactttgggagccccaggcagcggattacctgaggtcaggagttcaagatcagcctggtcaaaatggtgaaatctcgtctactaaaaatacaaaaattagttgggcatggcggcggatacctgtaatcccagctactcaggaggctgagacaggagaatggcttgaaccctggaggcagacgttgcagtgagccgagatcgtgccactgcactccagcctgtgcaacagagcgagactctgtctcaaaaaacaaaacaaaacaaaacaaaacaaaacaaaacaaaacaccggcaaatagctctgatgcccacagttagatttctggtttgcaaatgggtacccgtttctggattcattatacaagtgtgaccaacttagccattgcaacaaacaaaacaatagaatgcaaaggaaaggtttagatggttacatggaaataaacttacacacacaagtacataatctaggttcccagactgactcataattgatgattctctgtctagcttggaacctcataatgatagagacttcagaactccttattagattcagaaaaacagcagagacagtactggttaaaaacttattgtgtaacccctaaagaaataaataggatcatgtaatcatttcaatgatcactcaaaattattatgaaacaaacaagcaaatagaactccctgcccccaaatcatctaatggtggtcagtcaacaccatgtccttgccaaataataagcatttttattattttagattctaaaatccctttatacagtgaaggtgccttggatttttaaaataaagtctgcagcaagaaaaaccaataagatgtgatgattacaggatgtccagtgtggcctggggcatgtcttaccctactagcctttagctcccacatctatgtactgaagggtcagcctgggaaagaatcaagggtcctttcagccacaaattatccagttctatcttttgcaaatgaaaaaaataacattcacctccgcaaataaaacaatctctgtgctaacggtgaagtgggaaacattcgtctggggaactccctgcctacttatgagaccaatctcccctttcctgtggcttctctttctccctggttttgacttctggtgcttttgtgcctttacaataaaggatcttacaaacttattcaaactaaacttttaaaacaacagataaaacttaatgtgctttctctcccgaagtatgcaccattttcaattttagcttaacagaacaatcttgtacttttggaattttaggcatcaacaatttggggagaatagggcttagaggatagaggagttggcttgtagggctttcttaggtatatcattatgtattatgttggtcacagcaacacaggggcctcttcctttgcctgaccgtccctgtccacaaatatgggcagtcttgttacggtacttcttactaacatttgtgccttttgtatatttgggttgttcgttttttctttcaaataaatttttttgtttttttcctgcctacctttgcttatgggcaataacattttcaggaatggagttcccctagatcacagatatcttcaaatctctgggtaatgcaaaatattgtcttctcttcccccattcagttttgcaatgacaaaagattagattgttatgacatttattagactttgccatgagtacttaagccttctaaacattttattctaatataaattgctatatgagtgtcagttatgtgtttatatgtgggctgacacttttaaatgatttttttgtttaaggattttgggctcgtgaagtaggtaaaatgattggactagaacatcctctcattccggttcaacatcaatatgttgttacatcgactatacctgaagtgaaagctttgaaacgagaactccctgtgctccgtgacctggaaggatcatattatctccgacaggaaagggatgggcttttgtttggtccatatgaaagtcaagagaaaatgaaagttcaggactcctgggtcaccaatggagttcctccaggtgggttcagcaaatgaaagtgtgtgctagtcagacatgaatggttcatcctctccatggctgggggatggctgtagaataagacaacaacataatactagactttcagatacctgggacattggaggtgacaggtttgaggtgagctctgttctcgtatccctttgaacaatcacagcagggagtaggggaaaagaaagatgtagttgatggtagagaagctgaagtaacatttccagctgctttgaaaggttccagatacatttttacctgcccacacaacctcctgcctccccgttttttcctcaatccactgccagcttggtctgctttcaagatttgaatatagatgctattgtgcttttacagctagaaacacaactgatatcagaggccagatatccatcctaataagaaggaaaacccaagagtctataacagagcagggtttttggtactgtaaatggagtacttcccatgctacataagtggatatggaaaaggcttgtgcctctatgccaaagcaggggatactatagtttctctttcaagttctttaagggagatggttctgtttttgcttttcatgaaatacttccacagagccagattgaagattgggtcatctaaggaggtacctcagcttttaatctataaaaagagctaaaaaatcactggggcattgaaatattacagggaatacaaagaaatgtaggaaatggtacttcctaaaattatactttgataagcttcttgagataggaaatgaatccctccactctactcctcaaagagtaggcccaaataatagcaaatgatcactaaattgccttctacagaagttaggccagctggtttcagggctttggttgtgctgagtgggctctgcacatttgggcctgagcagaattgctcctgatcccacagggagggttgaaatgccactgagagcctccctctctgctgttcccccatgctggcagcttctccttcaaataaatcttgaacaaatatttaaataatgccatttggagggagagctggattgttagctgtctgtgagcatgggtacccgtgtgtgctagtccaccctgatggtctgcaggcctccatgagactgaccctacctgtagtccccaggaagggcaagaagctggctggctgctgtgtggaaaaatcactagtgttggtagagacattcttttagaagctcatcacaatgacttttaggacaagaggaggattgcacttcaagaccctgcctgttttcagaactctagcccttggatgtgtatgggggcaggctggaggaaggaggcctccacaccattcctttcttgctgaaaggagagttaaaaggggtctaaaatccatcatcttagatcttggaggagtgttccactttttccagtattctgccatgactttgtaaactcccatttgccctcatctcaggggatgaaacaggttcttatggttaattgaagcataacgatcttcttgacaaaccaaattatagtttttttaaaaaaagactgattggattaaatatcagaaactatattattcatacatttaaattttatattaattaaaggttaacttttatgattttgtttcaagaacaataccattgttttcagtaatataaatggatactcatctgttgatagggaatatgaaatttagactttaacaaaaaatggcagtactttcctaacaggccatctttaaatgtaggccatgtcagaggcttaaatcactttacaggacttgtcagctcagctacggcatcctgaccacaagggcaaatctttttaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttgggtaagtatcttcatgtaattcaacatttattgtagaatcacttattttagctaaatctagttccatattctcaggatgcaaaagggaaatgtgggaggctgagagagagagaaagagaaacagagagagacccagagagttttctccctttcatgaccaaggattcatacaatgaataaaaaatactggttcaatcacttgtatatgttttaaagaagggcaactatttcctggaacacagaagggcaatgatttcctggagctttctctcttttattttttcagatggagttttgctctcgttgcccaggctagagtacagtggcgtgatcttgactcactgcgacttctgcctcctgggttcaagcgattctcctgcctcagcctcctcagtagctgggattataggcacccggcatcacgccggctaattttttgtaatttttttttagtagagacagggttttaccatgttgcccaggctggtctcaaactcctgacctcaggcaatctgcccacctcagcctcccaaagtgctgggattacaggtgtgaaccaccgcacccggcctcctggagctttctctttgcatatttcctgccatttctattaactgtttctggttttatgctgtgtatcttcagatagtcaatttgccccagttttacaaggatgttttcataacacgatgtgacaaagataattcaaaatatcaaatgtataacatgtctgctgcatttttcaccataattcatgtttgtccaacatgatttgtttctttataagtcctcaggttgctttctatttatgactccattgcctctttgatgtttcatttctgatgtttgttccattaatttggtgaatattgatgtcaagctcactcaactatcatatcacatcttctaatattctatttttcttccccattttatttggccatttattcaactaatgtataataactgctagctctgtgccaggcctagggctaggcattggaatacagctgacaacaaagcagtgaggtctgattggagctggagggctgcctgaggcacagctctgctgatccaatagagaagctggggtctctaccaaggtagcagcagtgaagactgagagatgggagataaaatcatctagatttggtgatcaatttcataagatattgaagggaaagagaaaaatggcaaatgatggcaacctttctaacttgaccaccgtctatatgttggagacatggagagagagacaagaaaataatgagttccatttttgatgggttgggcttgaagtgttaagtttaggtatgtgggacatccagagggagaaagtcagatggagatttgggatggaagttataatgtaattgagggttttatagtcacctatagagtccatatgcaggcatgtggaagtaggagtgcttctcctgcacatcactcatgtatcttctttggaacaatgtctattcatatcctttgccattttcataattgggtaatttgtctttttattgtttagctatggaagttctttatatattctagatataagaaccttatcaggtacatgatttgcagaacttttctcccattctgtgggttgtttttttactttcttgatggtgtccattgaaatacaaaagtttttaattttgatgaagtccagaatatgtatttttccttggttcacatgtacttttggtgtcatatacaagtaaccattgtctaatccaagttcgtgaagatttaaacctatgttttcttctaagagttttatagttttagcttttgcatttagttctgtaatcagtcatgagttaattcttgcatatgacgtgaggtaggtgtccaactttagtcttttcatatgtatagccagttgtcccagaactattcattgaaaagactattctgtcctcattgaattatgctggcatctgtaatgtcttttttctgattccttttcttacaccaaatgtgtggtattttccagcaccaacaaccagttctccaattctctagtactaactgggtgtccaacaattccattcaattctgacaccaactcctggaattaacatagaccccacaggttaagggatccgttccacaagactgctctcacttcggacaccagtctcaagtctcgggagacacccatacttctgaccaactgggtgttcccacaaccctctcctcagatttgataatttgctagaaccaatcacaaaactcaggaaaatacttatgtttactcttttattataaaggattcagctcaggagtagccaaatggaagagatacataggacaaaatgtgaggggttaggggtgggtggggcagcaccaccaggccctttccaggtgccttcctagcccatcactgtgttcaccaacccagaagctctctgaaccccatgcctaggtctttatggaggtttcattgcataggcatgattgattacattattggtgactgcactcaatatctcttctccactccctggaggttggagtagggagtgagactgaaagttctttattattattattatttattattattattatactttaagttttagggtacatgtgcacaatgtgcaggttagttacatatgtatacatgtgccttgctggtgtgctgcacccattaactcgtcatttagcattaggtgtatctcctaatgttatccctccccactcccctgaccccacaacagtccccagagtgtgatgttccccttcctgtgtccatgtgttctcattgttcaattccgacctacgagtgagaatatgtggtgtttggttttttgtcgttgcgatagtttactgagaatgatgatttccaatttcatccatgtccctacaaaggacatgaactcatcatttttatggctgcatagtattccatggtgtatatgtgccacattttcttaatccagtctatcattgttgcacatttgggttggttccaagtctttgctattgtgaatagtgccacaataaacatacgtgtgcatgtatctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctttttgctgcataaatgtcttcttttgagaagtgtctgttcatatccttcgcccactttttgatggggttgtttgtttttttcttgcaaatttgtttgagttctttgtagattctggatattagccctttgtcagatgagtagactgaaagttctaactctctaatcacatggttggtttttctggctaccagcccccatcctgaagctacctaggactgctctcctctccacaagagtcatctcattaacattcaaaaaatagtaaatctcaaatgttttatgaattctgtgtcaggaactgggaataaagaccaaatatttaatttttattataccacagcatctttataaaaaataaattgaccatagatgtatgggttgatttctagactctcaattctgttccttcatctgtgtctattcttatgcgactactatactgtcttttatttatttatttatttttgagacagagtcttactctgctgcccagggaatggcacgatcttgtctgactgcaacctccacctcccgggttcaagcgattctcttgcttcagcctcccgaatagctgggattacaagcacgctccaccatacctggataatttttgtatttttagtagagatggggttttcccattttggccaggctggtctcaaactcctgacctcaagtgatccacccacctcgaccccccaaagtgctgggatttcaggtatcagccaccacacccagctgacactctcttaattactgttactagaagttactagctttgtagtaatttctgaaatcaggaagtatgaatcctccaactttgttctttttcaaaattgttttggctggaagtcccataaattttaggactagtttgtcaatttatgcaaagaagccagctgagattttgatagagattgcattgaatctgtagatcattttggggagtattgacatctgaacaatattaagtattctgatccatgaacatgaaatgtctttccatttacttaggtcttttaaaatgtctttgaacaatgatttgtagttttcagagtaaaagttttgcacgtcttttgttaaatttattcctaagtattttattctctttgatattccaattgaattttagtattaaataatagaaattgaggatcattgactgtaaggcatgttctgagcagatagagtcactgatctcatgtggaacacctattaactaattgctaaagaaagtaggaagttgcttcctctagaacaagttacttataacctagaaatcacatctgtttgcatgtgactgatgtcagactcctcccctgattgctctggctaattttctcaggtcatagatactgggaggtgggtggagaagacaacaggtgggagtgggggtgggcaaagtgcctccctgtctttgacaggtttggtctaaaccaaaaaagccttcccgttacctaaagttgaggtttctaagatatttcttatgtaatataatggaatacccccattagctgcccctcctggcttatatcagtgcactcattccatggctctggaggccagtggttcccatacctgggtgaggagcagaatcatctgaggagcatgttaaaaagcagagtcttgaccatgtggttagtcacatgcacattttttatctcctatacctctcatctgtgaaattcctattatttgtcactagaacccatgtggcttagtctgcttgggctgccataataaagtaccatagactaggtgatttaaacaacagaaatttactttctcacagttctggaggctggaggtctgagatcacagagccgtcatggcagagttctggtgagggctctcttcctgggttgcagatggccaccttctggctgtgtgctcatgtggcttttccttggtgggtgggtgtgtgtggagagaaagcaagctctctggtgtctcctcatagaaggacactaaccctatcatgagggccccaccctcatgacctcatttaaccctaagtacttcccaaagtatttagagtaccatctctaaataccgtgacattgaggattagggcttcaacagatgcattatgggaggacacaaacattcagtccatagcaccatgaaagatgtattgaattgcaacaaacaagcaaacaaacagatttccagacactactcctatagattctgatttagtggtctggagaggggcccaggaatctgtattttattataataatatctgtaattcttggtacagccagttcagggaataggtgtttgcaaactgcttacatatgtgccagtgcccatttaccttactcgcagaatatcctcagccacagctattttactttggacatttgttttgtcacaattccaacaagtttttctgcttctaggtaactaacacaatgcccaaaaaagtcttatgaattgtatttaattgaatctgattttcttggcttagaacggattataaacagcaaatttaaagaggggagagtgctataagatgtaacatccagtcatttaacagagttataaaaagcagatacaaacactcaaaaagcatataggcctagggtcattgagaagaatctagaattctgcagattaatgctagagacagaagaagaacctaattgtcctctcctctttaagttcccttctactttcacttcacaccttacttccttattaaaatcctttcaactggtcatacaagggcccaatagccaccatgtattccttgcccactatgtgccatgcagtatactaagtgcttttaaatgccttggcaattaattctccaccagcaccataaagtgtgcacaggagaagaatgaagcgcagggtggttacataacttgcccaaggtcacccagctaacagtggaagaataagaatcatacccagatcttttccccatacttttgtacttttagctgctaagccagggattctccagagatgttttctattttcctaagatgatactttaaaatcaagaacatgatgtggaaaataaaggggttttgacatcagaaaagggattggttttacattggccatgtgtagttcataacactcagttgtatggaattttatgtaaagcttgttaatggttggataacttgtttgtaaaatatttactttttagaaataaattagatttgattcaggattccccccccgcccaccactcccacccaaataacagcactctgcccatttatttgctcatgtgcatggttgaaagggaaagaacatgatggtatagcagccaggccataggaaatcaaagcacccctggctctgccctggaagtctgtcaaaaatatagacagtgctgtatctgctatgtgtgtcttggctgaacaaagactgagaactactgaagataggaaagtccgataacaaggagcatgcgttccagggtcagataaatgaatttgtatcctgaatctactctttactgctgtgtgactttatttagcctctgtgtgggggctgatctttctccttaaaatagacttgctaaagcataaatcagcttctatgtgttagacggaaactatgcctggtaaatgggaggcactcagtgttggtagaacttcataagccttcaagtcttatcaacaatatagctctcaaaaatggtacttgatctatatgggcattgggcctggttaagtgaatgtgctaagtttaataaacattttaagcatatatttaataatttttcttgctttcttaaaatttagagaggttgtttgtggataacttggatgccccatgtctattaaaatgcccaaaggaatgtaaattgctgggtttttattctctttgagaaagtctttttttttttttttttttttgagatggagtctcgctgtgtctcccaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctgggattacaggcgtgagacatcgcgcccggcctgagaaagtcttttataaaatgtaggcactcatttttatgaaagcaaaacaggtgtcttgttgtgggaaaagttagttaacattttcagcatttgctaaagttcctcccatgctcttagaagctgtggttctggctaagttgttgttgttggggatactagcatttctgtgtcttgatgtctgctttgtatccccttttcttgcttctctccccatgactctctgctcattcagttccttggaagctcctgacttaaaccacacataaacccacagtagaggccttcattagacaagactgagtgggtagaactacacatggccaatgtaaaacccatccattttctgatgtcaaaacccctttattttccgcatcgtgttcttgattttaaagtatcatcttaagaaaatagaaaacaagcccaccttccccatcaagtggcctattagttgcaaaatacaagagacagtgttcctttctacctctttccacaagtcctcaggtgagggcctctttgcctgaatgtttctaagataatggctcaagttccttgcgcacaggtcattgtctaaggaggtcagaactaacttgagtctgagaagagatggatgggacaccacagtacatatgtttctcccaccgtgtttcctaccagtcaggataatcatagctcaggagggctgttagggtaccagccacatctgtctgtttgcattctggctccaacccctagttttcctaaagcaaaattcttattagttaggagtcaaggatcaccgagccttttccccataaagagctattttgtttgttgttgttggtttttgttttgttttgttttttgagagagggtcttgctttgttacccaggccggagtgcagtggtgcgaatatggctcactgcagcctctaccgcctaggctcaagttatcctcctgcctcagccacccgtgtacctgggaccacagtctcgtgccaccatgccgagataattttttaatttttttgtagcgatgagttctcactttgttggccaggccgttctcgaactcctggtctcaaacgatccttccaaagtgctgggattacaggtgtgagttagtgtgccctgcccaataaggagctatttcgcaggtgtacatctcttgaaactgtaaataaactagctatcaagtcaggcacatttaatttggatgcctaaacatgtcacttttaaggaaaaaattgttccatagagattatgttacttgtgtgttctgattagcacagaacagtccaactttgaagccctataaaatagtttgattatgtttcatttgaaaactacatgtgttagtaatgggttttctatccctgtatttgaaagatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattggtaaggtacaaatgtactgttgtctacaaagtgttgacggaattgaattgtagcatctctgactttagatggtctttattctattcactgggatggcggtagttagggactccaaaaagcattgtgcccctgagacataacaaggaatatatatggatgtatatatttaacacgtggaatgcctcactggttttaaattttaaatatatttttactttactctttgatgagtcatataaatgacagctctgttttctacatgaatcattcatatatatgtatgtatgtatgtttatgcatctggattttaagtactgtatttccatatttggaatcccatgtaagtatcttgttgttttggctatatgtgatttaaagtaccaatttttccttttcagttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggtgggagaaggactttacctgcctgtggttctgaccgaggggtgaaacaacgggacagcaaaaagcgctgattctgccttacactccattgctccaccctgttccaaggagcactgagctttgtcctacaaaaattactctctggcagtggtggcattagtctagcccacgagacactggcccacatctaggactcacgtgaccctgagagtcctatagccagccttggtgaagcctcttggcatttaccagatgctcggaagaaacttgcgaccgccctccaaattcccacctggcttcagttggctcctaaaggtttgctgtactttagggtgctcagtggaatcacatcgtgtataaccacaaaatgtacctggagttttggattttctgttcatcctgaaattgctcaaagcaactgctttctagagtgtgtgcactgagtcatgcaaattatatgtgcagttgataaggtcatttgcatagcattccaggttaagcgaaaacataaagtatgccactgaaacagttctctgaatttgggtaaagtgctacctgccattgttgtactttggattaatagtgattatatatttttttctcaagagaatccacagatcaagggaaaacaagttgcaaatttagaagttacattatccttatttttatgctgtcattttgctttttacaataggttttgctattttaagactagatctaattcatacaaagtatagcagagaacccgttgttgatgaatgaatttgggctttataagcagccaatctagattatttggtggccaaatactgatttggtttttcctaaattactctaacacatcacttttactcttcacttagtgctgattggatctggcctaagttttttctaccatttaataattaaactattgaaaattcatgttacagacatagcatcctgctctgaagttaaaataccacattagaagtccacttcataaagcagaaaggacctttagtaatgagtcaagagacctttgttccaggtctggctctgtcattaatgtgaaggccttggagatcattttgtgccttttctctgaaaaatgaagatttgggaccagatccttatgtaccccaggtgtggaccaacagcataggcatctcctgcgagcctggcagaatgcagactatggggtcccaccccatacctgctgcttcagaatgtggaatttaacaagtgcaagtgatttgtattcccattaatgtttgagaagcactggaccagacagctccaccccgcctcccaacccagacactctgatttaattagggccattttaaaatgctctccagatgattctaatatgcgtctagagttgaaaaccaccagactggttgacttataaactctcttccagatctgagagcccatgaattatatcttattttccagttaatcagcactttactcactgagaaataggtcaaagggataaatgagtaactttaaagggtcagattccaacatacatgaatgatttgcagaacagaatttcaggttgcatggtctcgcctcccatagtcccactccccgctgcccgtaggattttctagatgagtagggcttattaaaatatcgtattctgtaatttttgaaaaatgaacgggagttgttttatgacactaaatgttgtgtttcaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtaaatagccttgtagggatacaaggtccaggattctgacctatttaattcttcatcccatatgttattttagttcacctaatgatttctggatgaacactagaactcttcaactgaccaaaagtatacaagtatacaagcttatttactttctttttttcttttctttttttttttttttttttgagagacagagtcttgctttgtcacccaggctggagtgcagtggtgtgatctcggctcactgcaaccttcgcctcccaggttcaagcaattctcctgcctcagtttcccaagtagctgggactacaggcatgtgccaccatgcccagctaatttttgtattctttagcagagacagggtttcactatatgttggtctcgaactcctgacctcaggtgatccacccgcctcagcctcccaaagtgctgggattacaggtatgagccaccacacccagcctacaagctaattttcaaatttaaatttttgttgagtgaattctcatccaaggaccttatgactttgcttaattgtttcgatgggaacttaaaattgagttctgcagttaaatgaagaagagctttttaatggcaaatagttttaaatgattgtttaaatggagaacttcaaattactgttgggtttaggtttacagataattcatacgattgacacaaacagtaagattcagatacttttcattcttaacacccacattgttatttcaataggtgttaaaaggatgcatgtgatttttagttcatcctaaggtaatttttaatttttttatgtaggtgggttttacaaatataagtcacatgttaacacccaagggtcgagtgtatgctgagctgactgtttctcaccaatctcctggggagtttcttttaattactggctctggatcagaacttcatgatcttaggtaagtgcacacctagtaagaaaattttgtacacattatatattgactcaatcttacattaagtttttctttttaccagtactcgaaagtacaactttatttcttcttaaacctgattgtttcaaataaactttattttttttaatacaaaaatatttgaagtgagggcccctgcccctcccaaaggtaattcatccataggttacttgttctaataatattaatccatttattaggcatcatcaatgtgccagaaccttttttagatattaccttaatgaattctcttaatattttgcaaggtatatattattcccatgatcagatgaggaaactgaggtttgggataagggaacttactcacacgagctttttgattctgatgcccgcatttggtccacttctgtaagctgtcttcctaaattatctttgtcctttgtgatgctttgtgctttctggcccacagctggatctaagttgctgacctgccaagtccagcctttacatgaatcttcattctattataaagtctttagtctaatattccaaatatttttggaatattattatttaatacatgtcttactctgacagattctcatcttagttgtacagtgatgcaaattatatgctccaatccaagatgtactgggaccatcttaatagcttagctttgtgtaaatccagatgaacattttgtgatagacttagatagctcaaggactgctcaataaattagaaaccagccctatagctgggtcccaataactcatcaagccatagaaattgaaactagagtttctgtcttttccttgtgattctcagagcaattacgtgtcttgtggcaggcacattattaacctttagcaacataagtgtgcctcctgtgtacaggtattagagaaaatttgggtttaaattaattttgcaaggctgaatcattagtttaaatgcaaaagggctgtgtcactatttaaaagaattgtgtggcagagctcattaaattgaaggatccttctgtactgtgaaaaattaccccccaaatttataagtgggtgatttaaagagaatcatcacttaacatctcaggggcttggtttcctcaactttaaaaatcagtgtgatttcatgaaatgacactctggggactttctgataactctagacacaaagcatgtcttcagagagataatttattaccaaagtacattattcaagcaatatttaacaccatgttcatgactaaaacgcagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtaagattggaaaacaacctggactaagtctctgaaatttaaaaggtcaatttaaaatttaaaatttaaaattaaaaggtcatgtcacaagaaatgtgtgagtgtgtatgcatgtgcacactcacactcacttttgtccatgcgactttggaggaagatttttgttctgcccagctcttatgtctagtctgtctattcactcctcatcttgaaagtggttccacagatttctagttgttgctccagtcccatcgctgcctaccatctggaagggcagataaaaaaaaagtgggggctgggtgcagtggctcacacctgtaatcccagcactttgggaggctgaggcgggctgatcacctgaggtcgggagttcgagacaagcctgaccaacatggagaaaccccgtttctactgaaaatacaaaattagctgggcgtggtggcacatgcctgtaatcccagctgctctggaggctgaggcaggagatttgcttgaactcgggaggcggaggttgtatgagccaagatgacaccactgtactccagcctgggcaacaagagtgaaactgcatctcaaaaaaaaaaaaaaaaaagaaaagtggggaagaggattggctgaaatagtcgggccagccaactctatttgtgaacattcaagatggtctcctggagatagaatctcccatagagaccattttgaaggtatcaggtacctctcctagagcattgccaacaatccttctttccttccagactgtaagttcactgagatgtcttcctctagcacctaaccttgcacatggtaggtatttgatacagagatgaatgaatgctcttcagttccccagtggtgctctgggctcccttctaagtttttctagacctccttgtctctcacaggagtactgcatgcccaggcattcattcaattatatgttgctcctattctgtggtatcccataaaaacaccttaccatgagccctccaccttgggaaacaggagaacacagagattaaagaccatagctctttctctgggctgctgctataccttttccctgcccttcttccacccaacgttggcaaattctagaataaaaaatgagcagggctggatgcagtggctcatacctgtaatcccagcactttgggaggccagagtgggaggactgattgattgtcccaggagttcaggaccagcctgggcaacatagtgagaccctgtctcaacaaaaaaacaagacaaaaaaacaaaacaagaacacaaaaataagcaggattttttgggttacatttaatttcttttgatttttgcccacagctctgttggtgaaggaaatgactagggaagaagtgggagggggagaagtcagagactatggctttctcactatgaggataacttgaataattcttagttaactatatttttaagcttgtgatttttgggcaaggggttggtttaaaccttgaactcgttgccctgataaactgtgccatgctaactattcacctaacgtcattgtcccagaaaacagtcaagcctcattagaaagctggggtccagggtggagattaattcctgtattatagtctttctgtgtcatgacaagaggtgtcctgcataccaccatctacatgggagtcaggatcggcacaaatgcatctgtgatatggtgggcttctttgcagtggggtcttgtaactttttgtgagctggtctttttagagactgacaatgtctgtgttgcataagtggaatttctcctgcttatatgtgttctagctaatgcacattagatctagtgatcattgttcttgccctgctgtggcacctgtgggtttatttcaggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagaggtttgaaatgctagcatctttattaacattttatgtttatttatctcatttttatataagggctggtttgaactgcaataacattggttttggctgtaagagaaattacatatcattagataactttatttcattaggggaagaggtttttctccttaatttctcaagtgaaagttcagtggaattctgacatatgtttattctgccttaattcatcctagttggctgacagccctagataactgtcttggactttggggagccggcttgcctcatgggattagagtaacacttttcaaaatctctcctcctctgtcattttgcccgtcttcattttcttcttatcttataccttttggtgaattaacactcctttctgaggggcagggttgatggtccagaatgtggtggtccagccttcctccaccattaataatggttattaagagtttctatttgtatagtgctttaaccatttacatattttcatatgcatgatttcattttccttctcaactctccattacctctattttacgcataataacactgagacttagagaaccacttggtccagattacctagtaagtggccagcctgtggtttaaactctgttctcctactttatttccaatatggcaggctatccctggacccagtcactatttcagattcagtagttgtttctttggaagacactgaggttttagacctgaaaggtaagataagggatagtggtaaaagatgaactcagagcggggactcttgggtttgaatttttcctccaccacgcaccagctatctggcttaaccctccagaacttctgtttacttttctaaaaaatggattttttatgctacagaattatcatagatagtagagagagtctaggaagtgccaagcacataataaagtgcatttgattgaaggggagagtgtgtttcaaagcccaggcagagacccaagggcatttagagtgcgcagaagcaagtgggcaagctctccacgagagatcccctattaggggattctctagctacaactggggactgaggcgaggctaggcgcagggacagaaacggaggacagcgcggtccccacactctccgaggaatgaagcagcaggagcagccctttgggagtcagacatttctccattctcctgccttttattttctcagatttcctctcccggcgacctcctctggagagcttttctccttctcccgtccctccgatttcccagcagtgccagagcgccctctagtgttggcactgcaatcctctgtgcttcatttttatttttttctttgaagaaattctgaaattttgaacagataaatataattttagaatagctcaaattgattaagaaatatgaggcaacgttttacgtcatataaaacaagcgtactttcatttagtttatgcaggtgctgtgttgctttaaaagtttgactgcttgtagggggtttagactagttctctcactgcgaagaaaacaacaaaacgaagaaagaaacaaaaaccattaacttcaggtctattaccaaatattggcgttagccctgacttggtagctattacagtgacttggccacatttgaagagatacagattcaaactccgcttattcctttctcctctcctgaactctatcagccaccttcctactatctgctttccctccaccttaccctgattcttggtgaattgtaagataagtaaattgtttaataacttttcaaaacgtagttatgtaaaattattgcagaaaaacatgtgaaaatcttgtttctagaagaaacatcacgtacattccctcagatgtttattaaaatgggagagctgtggaaacacagtgaattttagtttctatatttgttatattcaaatgaccagttttgctgaaaggctacatcgaattttggattaaaaaattgttttcaaaaccggtctatagtttgcctttctttagaatctgtgttgaaaaatcaaaaagggttctttctcctaaaaacaaatatgaaagtgatgttaccaaaatgacttgcactcatctaagatttaaaatgtgtgtttcctttttagatgaactgtgatacaaatcctttggaagctggactggaatattttgtgaagttaaataaggtatgtttacattccaaagtgtgcttgaagtaaatcttaacattatgatgctattttgtgacagagccattctttaaaatttaaccaagtatggattataggagaaacaaggtgaacataaatactagcattgctcaattgtgtcatattactcttttgtcaacatttgcttagttcaaactattggagtgtgcttacagatttaagatagcagaatccagcatctttaagggctaaatctaaattctaagataaaaattagtaaggataagaagattatctgtcagattctagtagacatttatgttggaagtgcgccatgttgtgtattttgcagtaactcctggtgacttgggaaattgcacattagctgatcaaacatagtgcattcattgatccttctggatactcacagtgtggagcagcctcacttcagcatatctgtccatctgcttatcaagcatctttgtgggtaactgcaacatctgaatataagcaaataacacgtttcaaacgttttcggcataaaatgggtattaactgagaagctaatataagcccaaataatcataaccgataagacactccaaagggaactcctacatcagtggttcttaaaatgtagccttcagactaacagcatcagcctcattgggagcttgtttgaaatgctaattctcaggtcccaccctagaactactaaatcagaatctctgggagtcaggccaacaaatctgttttaacaacccctgcaggggattctgatgcatctaaggtttgagaagcattactctaaataattatagtggaaaagcatatcatgaggccaatttattacagccaagctcatctgtacaagccttacaaatataaatgaggttactccattgagcagtgcctaagagttataataaaacaacttaatagagctggggtgagtggtagtattgaagaataagggcagcagcggctactgtttaggatatttgttagaactccaaaaataaaatgtcctgccctagatggttgtaaactaaagactgatttcccatcctgtggaaatacgtgaatacatgtatatgactcaatcaggccaaggaaacctttttcatgaccctgtgtcagttcccaaattctgagctataatattaaaataaaacatgtgtatttatagtatgagattttaggaaaacgaacctcctaaagggttttaaagggaatatctttctgtacattctccccatggcttttatttttatgatgtaccatctgcctccagaccagagaaagcaggtgcttggaatttgggcagaccctagcagcagattgctccctctgatagcagaagccttactttagctgtttcaaataaggttaaaaatggcccaactcttgaaagtgctaaatttctgttattggtcaccagtaggtagatagataactgattcttttgcttcagtgttcggatattattgtttggggataaggcatagataaataatcccttcgtattgaaatgggattttcaaatatcttttatgattattagcaggggtggattgtgtctttgttagttaagttatacagccaaataaccaaagctcatctcagaacgtagttagttgtttagaagatactaattttgatttctggcatgtttttataatttctgaattgttgtttctcattcaagtgtcacaaagttaattcctaatgattttatagggtaaaggtccttgtagcccaaggacctggcccccaactgagccagtctttttcaattatgtcaattcaagtggctagttggtattaacctactcataatgatgcttgctaatctccaagacaggtgaatagattagatcaactttggtggttttgtagcagtctataatgtgaaacggatgcctggaaaccttattaacattacaaactaagctttgtaacttgaccattcaagtcctgtgcctaaaaaccaaaatgttacccaaactagcttcatacaacattttaaatactgtaagcctataattgcttcggaaaatcgatgctataggagaacagaagcaacagctaatacagagagatatttatatttgataccaaaacaaacacagcaaaaaccctggcattttacaattgtttgaaatcagttatttctttcccttcagagcaaacatttagaattctctggttggcccttaggcatttacactatgatcgtttaagccataatgtgaagaaaaggtagaagctgactgtatcagagctagatgggtccctggggatcagctggtactcccctcccccatctgaagcagaggaaactgaagcacagagagggaaagtgacctgggggaggccactgctttagcttaggtcgaacgccaccctctgacctcatcgtggagctttcccacccaccactttcccccacaaagtccttttccacagtgggcttatcagacttgaaagactgcccaagaatttctctctctggtaacatatattgtttgtatggactaccttttattaatagacacttcccccacatgtttttgctgtaactaattttgtgttttatgataggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggcccttgcttccttccgtcttggagttgttccagcctccttcccctgctgttggcttatgtgaagttgatacacatgtatcattcattcatccgttcatctagtagacatttattaagtaccgctgattagacaccttgctaacccatagatctaaatgttaaagatatactcctgatggctctcagatctcatgaacctggaaacaaataatatttcaggaactaaagctgtagggatacgttcttagccgtaattgtgaagataacccttccgcaagtggagggctctccagccgcatacaacactgccatcttgtgggaagtgctccgtagagccacttcaggaagccttgaccaaagctgcggtaaaaataattgaatctgtacttttaaaatcttcttaactaaaaacgcttcacctgaaacgactcatatcattgttctcaatggtatttttggtatgttccaaaggaagtaacttttgggaggaaaatcagtagcctttgtttagttggagatggaagaaatgcattaatcaagagcaaaaggaaaatcagctgcctttggatggagtcataggcattcctggaattttcatggtggaaatattgaatttttgtccatttctggagaacctccacgaagattcacagagactcaagtattaaacgtaatgtgttgaagcacatcagaagaatttgttttctataatatgtttctccctctttttctcactctctccttctccctctctttccctttttctctctccttcccctctctccccgtgtagagcttctaactagtagaaacagaataaaatgtaatctctattaaacataagttataagacaatgttgattctagaaaatgcagggtctcttttggaagaaatatttaaagcataactgttcgataaccaaaaacaaaacaacccaaaaaagctggtaaagaggcaaagcgcttagtaccaagccttccacaccccaggtgttcagtaaatattagctattattaaaacatcagagtgctaaaaacaaaaaaatccaagtggaatcaaaccattgttcacagacaacaagctagaaagaaattgttaatatagtggtcaaagcatccaattctctttgggaaatttgaggtaaatggtaataagaattgaggaggcagaaaattttcagtgatacttagccctggctggacattagaatcatctggggtatgattcttttaaataatatttcgctgtttaaaatcccaaggcccaggctacacccaagatcaatttaaaaagaagctcttgtagggactcaggcatcagttgtttttaattccccaggtgattctgcagagatggagaattactgtcttcaaccaaagattttcaactggctgaacatattatcctgaagaactaaaaattacctgaactgaaagaactaaaaactactcaagtagttctcaaggtgtggtccacagaccagcagcatcactgtcacctgggacctgctagaaaattcaaattgttgagtaccatcccagacccccaaaatcagaagctgccagggtggagcccaactatctatctatctatcgatctatctgtctatctaactatttttattgagacggagtcttgccctattgcccaggctggagtgcagtggtgcaattttggctcactacaaccttcgcctcccaggttcaagcaattttcttgcctcagcctccccagtagctggtattacaagcacccgccaccatgcccagttgatttttgtatttttagtagagacgaggtttcaccttgttggccaggttggtcttgaactcctgacctcaggtgatccacctgcctcagcctctcaaagtgctaggattacaggcatgagtcaccgcacttggcccaacaatctattctaataagccctccaggtagtttcaatgcagtttatttaagtacatggacctaccccaaatcaattagattttctctaggtgtaaggtccatggttcctttttaaagctccacaggtgattttttttttttaatgcagtgaatattgagaaccactgttttagttcttataacttcataccaacttcagtcttgaaagtacataggaaagtagaaaaacatgtggattggtcagaggatggtgctatagaactgtggtggaaaggatgtaaattaatagatctagagcctattccagctaggctacaggttcgtattctgccccatatctttgttttttcttttagaactgggtagtaagtgaattttttttaagtcaccaaattctaactgcgtggcccaggaaagccatttaacttgattttcatgctgagatttttaatctgtaaaagaaggctacttttgcaagtctaaaatcctatggaatgcctccaacacagtggttgaagacattggtgccatgttatctttatgagccacataattgtgtcatctgaattaagctatccttattctgttacccattttcattgctgagtgataaggggaaggagaggagaaaggaggggaggggaagagaaggaaaggaagaggaaagaagtaaaacctagctgaagtgtagttgaccattcctgaaacacctgtcaggatacattaaactaaagccattgaatcattattttcatatatatccaatttctgttatgaaacagtactttgtttctaccctaagagctgaaatgtgaagtttagctgactgctttcaaatttggatatccatggaaacccaggtctaggaatgaattgaaataatttttaagattgcttttatttttattattattttaagtgtatttgaacatgcaataattgacatatttaaagtaagcaatttgataagttttagtacatgatacagcagtgaaaccatcaccgcagtgaagatagtaaacctatccctcatccccggggtgtccatgcccctttgtgatccctacccgccaccctccccacagcctcacctaccccccaggcaacaatttatgtctgagactataggttattttgcaatttttaaaataaatgcaaaatctataaaaatggaatcatagagtatatactttttttgtgtgttaattctttccctcggcataacttgagagtcatttgtgttgttatgtttattaatagatcattcccagtggcatctcatacctgtaatcccagcactttgggaggtggaggtggaagggttgcctcaacccaggtttgaaaccagactgggcaacatagtgagacttccatctccacaaaaaattagccgggcatggtgacacatgcctgtagtcctagctacttgagaggctgaggaaggaggactgcttgagcctgggaggtcaaggctgcagtgagtcatgtttgtgccactgcactccagccagggcaactgagcaaggctctgcctcaaaaaaataataataattcccttttatagcaggtagtattccattgtatggatatactacaatttgtttgtgtactcactcattgataaatatttgggatgtttccagtttagggctattacaaataaaactccagtagtctcttggtatacctggaggattggttctatgactgcccaagggtaccaaaatttgcttgaagtccggcagtttgtctgtggaaactgcctatagaaaaagttgggttttgcatcctgcaaatactgtctttttgatctgcttggttgaaaaaaatgcacatataagtggatccgtgcagttcaaacctgagttgttcaacagtcagctgacactgtgaacatttgtgtacaagtatttgtatgaacataggctttcttttccctaggtaaatacctaggagtgaaatgactgaataaaatgaaagtgtatggtaactttgtaagaaaccgttttgccaagctgtgtgccattttatatattatagtcctaccagcagtatgtgaagttccagctcctctacatccttgtcaaatacttttcatggtcagtctttttaactttagctattctaagagatatgtagtgatgtctcatgatggttttaatttatttccttaatgtcaaatgatgttggacattttttgatgtgcctccctgccatttctatatctttttttgtgaaatgtctggttaaatctcttacctagggtttgttttttttaattgagtttttaaagtgctttctgtattctttatcagatacatgctttgcaaatttttttcagatgtcttgacttttcatttgtctcatggtgtctttcaaagagccatttttaatttttgaattttaaagttcttatcaattgttcttttatgaatcatgcttttggttcatatctaggaaatctttgcctaatccaaagtcataaagattttctgctatgttttcttctagaagttttattattttactttttacatttaggtctatgatccatttttagttgatcttgtatctggtatgaggtatggactgaagttttatttatttgtacttggataaccaattgctttcagcaccatttgttgaaaagactatatattctgaatttcattgcctttatatcttcgtcagtatgtttatatctttgtccatttgtttgtaggtctatttctggactctgttgtattctgtatatctgtttatctttccaaatgccaatactacagtgtcttgattactgttgctcaaataaggttgtgatagccctgcaactttgttctcttttttaaagctgttttggctattctaggtcctttgaatttcattaattttagaatcagcttgtcaatgtgtaccaaaaaacctgctagactttattggaattgcattttatctacaggtcaattcaagtattacaattcatgaacaagttccatctctccatttattcaggtcatcttttatttctgtcaggaatcttttatagttttcagtatacaggtcttacatatcttttaacatatttatccttaagtatttcatgttttgatactgttgtagatggtatttttaatttcaattttcagttgtttattgccaaattatagaaatacaattggtcttatatgttgatcttatattttggaactttgctcaatctgcttagtggttctagtagcatttttgtagattccatcagattgtcacatggacaatcatgttgtataaaaataaagcttttctttgtcttttctaatttggatatcttttttttctttttcttgccttatattcctttttttttttgatggagtctcactctgtctccaggctggagtgcagtggcgcgatcttggctcactgcaacttctgcctcccgggttcaagcgattctcctgcctcagcctcccaagtagctgggactacagacatgcaccaccacacccagctaattttttttgtatttttttagtagagacggggtttcaccatgttggccaagatgggcttgccttatattcttgcctggaagttctttatcaagttgaagacatttgcttctattcctagtgttaacatttttaaaaaagatcaggaatagatactggatttttagcaaatgattttccacatctactgagataatcattttgtttgttttactttgttatatggtttattacatttattaattttctaacattatgccagcctttcgtttttaggataaaacccacttggtgatgatatgtcaccttttaaaacatcattggattttactggataatttttaaaaattttgcagctgtattctccttacagcacttagagcttgccattattttgtttatttttcctgtttttcttttgaacagaatgtaagcttcctgagtacaggtgctggccatacaacatatgttttgtttattatttttatccccaacacccagctcagggctggcacatagcagatgcccagtaaatattttgttgttgaaagtaatgtcaaaagatgatacttgaaaagtcctgggccctcattatgaagagtctcatgtgccaagctaaggaatttggagtgtatcctggagaacctggggagtgacccaagaattttgagtaaggagtgacactctagtgatgggaaacagattaaaagtgagttcgtctgatgactgggagatcattctcctaattatcaaataaatccagtggagagaaggcgaagacttcaactaaagcagtggccataggatggagaagaaagagcaatgagtgctatttagaaggaagggtggataccacatgagggactgcatgtgaaggggtgagaggaggatgttaatgaactgtggattaactaggaaacacaggtggaggggtgtgggtgggaaattgtcaggacttgggttggaggactctggggtagccaagcagagagtcccagaaggcatctgagcatgtgggtttggagagcttagctctgcaagtatggctttggacccttcagatataggtggtcattgaggcaggtgagtgttgagaatccgttttctatagcactctgcacttgcctctgccctggtactgaccacgccttatattcctgaccacctcctcaactttgaggacagaggccaagaatccttagcctcacccctgtgtctgatcactagtgagggctctgtaaatatttgttgaagggtttgaattgtgactctgacatttactgattctgactagatgtattgcttaatctatgagcatttcagttttctcatctgtaaaatgaagaaaatgttcactccataaatttgtcataagtattagatgagataaagaacatttggtacctcactaagtgttagttcctttccatattattgatttgaatctaaataagtcatttagagtaaaggaactatacatgaaatcctttttctttttttaagatcccagtaaggaagatcttgggtccctattgaggcctcatttcttcatgcttttaaaatttcctttgattattatttactttgcatttaggcttaagtgctatgcttaaaatatcaaatgggcaattgttcttcactctactctagagagatgaaatctattatgaaaactctatattatagttgttggccaaagcagttaaacataaatctgataaagccacaggtccatttcacagttttcctttgaatcatcagattaaaaaaccgaaaaattaagtgttctctttaacatcaaatctagtaagatttaatattaaagacatgtaatgggggctttagttttgaaaatctggtttgatttgaacgctaattagcctgattacttgcctggcttaggaactatattttagttattttcccaggtttctattttatcccccttttttagtgactatggttcctgttctagtaatattaaacatttttgagaaggaattttaactggtcagtaattttggttagaaaaatgctatatgagtgctttcttttaaattgctaagggcagagaatgaaaactacctgtgtgtgggagtgatatgatttggatctgtgtctgcaccaaatctcatgccaaattgtaatccccattgttggaggtggagcctggtgggaggtgattggatcatgggggtggtttctcatgaatgatttagcaacatcccctttggtactgtcctcacaatagtgagtgggttctcatgagatctagttgtttaaaagtatgtagcacctccctcctgtctcttgctcctgctcctgccatgtaagacatgccagctccccctttgccttctgccatgattgtaagttccctgagacctccccagaagccaagcagatgcccacatcttgcttcctgtatagtctacagaactgtgagccaattaaatctattttctttataaattacccagtctcaggcatttctttatagcagtgagagaacaaactaatacataaaaatggtacagaggagtgggatattgctataaagatatctgaaaatgtggaagcagctttggaactgggtaatgggcagaggttagaaggatgtggagggctcagaagaagacaggaagatgagagaaggtttgaaactccctagagatgtgttgaatcgttgtgacctaaatgctgataatgatatggacagagatggccaagctgaggaggtctcagatggaaatgaagaacttattgggaatgggaataaaggtcacttttgttatgcattagcaaataacatggctgcattgtgctcctgccctagggatctatggatcttagaaactgagactgatgatttagagtatctagtggaagaaatttctaagcagcaaagcattcaagatgtggcctggctacttctgacagtcaatgctcatgtgtgtgaacaaagaaatgacctgaagttggaacttatatttaaaggggaagcagagtgtaaaagtttggaaaatgtgcaacctgaccatgtagtagaaaagaaaagcccattttctggggaggaattcaagcaggctggagacatttgcataagtaaaaaggagccaagtgctgataaccaaaacactggggaaaaaggtcttgaaggcatttcagagaccttcacaacaacccctatcatcacagccccagaggcctaagaggaatgaatgttttgtgggccaggcccaaggccccactgccttgcatggcattgggacactgctccctgcatcccagctgctccagctctagctgtgactcaaatgagccctagtaaagcttgggctgctgctacagagggtgcaagccataagccttggcagcttccacatgatattaagcctgtgggtgcacaaagtgcaagagttgaggcttgggagcctccacctaaatttcagaagatgtatggaaatgcctggatgggcaagtagaagcctgctgcaagggtggagccctcatggagaacatctacctaagacagtgtagaggggaaatgtggggttggagcccccacacagagtccccactggggcactgcctagtggagctgtgagaagagagccaccatcatctagaccctagaatggtagacccaccagcagcttgcaccctcagcctgcaaaagctgcaggcattcaacaccagcccatgagagcagttacggtggctgaaccctgcaaagccacagaagcataattgcccaaagcttttgggcacaccagtgtgccctggatgtgagatatggagtcaaaggagattattttggagccttaagatttaatgacttccctgctgggtttttgacttctgtggggcttatagctcctttcttttggctgatgtttcctttttggaatgggaatgtttacccagtgcttgtatccccattgtatcttagaggtaactaacttgtttttgattttacaggctcataggcagaagggactagccttgtctcagatgagactttggactttggacttttgagttaatggtgaaatgagctaagactttggggaactctgggaaggcatgattatagttttcaatataagaaggatgtgagattttggggtcagaggtgtaatcatatggtttgtatctgtttccccaccaaatctcatgttgaattgtaatccccaatgttggaggtggggcctgatgagaggtgattggatcatgggggcagatttctcatgactggtttagcacaatcccccttggtactgtcctcgcaatagtgagtgagttctcatgagatctggtcatataaaagtgagtagtatctttctgcactctatctcttgctccttctctggccatgtgaagtactgctccccctttgccttccaccatgattctaactttgcttgctaaggtctcctcagaagccaagcagatgccagcatcatgcttcctgtacagcctgcagaactatgagccaattaaatctcttttctttatatattacccagtctcaggtatttctttatagcaatgcaagagcagactaatacagggaatattcattttctagccaataataaccaatttagttgctaaactaataatttaacattttgctatcaaggagatgttgaaattgtggttattgttaacttatgtggaatgttaagaagctctgaatagtggaaaaggaaccaagagttgagaagcttgggtttaaggtttggtgctaactcactttgttgctgctggcaagatccataattttgtagggctttagttttctcatatggaaaatgagtttggactaagttttctgcttgctttaagactcctgtgattctaagtctgtaaatatgaaatgaataatgctgtaatttgtctattatgggggttggggatgttaaatgaattcattcccccaaatgaatgaatccagtttatggctttattataagtttcctgaggcataaacagtgtcacaggtgcacagggtactgcacaactgagtgaagaaagttcagattgtcatagactgtaggtgagtgatggccataggctttgcaacgggattcccacccagattgctttaaatgatgatccaaaatccattctaaatgagaagcttttcaggaaaatattgaaggatagtggcacagcctgtcatctggatttccatctccactctgccacttacagtacctgatgatcacagtctctgcagcccttccccgcctataagacacagtagcctgattccacaaccagtgctgtgcctgattcccaaggaagctttactgggacagaggatgttacacggattcccttatgtctctagaactttctatgagggtgtaaaaagtcacaaaagttttataaatttaaaacaaagaataacatgtggaggcagaaatgcaaacaaacagaagctatgatagaggtatggacagtgggggctcaaggaagaatatgactcaattctacctggggtggcagagtggggctggggacagcattccatcatcaccaattgtatagagaagttgcttgagctgagttttgaaagatgagtagattttgactgatacaaaatcaatcaaaaaattgatgacttctttggattttctgatgggtttttgactccatatagatggaaaagaaaaggtccaagactgtattttcataatctctacccagtgtcttatagcccactaccctgactctccatatcagaccctgcctaccgtgctgctgtcaaatttgattttaactacatatctcagagctctccattgccctaagaatcacaaccaaaaatatactgatttactttctttcatttacatgtgcttttaggtaatatggttcctttaatagagctaatgagagatgagtaattatatttcacttaaaaatctacttaatgttttcatataggtagatattatatttagtatgtattacaggtggatgttttaatgactcatattgctatttaaaattaataaattttaaaaacagaagccaagactatttttaggctacagtctcagtgttccagaaatttatacatttttcaaagatattaatagctatttatatagttaatttggcaatgacttattaaagaaatatacttctgttcttgggtcatcctgaaagcacctattttaattacagcattaaccttcagacacattttcctctcatttataattaataattatatagtagagtaaaatctataatcttgggagcaaagccaagtaaaatgaaaatgaaatgccctcattttacttaaatcttcctaagtcaggagccttgttggtttgagacagggggattgtgccaatgggcaggtgcagcctcctgtctgtacttatggcacttattgaagtgttccagctgggtgcggtggctcacacctgtaaacctgtaatcccagcactttgggaggctgaggtaagcagattatctgaggtcaggagttcaagaccagcctggccaacatggcaaaaccccatctctatccaaaatacagaaattagcaaggcctggtggtgtgtgcctggtcccagctagtcaggaggctgaggcaagagagttgcttgaacccaggaggtggaggttgcagtgagccaagattgtgaccactgcactccagcctgggtgacagagagagattctgtctcaaaaaaaaaaaagaaaagaaaagaaaagaaaagaagaaagaaagtaagtgtttcttactttcaataagatttttgctgttgtttttgttagaatatgttttatttcatgtctgaggatgaaattactgaaaagacctaattcctaatttagggatatacaaatacagatatcaaattgcattaatattaacattctgaatgttttcagatacttttacatagtacacaaatattattttatagtaaattcattcaaaataggttccggccacctaaaagaaatttaaaagaaacattctttatttagagtatttaaagcactttatttagagtgctttctaatgatagactccaggcacaggcatttaaaaaaatatggataaaatctaaaggtgcaggtttatctcgtcatgtaactgagcctcagtttagtctttcataaactggggattaaaatatccatcttaaagtgttgtcatgaggattaaatgagctcttgaatgtgaagccatcattttagtatgtgacacagcaagggcataagaaattgtaaatgttactgattaatattttattattttttaaactgaatttactactctatttttttttctagagaaagtttttgcccactctccccccacctttcctgtttccctcatggttagctaatacctgatgttccttcttagcctttggtaaaattgtgaatttgacaaaggtagagttagtctccttttccagcacatctcaaccctcgcctagctctgccccaatagctctcatccagcacccccagctggtcatggccagcttccaccacatcgcctccagaggtgtagcagatattgatttaagtggctccattagggctgttcagagtaggcgaaatgaacagggctaggcctcctgagatcttggttcttaaccagtttgttgattgcctgtctttgactgagttaatgcactgctcttggactccaaatccagtatctgtggggtgtttttgtgtagatcagattataatgtaagtacagacacttttgggaaaggctgtacagacagtagttttatgaaacctactcgtctttcaaaactcaactcaaagaatgccccgatccccgctctcccatcccaggcggaactgggtcattttcttccttgggcccccactgtccatacctctatcaaagcttctatttgtttgcatttctgcctccacatattagatattctttgttttagatttacaaaacttttgtgatttttacaccctagaacacaaggaaccaaccatgagtcatatttcaaaatttgtattgctaattgatatgctactgtgtgtcatgttctgctatgtttccaataatctcaaattgttctttttttctgttaaaacattgaggaaaaacattttcctgttaaaacattgttttctgttaaaacattgaggagatgtagtaatttcaggactgggcccaagatcatgttctctgaagctctgaatacccgctgcctaacacagtatctgatattcagcaggggcttaacaatagttgaataaataattgaaagaaaattatttaataggggactcaggaagattaagaaccttcaagctgtaaatgaatctctaatggtaaagattcagattccatgatggtaggtgaggaaataatttcagatctgctggcattccataaatcacaccgtgtaagtcaatttggtcactgactattgtttaagtgcttctctgcacaataaagcataaaattttttcagtatagttattgattccaacatagacaagaactctgaaaagcaccccttgtcatcattattctatgattgcaagtctcctttttaaaagatagcaaaaaaaaaatgttgctgttatagaattctttcttagatatagtcatccctctgtgtatgtgggggattggttccagaacccccacatataccaaaatctgagtttactcaagaaccaccaacccatatatacaaaaagtcagcccctccatatacatgggtttcaaatcccacgaatactgtattttctatttgtgtttagttgaaaaaaatccacatgtaagtggacctccacagcttaaagtggtattgttcaagggtcaactctgcctgttttaactatagtgaactttggtttgttatgacttgttatcatgaatttatcctatatatgaattcaaatgaatcaagctcttcctgtgactccccacccccatttgtcctatattaaataacacgggttccaatcttctttaaattttcatgatctggcttcataataaagctttatagttggttcttaccatttgtatcaccctggggaaggagaaagaattggatgttcattttgcacattattttaacctcggctaatggaaactttctctaacttcctgtgtaggtcagcaatttaaagttggattatccatagaaatcatatttcattgtaggttcatcctagaggttctaaactaggaaaggaatggactgggggggttctcaggtgagggtgtgtgaggacccctgctgctgctttcttctggaggttaaggggatttattacactcagtcctaaatgtttcaagtgcagaaagaactgtgtaagtcctaaatgttagcggtggaggacatcttaggcatgaaatactctttcttattgccaataaagaaattaaagcttttggttgtttcctttctttgcgttcagagagtagtctgtctgtgggaactgtttggagaatcttgttttccacattgtgatctctgattaaatcttattcaccatagatacgatttatatatcacaaatttcctttccttcacataagagatgcttgtctaggcagagtatgcagaagtctcatactaacctcccacggatgtcagccctccctccagggcgctcactctcagtgctctctcttcacctctgactagtttatcacacttatcatgtgtctcctggcatttggttgagtagaattctatctcccttattagctaagtgtctctgctgaggagtcattgctcacttgtgtgtcctactcacaggtaaggtgtattaaggtgtattaccagtaagtgcgaagtcttccagtttgcctgattcctactttttttttttttttgtaacacataagaatgaattcaaggttatccctataacaatgtcgctgtcattcccttgcattgattgcattgggaatggccctgagtgtgcccatgggagtgtattaggaataggaatgtcatctgtcatgtgttgcacggaagaagtaaaaaaaaaaaaaaaggttgaaaagcacagtattagagaataaactctttgataaaaatgtctgtgtctaactcattttgttacccacacagggcctagcattatgcctcacacatagtaggggctcaataaatggtttcagaatgaactaatgaatgcaatccaataggtaaatacattccagagacattattctgaagaagcaaaagaaaaaaaatactgcattttgggtttgttttagcaccatgtttcaaaaaagtgaattttcttcaggtaaaagactttctataggtagaaattgagttgcacattgcttaccgacagcccgtaccactgtccagacccattagacacaagggtcactttcataatccaccattgcaacatgccttatgtttttctgcctaggtttctgcctggttctggtaaattgtcatcacaagttattacccttaagtctaacatattctgaaggaataggtggctgatactctcatttgaggactaagaaatatttgtctagacatatgatccgatctgtatttttatttaatgtgtaattggtgagaaaataggaaagacaaatttaaatgcttgcatctctaaccttgtcacagtgtctgagcattcattcatcatcattatcttggattcctgcagccagcagacttcataggaaagcaagcactgaaacagattaaagccaaggggctgaaacgaagactggtctgcctcaccttggcaacggatgatgttgatccagagggaaatgaaagcatctggtacaatggcaaggtgagtgctgaggacctcactgccaggggctgtggcatcttctgcaacagaaactccccttgttcctatttcctcttaaacccttttgctattaattatttgttggagggatgacacgcttttgatttctgagctgacattcaaaagacagaacgcaattgactgaaaggaaaatgcaatgttgctcatttttgaaaacataaaattctatatattctgtttaaagaaaacaaacccaaagacttgaaacacactggacaatgagaaggatatgatttagagggtaaatgatctatttgctcaccacatccatgtctgtaaatgcaaaagatggattttataaaaaatttggcattctgatttaactttttatggatctttcagaaggaggcaattagcatattaacagagaaaaaatccagatgaaaacatttatgacaatagagggtaaaaccttagaaaataaagtgaaaagtggaaaccatttggttcttcaggaagagtaaaatcaccttctcattttggaatgttactttttattctttctatttgtgttcagtaaaaccagagttagtcagataatgtatcaatgggactttattttctccattttttctcccaagctttctgcattcagttactttctccatttttttattactatttgtaaaacccaattttgttgaaactgagtgtgggtgtgtttttcctggtgttagcaggcatatgtgggacacccagcttagaccatggggagggaatggagccttcaaagctcatctaagcagctgttccacaatgaacagggtcagcttggtcattacccaagactcagagcttctgtgcctgggtttttttcgtattcactgcagcctacttgatatttgtttccattttctctatctcatcagtaacacaaagagtgctagaagtggagaaagccagtggtgtcaaatcacagcctttggggctaaagcatgggtcaatttgacaaagaactaacatctactgagttcttactgtataccagatatttttcatgtgctctcccatttaactttgcagcacacctgtcagatatatatgatcatttccattttaaagatgaggctttgaggggctcagaagtaacttgcttgaggttacgtggccagtgattgatagaactgatctccaacccaggtctagtttccaactttgaatttctggtcctttcttctaagacatgttgaacacttcaatttgatctcttttctgtctctgttgatgtccccctgtagtttcttaagaatttattttatttttatttatttatttatttattttgagacagagccttactctgttgcccaagctggagtgcagtggcgtgatctcagctcactgcaacctccgcttcccgggttcaagtgattctcctgcctcagcctccccagtagctgggtttacaggtgcgtgccaccatgcttggctaatttttgtatttttagtagagatggggtttctccacgttgcccaggctggtgttgatcaccagccaggtgatacacccaccttggcctcccgaagtgctgggattacaggaataagccactgcccctggccttaagaatttaattctatgcccacattcttgtgcatctgagtatcaggtggatgttattagagcctgtgaagccaactgacttttctcagatctcaagtgccttcgcctgtctgtaagcctggatgggctgacctccacttccttcttaaattgggctgagtttgctcttctgtttgaactgttgctacctttctccctatctcttctttctctttctgttctgtatctctggttcagccctcttttctcaatatgtattcttcctccaattcatatttgcccacaattcacatgatttatacttataaccagctctgccattaattaactatttgacctgatcctgagctgatctctgggcctcagctttctcatctgtaaaatgaagccattggatgagataacgtcttcttgtcactacatttcctcccacctcatcttccctttgttttatatttttcactctattcccattcagttttctcagtacttcttaatacagtctacacttacccttccaccaaccttctgttttactcagcatggaatgaaagagatattatgctatattattctgtattcccacgtcatccacaatcaactgatttttagccaccttaaatatgatgataacaaaattagttttaaaaccctgaaaacccaaggtctaatctaaaggttttttcctttgccctatgcatatactgcatttacatgctatattccttgccatctgcttataaagctgctaatccaattataggattctatctcttagatttcctaatatgagtttgcctgctctttgatgcttagtaaggtcatcattttacatacagatagtcttctttttgatcctttttcagaggccctccttggatcctctttactctggactgatatgaaataatttttgctttttcttttcagactttgtcttgacttgtgttgcttttggtatttagtattttattcttgcaagcatttccaatgctggagatagggtacaaatgtatttgtttattgacttttttgtgtgtgtgtgtgtctaccatatgccagcgatattctaggcactgggaatacagcagtgaacaaaacacaagaatctctgacctcatggagtttacattccagaggagggagagacagacaatggacaaaataaataaagtatattgcatgtcagatggtctttagtgccttggggaaaggtcaagtccaacagggagctgggcagtgctggagaaagggattataaccttaaatgaggtttaatttttttgaaatcaaggcataaagatggtcatgagaaaggctttctttatattcggtggctcagttattaaaagatgcttagcttggaaggaagttttgaaaaagaggtttgtggagaggtttggagagcttagaaggttttttaaaattattatttgtaaactaaaacacacggggacagtcaaagaaaaacacaatagaacatcaaacttaaattatgttaacttccttcaaaggccatttgccatgttatcttctggaagtcagatagagacttctcataatttgcgagagaaatgagaaaaggctaaaaataaatgagaattattcacattggtaaaaagaaggtcaatgtttgttttaacaaagaatgagaatttgccaggcagagggtggggacagattgttctcacagttcactgaactaaaaggcagaatggatctaattgaacctggaagattttaggtagaactatttaaaatttatgcaagggaaaacatttccctggagatttagtaataaggtaaaaggaaaagccagatttctgaaatatcctgggcttctaaacctggattagagagaaattcaagtagaaatgaaagtaaattctagcagaaagcaaggcaaattttaaaaatagcactcataaataaggactctatttttttaggttactaatgcagaatgactgcaagacaaatcactgctgggatgttaggagatgagaagggctgaggattgtgtgcttttgacccagtgagtcaggggatcacaccctgagactggcctaggtctcttcctgttttctgaagatgctcaagcaaaccagcttaactcttccagggctccaaacccaaatctctttcttacagatggggaaatgaaaacaaggttatcaagaaagtctttcaaaaagcaatgattaagccaggcatgctagctcatacctgtaatcccagcactttgggaggccaaggcgggctgatcacttgagttcaggagttcgagaccagcctggccaacatggtgaaaccccgtctctactaaaaatacaaaaattggccaggcatggtggtgtacacctgtagtcccagctactcaggaggctgaggcaagagaatagcttgaacctggaaggcagatgttgcagagagccaagattgcgcctctgcactccagctggggcaacagagcaagactccatctcaaaaaacaagcaaacaaaagcaatgattaggtgcagccgcaggagctgcttccagggctacatggctgagggggacgcagggagtaaccaaaggcaggatgaggaaattgaagcaatggtagccattgatggcgaggaatggtgtgtcattgatgactgtgccaaaatattttgtattagaattagctacgatatagatgaccccaaatggacactttgcttgcaagtgatgctgccaaatgaggacccaggtacagctccacctgtctatcagttgaatgctcattggcttaaagggcaagaacttgtccatttattgaatagcctgaggaaatatatatgtggccaccccatctggttcggtgagagtacctgctttgtgtccctgggatccaggctaagtttcttttcctcccaaaatatttaatgagaaaatgacagaatattggtgaaagtattctttacctgtgagtggagaaaataagagatgttccaatacaaaaacctcagatgacagaaccaggcccagaggcaaagaaagaaactgaagaggaagatgttgaatgtgaagatgatctcatttttgcatgtcagccagaaagttcggtgacagcactggattttgatatcagtgaaaatcaaagagaaatagaattatctctgattgatcatggcatttctgttacagaccgaataagtacttttcaggcagactttgatccagtagtttgtcccaaacaggtgaaaatggttctttccaacttgtatgagaataagaaaatagctagtaccacccacagcatctatgcctacagagtatattgtgagaataaacagaccttcttacaggattgtgaggatgatggggaaagagcagctggtgggcatcttcttcatctcatggagattttaaatgtgaggaatatcatggtggtggtatcacgctggtatggagggattctgtaggaccagatcactttaaacataactgtgccagaaacatactagtggagaagaacaacacacattcacctgaaaatcatctaaggctttggaaaaaaaacaaaaaatgttcatcactgagtaatggagtaagtgaaaatccaggagtatccacttgcagttatgggctgaggtgacaattcttccaacatatttgttagcgtaaatattatgcctccatttctgttgcaaattggtgattgtgaaatttccaaaagtgattttctagtctctgcttctttaattcttataatataaagcaataaatatggagtgtcagtagtcttactccacaccagaaaaaaaaaaaaaaagcaatgattaaaattctaacctctctgaccctaatccctgcctgtatcactgaactatgatctaaaggagaaaagcaattttaaagcatgtgttataccttggcagttattaatcagccagagataaacttttactaatgaatgtattcacattttatttttcacagtcaaaaagttttcttttttcacggtcaaccagttttcacagtaagtttagaaatcatatggagaacagccgggcgtggtggctcatgcctgtaatcccagcactttgggaggccaaggcaggctgatcacgaggtcaggagttcgagaccatcctggctaacacggtgaaaccccgcctctactaaaaaaatacaaaaaaattagccgggcgtggtggtgggtgcctgtagtcccagccactcgggaggctggggcaggagaatggcatgaacctgggaggcggagcttgcagtgagctgagatggagccactgcactccagcctgggtgacacagagagactctgtctcaaacaaaagaaaaaaaagagagagagaaatcatatggagagcttctgatttggggtttcaaagagagaattaaaaactgggactacagagataggagtctgcaattaaagtcatgaatgtgttagcatctaaaatactagaagtgctatagtaagattgttgtttgtaatgtgctctttgctgaggcagctgaatgatcaccaggctgatttccatccatgaatgtcttgagctccagctgtaagcagtccactgtgccagacggtaggactttaaggattagtgcaatgttgtgtggccaggagaagccattttgagcagggctatatatcgtgttttacttttgttgtcttccttttatttttgttccatgtaatgttttgatgtaatgtaatgtttctgtattttctgcttttccttctttttcattctttcctttagacctgatttccagtaacctttttatcttttaatcaagcttgttatatagacttttttttcgagacagtctcactctgtcatccaggctggagtgcagtggccagatctcagctcactgcaacctccacctcccgggttcaagcaattctcatgcttcagccttctgattagctgagagtataggcgcccgccatcatgcccagctaatttttgtatttttagtagagacggggtttcaccattttggccaggctgttcttgaactcctgacctcaaatgatccgcctgcctcagcctccccaagtgctgggattacaggcacgagccaccactcctggcctaaaccaagtattactattttaaaaatgagaaatttcagagtaatacagatgtgtaccttgataattacttttcataatttgtaaactttcattcatcttctcaaaatgtgaagttttcctcctgtgtctctggcgttgtccccccagacagcacttcataaaacttccattttgtaagttgaatctgtattttagttttttttcacccagagatgaggagcacagagctgtgaccaagatgctgaggactgttgggtcttgttttccaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcagtaaaacatttaggtgtttgctaatatacacaatcattactataacctaattaagggacattttataattttagtaacaaatgcattcggttcttgacagctgaaaacaaattaataaattatcttttacataaaaacatgtacaatattgtttatggatttacttctttgagaaatctttccttagatgaataaatgaaagttttaatttttcatgatatatctgtgatgaaaatagtaaaacttaacattgacatatagccaacattttaattcaattctgtgaaatatttatcattttcttaatgacttccctgaaaggagctttataggacattattattgtcctttcaaaggttgttttagaagagaaattgcaagaaagaacagagtcttccaaaggaagaggtacttgtaaactttcagaaatgaagctgacacataaatagattgtgccagtataaacacagtttgaatactgaacacctctctttgggaaagaattaatgcaagttgacatcacatggtgctgttctgaatatcatttcacaaagcatttgacaaagcaggtcaaacaaaagcttaagagctgacaggttttccttagcgctacgtacagcaagaaaaaaatcaatttagaaataattctttgatatactttttgaaattatttgggtgtagttgatggaataaataaattttttttgtaaagggtggtttctcatttataattaatttatacatacatacatttgttacacatttatagaagttttcttaagtattcaaaaaacagaatgtgaagcatgataagattctgtcatttgaataaactttaaaatgatttcttaatgtgtaagttttgaaaaggtgccaattttacattttaaatgttttataacagtagttacatattagaactcttcacatgttcatttctctttggcatatcctcttagatgagaaaagaaggaaatccctttggtaacaaactaatttcctaattattgggaatattatctaggttctttaatccagttcatgttagtgctgggaatttgggatatccgcttttttgactgggaattgggatatctgcttctcattctctgcctttctataaccccatgactttaggatagttacataccatctctgggttcctcctctgtgaaataggtctagactcttttttggatactatattatcaagaagcaataatgaaagtataacattaaattcatatcatatagttaatatagcgctaaaactaatgaataaaagaatagactattcagatgaatgttaaagttttaaagaaatcctacccacaatataaaagacgtctactctgatttccttaagaagttgccctcattctctcttttgttgtatgttaggtgctattaggttttgtaggttaccccagcacccccactcatacccagccagtcatcctggcctcagcaccggggttggcatcagccaattcatgggctgacaatgaccttcaacacaacttggccatggagaattgagatgagttaaccagatttcttccatgggaatttggattgtgaactatcagaggaaaaactggttagtactaaaagctgaagctgaaaagatggatagaaatagaagccataaagccaagggggcaatgagagctcccaataaggagggagacattgagagagaatgaaagaccagttcccaaagctctcagctcctgatggttt

SEQ ID NO: 16091 - DNA, 21048 bp, Human
gaaagagtctctcaagctcccacaaagaaatttcccgagcttgtgaggaattcagtcacaggaagatcaaggaattaagtgtactgcaaaaaacccttcatgcttctggctaagataaatctaacagtgtactggatgtcttcaagaatacctcatttactcaaaaaatacaatattcccattttctttatttgcattttaatgtgatttttgcttcatctcctttcttcactcaagccacctgggccgtacccagggaattcctaaggggcaaaaggagggatgtgaaaacctctgcagccccttcggaagtttcttgtgaatatatgcacagataaacagatgtgcattttaaaaataaaaatgcttttagatctaatgctaggagattcaaaccaacaattaatttctctgttaaaatgggttaaaatagatgtaaaatattaatatgtatataagcattctgaattagacttatgtgaatttttctccttttctttctttctttttgagaataagccctttcatttacgtagaaatgcttcagcgtttagataattgctacttatcttgttagctacaaacacaaccataattaaaggctctgtaagaattatgaattctggggaaattggccacttgtctctgtggcgtaaacagtatctaatttataacaaatcatctgccttagtcccagcaggataaggtgatatgtattgctcagcacatgagaaagatggcaattaggaattgttaccaagttacgggagcctcacacgaacatccatcacctttggggatatgtacaagatacaaacttaatttgatggattccttttgtattgggatcaaagtctcaaaagggaaagtgacaatttcagggaaaatctggtgcaatgagaccaacactgatgagagaaatgcacacaatttaatacacctgctcacctgatgtggcaactcagcctgtgcttgctgtgggttgccacaggatgagacatggtctgtgcatattcccagcagccacccatctcatcactattcttgccagcccagatttacagttgttcaatagatggatttggtaatatctgcatgacaacaacaggcagagaaggttagatggcaattgattcttgattggtgtaagtttatagaacacattctggcagggcccaaaggaaatcactcacctacccctctgtgatggtaaaacgttgaaaattccacggacttggaccttgtgatccttcagtggaagatgggcagattccttgctttaattgacagacactttctaaataactaatgcaatcttatattacattatagtccataagggagacatacttaaactactacttacaacaactgtttttagagcctttcaaatggtttgtacaaagtagctcccatttaagatattttcctagtatttaaggctatctagtagacattacaaaacaatacgctgtaaatacattcagatttttatcagtaatacttaacatgccgtaatttgaactttctgctaaatcatgctatccattcctagttggccccaatggtgagagtttactgtttctttaaataattttgtttccctttgctgtctagaggtgtttatcattctgcttacttgcctgtgtctctggaatattcagaaggttccatgggaaacaatttgaatatgcaaagaagttatttttaaagcaaggaaaatgttttcatatggatttattttgagcacttctgcctttgcctccactgggaacatgtttctctccaacgccgaagccccctccctgtgtggtgtttgacgcagaggctgacagggcagggaagtggggttcaagataggaaggccattggcagtgtgaccccagcccacagtcctagatcccaggtcgtgacaccactcttttgacagcccagattgttacctaacaagaatgactcccaagctcaaccattccaatgccatctcctctggttccagataagattgaagatgagctggagatgaccatggtttgccatcggcccgagggactggagcagctcgaggcccagaccaacttcaccaagagggagctgcaggtcctttatcgaggcttcaaaaatgtaagacccgtgcacgctctgaaggcctggggggggttcccacgtgaggctacactctccccaatgccaagggagctcataaggcgtttcccatatgtgaggctgtacaaggaaggccagctctataaagggggcatgagagggagatcacctggctagaaaggaaggctccaggcgaggatggagcaacctcaggagacagtaaacggccaactgcccagaaatttcacagggtggcacatcctcaaggaattcaccctggcccagggtcaagccttagcccttaacataatcataccttccaacctggtggtgcccccacaataatgggatttggccctgctgacttatgctaaccaggctcaccgagactgatgtgtaagccgaatgtcggtgtattaatttaccttgggaaatggaactgacagtggaaacagacactcctctcccttcgctgggacccgctctccttggaagccacatggaagccaggttacaatcaaaagtggagtcagaggacgggagttccttgtttagttgttactttaaatacattaatgtgttcctgcagtctcaggccagtttgagagctctcagatacaatcctggatattaatttattttttaagtttaactctcagagtgcaatcttattcccaaatcctggagtggtgtggagtggggtgggctacagcgacatgcacctggtcaccctccctccaggtgcagtctgtaggtagagctgagctgggtcagttccaaactgaccacagcctcaatgttctccaaactgctgacccacagggattccagcccctcctgggagttatctgacaggtgctgggatgcctcttccttccacactagccttgactgcacatgccaagtgcccagtttcctaccattagggcttctttccttcgatggcagcattagcagtgggcagccgagttggagaaggatcctgtgggaaagttttccaggcaggcactgggctcagagggaacagcatccagaaaagagaagaaatctacactgcttggcatctaccatggactcaataccacctaacataggttcataagatacccttggggaagttattgttacccccattttacaggtaaggatattgaggatcagagactggcttggccaaagtcacaaagcttagtattggctgagccaggatttaaacccaggtttttctgatcttaaagccccaaatctctccacctcacagtgcccattctctgacaatgtctcatcattttgcaaagcagctccagtcctgagatggcactacttgggagaagtggaaatgcacaggtccctgtccctggggatcatgaggaaccccagacaccaaggctgggcccagtcttctcctagtgctggccctcaaatgcctcccgctgactctctccccttcccacaggagtgccccagtggtgtggtcaacgaagacacattcaagcagatctatgctcagtttttccctcatggaggtgagtctgaccttgaaatctatcttgcccagctccctctctggtaagcagccttcccttcctccaagtcctctcttccttgccatttgcttccttctcgaggaagagacaaactcagggcaggacacctccctcatcgtgagaggtgggagtctccaaagctttagcaggaaagaactctgaaaatgaacccaccctggaaggggaagaagggctgataatgcaacatcacaacgtctcagaacagctctagaaagcaggtattataatcccagatggagtaactgagtttcggggaagataagcagtgtactcaagattgcacagctggtgagtagcaaaccaggattagattccataagggtctgaaacaggttttgccatgctggcaccaccattgtgcagggcacttttgaatcttttccttaaaatagctgagacaagctggaattttgtaaaagaacttcagtaaataccgaagactataaaaataaactaattgaaaaagaggcaggaaacataaagttgtgcttattaagccagtttacaagtgtgccaggcccacaacagctgctctgttgccctgcccgactcctgtgggaaccagctgtgtccccatgggcctgggaccacatcggtgactcctcctgtggcctccatgtgtcacatgccactttgcatcctgtcaccaagagctgtctcctgcaagacatcttccctggatcctgacaaaatgcaaatccaagtattccaaacacttcttgggccctgtttctcatgggcctttttggcagcagacagatgccttccttggtgtgtggggcccctacccagatcaggtgggggaggcagttttgtcccatgcaggccccagaattgcagtttgctgagttccactgagccactgtttattgagttctcactgtatgccaggcacagctgtagtttaaaatactttttaaaaaatttcaagagataggtcttgctacatcccattgtagagaggtaggaaagggaagctcagagaggtcgtgcttgatgcccacagtcacatagcttatgtagtacagcggcatccaagttcaggtctctctactctggagtgagtgctcatcccaggcattcatggccgttcagaagaacattgtcatgcagtcactgtgccattcatacaccaacgactccatgcatagacaggcaggagaatggttttctcatgatggctagagggaggggcaagggctcatctcactttttgctagatctaacttcacacccaaacccaaagagttgagtcaatgggccccactccataattttctcctttccatcaccctagcatcactctcctctctttcttgtcgaagccctgccttgtttggaaggttctccctgtgtggaattcctgcccccatcacctgccctccttttctgccttgtagatgccagcacgtatgcccattacctcttcaatgccttcgacaccactcagacaggctccgtgaagttcgaggtacgctcatctggggtccactctaggggtcctctggttctgcatcacctccccctctaaatctcaaggcattgggggaaggtctggaccatcaaaagctctcagtcagaccaaagacatgtttatccatttgtaagcatttcctaaagatggggaaaagcagcagcaactttccctggcctgcaggaactcagggactcaggggactaataacaacagtgtatgagcttccgggcacactgcttcccagtggcagcccctgtacttagggctttgtatgtattaattcatttactccaattcccacaataaccctatagggtagggttttattattgattacctttttacagaagaggagagtaaggcaaagagagatagagtagttttcccaaggtcaaagagcacataaatgataaaggatggatttgaatgtaggcagaatgaccctcaatacagactgttcctacagtccacgtcctcagccactagaccatacggccactgggatgatagacagaccactgcagccatggataaggcaaaaacagggctggctgtgttgatctgtgtctctcagagctccattcttcctcaagggggcaccttgcaaaaaaaaacaaaaaaatggggcagggtagggaactgaaggcaggagctcttcacagagcatagccacatcctccaggcagacaagaggacgcaggaggcaccattctgtgagagtatcacagtctgacccaaagacacagcttcacactgtctgatggcttgatggttaatgtcactctgccttttccccttctcaggactttgtaaccgctctgtcgattttattgagaggaactgtccacgagaaactaaggtggacatttaatttgtatgacatcaacaaggacggatacataaacaaagaggtaagtgagctggggccaggggtgtgagagggctccagtgaaggtaactaacccaacagaaaacagccccaggcatgaggatagcactgtctgaatgaggcaggctctgctttggggctaacagagctggtccctggcaaaataaagaaggcctccctcattgccctaccctgccctgttcccaagcgcccagaaaggattaaacagattcattctcactgggtcacctagattcagtagatattacacagtggataaaaatgacttgtttcagtgtgaagagttactcttccctagggaacctgcatttgggaaggttaggagccacaagtcaaagctaaaagttgaaatggtggaattgtaggcagcacctagaatagaaaagaaagatttttaaggaagaggaacctacaattgggtcatattggccttaaactattttgcctattaatacaaccgccaagggggtaatggaaggtacagctgtctttacagaaattatcacaaataatttctgaatcttcactgctttgcacttttagaacctcagaggacatgtctctagccagtgaaataccctcaggtctatctcaaaactcactttggtatccactgtatcctggtatctcagtggaagctggaaattggcatcctgtaacactccacttgctgagctcctgtgtgccaggcacggtgcctggaggtatagatatcagcaccaatcttcacctcaacccggcaagcttctctctgtaagctcagagagtttatccaactttcattcctcattcatttagtcatgtttttaattaacacagatttgaaggcttattaggtgttctaggtgctggaggtaaagaggtgaacaatcagactaggccccacactggagcagcatagagagatggacaataaacaggccaaaaaggaatcagcaggtagaagatattttggcagggaaggttagcaaaggcctctccaaggaggtgtcgtcatactggaaccagttatacaaaaagccaggaaaagtgttccaggcagaaggaacagccactagagaggctttgaggcaagatagagcttcatgtgtttcaaaaacagaaaggcttcagatggctgcagatgaaggtatgaagctgaagactagtgcaggatgagcctgacaggtcagcagagtcagatggtggagggctagggtaaggggcccatccatattcccctgggaagctcttagatgaacatgttttttgaaagacacaaaaggcaaaaacagacttaaaaagaatcagaaaatctgactagctctgtattatttagagaaattatattcacagttaaaaaccattcccaaataaaattataggcccagatggtggactggtgaattctaatatcaatcctacaaaaaaattttagaaaatagaggaggatggaacatttcccagcttgttttataagtccaatagtaccctgatacccaaaccaaagaaaaaaaggtcttatgaaaggaaacaactacaaaacagtctccctcgtgagcacagataaaaaagctttcactaaatattagcaaattgaattcagcaatatataaaaaggatgatacaatacaactatgtgagttttattctaggaaggcaaggttggtttaacattcaaaaaccaatcaatataattcactatatttaaagaaaccaaagggatatagactggaaaggaagaattaacactgtctttatttgtacatggtataattgtattaatagaaaaccctaagagtctacaaataaactgctaaaaataataagtgaatttaacaaagtgaagacatgagttctatttacaaaaatcatttataattctacatccaacaagcaaccagaaaattaaattaagaaaaatagcatcaaaaagcacaaaatactttgagaaaaattcaacaaaacaggtgcaagactcatacactgaaaactataaaatattgctgaaataaagtaaagaactaaataaacacagagataaatcatgctcatgggttggaaggcccaatatagttaagatgtggattctccaaatttgatttatagatttagtgtgatctcaatcaaaatcccagcaggtattttgtagcagttgatatgggaatgcaaaaaacctaaaataaccaaaacatctgaaaaagaacaaagttgaaggactaaacctaccttacttcaagacttaatgaaaatgtgcagtagtcaagatggtagggaattggcataaggatagacatatagatcaatggatcaaaatagagagtcaaaaaaactaaaagtagagctaccatatgatccaacaatcccactgctgggtatataccccatataaaggaaaccagtatatcaaagagatatctgcactcccatgttttttgcagatctgttcataatagccaagatttggaagcaacctaagtgtccatcaacagatgaatggataaagaaaatctggtacttatacacaatggagtacttctgccataaaatagaatgagatttaatcatctacaacgtggatggaattggaggtcattacattaagtgaaatgaaccaggcacagaaagacaaacatcccatgttctctcttatttgttggatctaaaaatcaaaacaatatgaagatagagggcagaaggacggttaccagaggctgggaaggatagtaggggggctgtgggggaagttaggatagtcaatgggtacaaaaaaaatagaatgaatgaataaggcctggtatttggtagcacaacaaggtgactgtagtcaataatttaattgaacattttaactaaaagagtgtaattggtttgtttgtaacacaaaggataaatgcttgaagggatggatacccatttttcatgatgtggttattacacattgtatgcctgtatcaaaacttgtcatgtaccccataaatatatacacctactatgtgcccacaaaaattaaaaataaaaaataaatattttttaaaaatagagatagacccacccatatgtcaatgcaacagatgccaaaaagatcaaaggggaaagaaccgtgttttcacagctgtatatccatttggaaacaaaaatggacattaaccttaacctcatgccaaacataaacatcaacttggaatggattatagacttaaatattaaaacaaaagctgttttcttaaggaatacataggagaaacattcttacaactttggagtaggaaaggataaggaatcatttcttaaagtagataaatttgactttatcaaagttaaaaattttgtgctttagaagacacctttaagaaaatggaaatgcaagccatggacttggaaaaaatgtttgcaaattatataccagatatataaagataccaggataccaaaccaatataaagactggcatccaaaatatataagggacatttataatttaatacaaagataaacaacttcatataaaataggcaaaagatttgatgagatatttaagaaaagaagatatatgaatggccagtaaacccatgaaaggttgctctatatcactggtcttcaaagaaatgcaaattataactataatgaaatacaattgcacagaatggccacaattaaaaagactgataataccaagcattggcaaagatgtggagcaatagaaactctcatagatagctggcagaaatgtaaatggtacaaacacgttgggaaacattttggcatctttgataaagctcagcacacacttaacatacaacccagaaatcccattccagtcaggcatggtggcttacgcctataatcccagtactttgggaggctgaggcaggcggatcacttgagctcaggtgttcaagaccagactgggcaacatggcgagacactgtctctactaaaaatacaaaaaaaaaaaaaaaaaaagccagacatggtggtaagcacctgtggtcccagctactagggaggctgaggtgggagaattgcttaaccctggggagtggaggttgcagtgagctgagattgcaccactgcactccagcctgggtgacagagcaagaccctgtctcaaaaaaagaaaaaaagaagaagaaaagaagtcccactcctggatatttacccccaaaagaaaaatatgtaattccataaagacttgtacaaagatgttcatagcagctttattcatagtaatctcaaaacttaaatgacccaaatgtctgtcaacaggacaatgggtaaatacatcatagtctgttcatccaatggaatattactcagcagtaaaaaggaatgttatagttgcatgcagcaatgtgtatgaagctcataaacctcatgctgagtaaatgaagccagacgcaaatgagtttacactgttttactccatttacatgagattttagaaaatacaaactaatctatagtaacagaaattagatctgtggttgcctggtgtcaaagcttgagaggcactcactgcgaagaagtgtgaagggatgtcttttggttgtgaaaatgttctatatcttgagtgtggtggaggttacatgggtggatacatttgtcaacattcatcaaacagtacacttaaaatgggtgaatttgttataagtaaattatgctccaataaatttgatttatttgttgaaaaacttggtgtaagggggaagtgcctaaccaatagaagacactcaaaaaatgtgttgaaggaaaaaaatcctgtgaaataaagcaggtaagagaaaataagaactcaatatcatccaaaatatagattacaaatcctaaatgagataataggaaattaatcccagtgctctgtttaaaggctcatacctgtaatcccaacactttgggagactgaggcaggaggatgggttgagcccaggagttcaagaccagcctggtcaacatagggagagcctgtctcttcaaaacaaaaatttaaaaattacctgggtgtagtggcacgtgcctgtgctcccagctactccagaggctgaggcaggaggatagcttgagcccaggagttcaagcctgccctgagccataatcactgcaccacactccagcctgggcaacagaacaagacccttcctcaaaaaagcaataaaataaaataaagaaatgcacatgactaacatagggtttattccaggaatgcaggaatagcccagtagcagagaaagcctattaaataatttatcacattaatatatcaaaagatcaaaccatttgatgctaaaatcacatttgatataatttaccatttattcataataattttcaggattcaattaattaggaataaaatacttcttcagcataatagaaaataccccagcctggtacacagcttcatactttatggtaacacgcggagattctcactgaagaaaagatgaggcaagaaaagatgatgaagaaaagatgaggcaagaaaagatgatgtctgcacactgtcagacatcaccactgtttaacatttcctgaaagctcttcaaacacagtgaaacagaaaaggaaatgcgatctaaataggaaaaattacaacattccttgttaatgacatgattttctatctgagaaaaaagacagcaagaaaatcaacttaaaacaactagaacttttaaaaagctggcaaagtgactggtaataaaatacatatgcaaaaagaaattgtgtagccaatatatcagttgtgactagctagaaaattgtaatacaaatattctcattgtgatcacaataaaatttaaagcacatgggcatttttaaatatccataatttagatgaagagaaagaaaattttgataagtagagaaacataccatcttctgaaaggatgtatattataaagatagcaatattataatgacagcaattcttctctaattaaatttattttattttgaatcaaaatggaagtgttatttgggaaggaaatttggcacaattgttataaagttacattggaagattaatcagatgaaaatagcaaagataattttcaaaaagaagaaaaatggtgggatttgttctaccagatactgaaatatattataaagctgaaactattaaaatattataatatcagagaaggaacaggtagatcaatggaacaaaatagaaatcccaggtacaaataccatcttggttcataataaagggagcatattgaatagagaggtaatgaatcattaaatgattcttggaaaactggttaactattttggcaataagtaagtaaatattcttactcggtaccataaacacaaaatcactatagatatgtacagttgctttttaactaaaaaagaactaaaaatcatatgtgaatatctgatcaaagaatggaaaaagcataaaatcaaagttagaaacaattttttaaattattgatggctttacactgtaaatattttaaaattctgcatatcaaaaaataccataaacaaagttgaaaagtaagtgacaaacttgtttttaaaaatctgcaatttatgatgacagaaaggattgatattcctcagtagacattcatcttaacaaaggcaagagtcatattcatcgtgcttatctttgtatttctttgacacaatatctagcacatggtagatgcgtaaaaatacctttaaataaattaaaaatctattaagatattttaacaatttaataaatctacacgaatatataaagagctctcacaatccagtcagaaataggtgaacacaatgagcaaagcagatgaaaaaatagttcatgggaaaataaataaaaatagtcaatacatatattagagacctcactaagaaagtaatgtatatctttaaaaacaatgaattatcacttatctattaaattgcaaaggttttgtaaagtctttgttgaaggttggtggaaagtggtttttcatacatagttgctgaaagtgttctgataataaactttctaaaaggtatttgaggaatatgtatcaaaagcattgaaagttatgcatcccattctccttataaaaccacaccttggtatatgtcccaaggaaataaagaatagacacaaagacttaaaagcaagaagagtcttcaggtaatagtgccccagaatgtgatagccatgatatccactaacagcagatttgtaaaatgaattacagtaaatacatataatggaatagccagtggccacttaaaatcatgaaagagtaatataaaataaacattagtatgatatattaaatttttaaatatattacattttaaattgataaagtggtatgtatgatatctcaattttataaacaactaaatgcttatatacacatgcaaatatatgatactctaaaatattcaaatactaccttgcaaaacatataaagaaaaaaatacagaaataggatttagttggtcttcaactttggttcactcattattccatcactgaataaacttactagtgcctactccctttttgtaatttgcaaactaggcagaattctccccattaatctatcagacctctctggagggcagagttaataaagtaccccttaaaagaaaaagaaagtgtggataagtagcttctcagaaaagatagcaggatcttcccctggcaatcatttggagataacctcatccaagttgtaggctatgaaaatcctgagagagcaacaaaattgctctttctgtgattaaaaaaaaatatcagacaggaaaagcatcaatggccatgtagatgtgaagggcttgtaaagcacacatttaaaaataaacacatggatagagacatctatttcctcgttctatctgttgagggcacctcagagcaatgacatccctgtagcagtgagcatactagtacctagactttgatttctaaataccattcttcgataaacagaaccagtcttcttgaagaatagttgattctaagattgggaaagagaaaatacaagatgagcctggagtactttattatgctgaaggtataaaagtgcttaaaaaaaaaaaactgcaggagtcaacctgaaggagttcccaatagtcagaatgaaagcaatttgagcaaaattaaaaattattaagtactggattataacctgtaaaatatggtaaatgcccacaagtccatgctaatgtaaataaacaactgaatacataaataaatgcaggagagaaggtagctcttccttacagaagaattgtaattaataagtatagaaggaataaaggaaatacaaaattaccatcaggcaaacactacagtaataatttttgcaggcaagatccactgaaagatactaaatcagtaaggaaacttgacagacaccaccttaatcaagtgatcaaggttaacattatcagtaataagacatctcaacactatgtaactccctgatatgacgcactgagaaggttataacatcacttctgtggtattcttgccagaaatgcataacttcaatctaatcataactaaaccagggattaactcaaattgagagacattctacaaaacaactgacctgtactcatatcaaaagtgtgaggtcctgaaagacaaggaaacaaagaaactcaggctgggcatggtggctcatgcctataatcccagcactttgggaggcagaggcaggaagatcacttgagtccaagagtttgagaccagcctgggcaacatggcaaaaccccatctctacaaaaaattagccaggtgtggtggcacttgcctgtagtcccagctacttgagaggctgaggcgggaggatcacttgaacccgggaggtcgaggctgcagtgacggggattgtgccactgcactccagcctgggtgacagagcaagaacctgtctcaaaaaaaaaaaaaaagaaaaaagaaaaaaagaatgagaaactcatacagattagaagagactaaggagacacaacaaataaatgcaatgtagaatcattgaagggaaaaaaatattagttgaaaagctgagatcccgccactgcactccagcctgggccacagagcgagactccgtctcaaaaaaaaaaaaaaaaaaaaaaaaaaaaaagaaaagctgataaaatttgaataagccctgtagtttagttaataatagtgaagccatgttaatttcctgggtttggtcattgtgctctggttatgcaagttgttaacattagaggagactgagtgaaaggtatgcatgaactctctgtactaattttgtaaattttctgtaagtctaaaattattcataatatgcaaaaattaaacaaaaaataaaataaaataagcacatggaatgagactgtcccctgggtctctgtagaaaccaggtcaaacatcccaaatgctcttttacccccattctgagttgggccagaatggtcagaataatggttcccaatgtaccttgataaacacggaaactctcaggaccgagtcctaaggttctctgattcaataggtttggagtggacttgagaactgatctttttaataagggcctcagtctgtggaactattggcctcatgtgccctgtggataatcttggctgttggttcatttttcttaactgaaaacagtggcagaaactatggggatttttaaatctctaggctagaacattaactttttaaaaattcagaatagtattttatttgcctcaagcctgtgaatggggatcccacaaatcaccccccactgaagacaatgcccataacaaggtaacctacccatgagcttctgagggatttaggaattgtctaccatctcctctctaagaagggctcccacaatatatccccttctgcttgcttctaactccctatcacctgctaaagaaggacctcaccttttaatcactttcattgccaaggggcacaaggagccccaaactctgtcacctaggaagagcttgacctcatggtttccacactgtgtgcttttatgtccctgctccaggagatgatggacattgtcaaagccatctatgacatgatggggaaatacacatatcctgtgctcaaagaggacactccaaggcagcatgtggacgtcttcttccaggtaagtgcacacaccctgcacatgagctgtaagcccagcctagatcaagtcaacccacgagcatctgagcaaatgatttgtgtccaaccctgtactaagcatggttggtaacagaaaagaattataagatacattgtcctcaagaaacagatgatctccttaagctgcaagtgtacatgacagaagagaacaagaaagtatattattaaacgctagtggtatagtatgaactctaaatccataaaaatttggggatcagggtaaacacgaaagacttcattaattacaactgtggaggtgttaagcatttgtgtctgggaagtaaggggaaataagattggaaactaggatagggccagattatgagacctttaaatggaagagtttggccttgctctggtacaggatgggcagctagtgctgatccttgactaagggagtggtataatcattggggcattttaggaaaaaattaatctagcggtggagtatcagagaatatcaagagttcactctagttcaacctcccactttgcagatgggaaaagagagtcctctctggccttgtgcaagtttgtacagcaagtaacaggccagaatcagaacctcttttgcccagtgttctgccagatggacagggtagcagggagtctacagaagaagcagaataagccagcagtgaggtgatgagtgtccagagcaagtcttttgatttaaggaagctcatggggctcaaagtgttgtaatcaggacctaattggagttgtctggccagtgaaagacaactctcattctcagggcaaagttggttaatgaaatgaatgaaatgagctccagctcattactctgagctccagcaagaaagcaggggagtaagctttggaatggagatcaccagattctgtaaagtgctttctgttatgtctttcagaaaatggacaaaaataaagatggcatcgtaactttagatgaatttcttgaatcatgtcaggaggtaaggagagatctcagggcacaataactctacatctgggaaaggaaacctggggcctggggacctgcagaaggaaggtgatgagaaacctgcacatacctgcaacccctcccatcagagccaacaacaccagcaacaactgtgaagtccacagttccactcctcaacctgacctgcagttggtcttggctaagcacaagactgaacagagagcctaagtaggggtctgggggcatgtgaaaactcagagggggtctctgtgaaaatagacttcccgagagggcaacaccattattttttagcctgcctctggcttgatgacccatttcccagactacaaggaagcagctggggggaaaaaaacctacaattgtgtgattctcaaaccacagtgtgcataaaaattgcctggaatgattctgaaaatgcatatttccaggcctcaatcccagagactctagatctgggtcactttaacacaaatgtcctggaccaatgcttctaacactttaatgtgtgaaacaatatccttgatgattttgttaaaatgcagattctaattccataggtctggggtagggcctgagatgttacttttctcacattctccccagtcacactggtgatgctgatcctgggaacacaactttcattaagtctaaccaatagaccagccccagagtccaccagagactgaactggaaataattgcttcatctacttttgagaaatccatttgtacccccacattattttagaaatgttcagagttactctgagctccagccaagaagaatagcaaatgtaagaaagccggggagaagttcctagcagatactgagcccccatcaagtttcaagcacatacataaacatcacagccaccctgttatgtagatgtcctatgtgcagggtgatatccaagatatttaacaactagaatggaatgaacactgacccccttgggggtgagttctcactgttaattcccttgagagctggttgtaaaacagcctggcaccttccccacctccaaccttgattcctctcccaccatgggatctctgcacacccagcttcccttcacattccactgtgagtggaagcagcctgaaaccctcaccagatgcagatgcccagctgaactttccagctgccagaataatgagccaaataagcctatactgacattaaccttttcatttctgatattgataatttgaaaagcagtcttaataagcatttatctactttattgatttttttgaaagagagcgctttggggggttttcttactgtatgtctctattgcatgttctgtattttacatttttctattatttcttctctgaggtatagtattgaatgtagaaaaatcctcaaatgttcggtattaagcaatacacttctaattcatggttcagagaagaaaatatctcgaataaaaataaaataaaaatatgacttatcaaaatttgtaggatctaaagcagtattccaggaatgcaaggttggtttaacattcaataattggtcagtgtaattaatcacattaatagaataaaaagagaaaaaatataatcatttcagtggatgtaattgttcagagcttcttaaaagaagcaactcactattttactagatgatttgtttcttctgaattcctctttaaggctacaggtggtgcttcttactttgaactgatcactttctaggtccccacccttacttcttgtttttcatacccttgtagagttttctccatataggaaacccatgcttgacatttgctcaccagagttacagagctctcagggaggagactcagagttctaaccctcttgccctccttttttcccaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgacattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaatcacttcttcatgactccgttaggtaagagaggtaagctgtgaaaagggaaggctagtccattcatttgacacccaattattagtgcagttgtccctccatatgtgtgaaggatcagtcccaggactctccataccaaaatctgcagatactcaagtcccacagctagccctgagggactcgtgttttcagaaaatttggcctccatatatgcaggtttcacatcctataaatactgcattttctatcacttttggttgaaaacaatctgcatgtaagtggacccaataagtttaaactcatgttgttggagggtcaactgtacttacgttgtgccaggcctgtgccaggcaatgacttcatcctccccagcccccaagccttccccagcaaacatccaatccaaatgcaaatactgtgaccaaatgcaaatgcaacttcgagacaagacccttcacaacactttgcttccaacaagattgccacttctaagaccctctgatatggaaagcctggagcccctgtggtgtgagtgggagtgcagagataaagaggatgacggggcctcctgctgagagattttaggctctagaggaccatcaagcggcttcagcctataaccagcaaatgattactcatgttgaacactgtgggtcttagtttccccatttgacatcacatttgaaagactaaaagctaacagtagcattcttggaaggaaaacaatttactgaaaccctattttgtgccaggtgctgcactaggggctttatatacattatcttatttcatgctcatgtggagcattccagatggtagagtcctggttgtactgatgaggttgctgaagctcagagaggtaagggggacctgcgtaaggtagcacagctgatagggactccatagggaggctaaactcttctcgctctatcatagacccttcctacaaggggattttgcctcaccccaaggatgaggatacttcccactaatctcattcatctgaagtcagttcagagaggcattggtgttctttgagtctgtgtaacagatggagaaacagatgcagagaaggggaatatctcaggcagccacagtcaccggcaggggcaggccacaaaaacatctcctgcattcatgacacatcccactcagatggccattggctgctgcct

SEQ ID NO: 16092 - DNA, 53337 bp, Human
aataaaaaggagaaattaaaataaaataaagtaaaattgcttctacttttaaggatgatctggaatgttccttttcataggtggcatgtgttttgagagatagcgagagagagattgattgatccacgtcaggaatgccctcccttttactccatcctccacggccctgcttaaatcccagttaattccatgacatcttctgtgcttactctacttcaaagtgatttctctctctctttctcttcaaatggctttttattgttcactgctatgctagtgatttgaaagaccaggtgacctctcacccgtgatggagcttttgtacagcagagctgtgctttatacagaatgatcagctacaaagagctcttaggtgcggcccaggcacaatggctcacgcctgtaatcccaacactttggaaggcctaggcgggcagatcacctgaggttgggagttccaggccagcctggccaacagggataaaccccgtctttactaaaaatacaaaattagctgggcgtggtggtgcatgcctgtaatcccagctactcgggaggctgaggaaagagaatcgcttgaacctgggaggcagcggaggttgcagtgagccgagatggcaccattgcactccagcccgggcaacaagagcgaaactccgtctcaataaaaaaaaaaaaaaaaaaaagaaagaaagaaagaaagagagaaaagaaaagagttcttaggtgtgaggccctgcaaggagcaaatggcctgggctaccttcactgatgccctcagcaccttctaaggtgaggctaacaccagctcacattgatgagctagtgctgggcctggagcaaaatgtgtatttcatttaagctgcccaccagcttgtgaggcaggtgcattaccgtgacggcggggctcctcagagtgtgtataagaagaaaactgtgcatggccaaagctatgcttgaaaaccctcaggaaggcaccacctcaaggaccaacacagcatcacttagtaaaggcaacagccttggaacagatgactcgtgtgtgtgtgtgtgtgtgtgtgtgtgtgtgtgtagcattagatgaagtagtaacttgtgtttagaggttgccttattgcacaaatatagttgcttttatacactggactcaccctctgccaataagttgttcagttatgagaaatgaacaatgtctgaaactaagaaaacagcaaattctcacctcctatctccagggaatgtgctctttggctagaatatatggcagaatcaatagtgaataaaatatattgtggaaacaatagtgaatggaatatatgacactaccaatagcaattgttaagttttttttctttttaatttttctttttaggtttgtctagttgaatgcatctaagttttatgtgcatatgaagaatcactgttttcctattatacagatttggaaactgagattcccagcttttaactccttgcctaaggttgcatagcacagaaatagtcatatcagaaactgagccctgtctgcacagtgtagcaccttgttcagccctgggtgcctgactcactcactccttgaggaccctctcatgacaactgtaaagaggcagctgaaagaatcccagtctttgatggtgggaggggaaagtggttggaaagcattaaaaaaacatgctccagcagttcactgatgtgggaaattgtctgtatttcaggtcaaccgtcaggatagattttggtctgcaaagccccagctgagcaagaatgcagtgtagacatatgggtgcccagagtttaaaggaaaattactcagactcacattggagtttaagaccccttcattgcctctcctactgggttggggtgactggagccagtggggaattaccaaccctgtggctctctctgcatctcaagcctccagagctgggcttccttgtttacttatttagagcccagcagaggaagtggtaaaggaaactagctgagtcgttttctgagaagagaccatatttgttcgcagaggaagccgttgctttctgggatctggctacggcagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaaggtaagccttgctcttgtgtgaatggtcatgatgctagtgcccttggtgggctgagctgaggcttgacgatggaattggggcagaatgtgggaggtgtataagatagcaatggaaccctatggcaactttactggttgagtgagcgccatatagaccgctgagttttcctgaccatgagttccggagagaaggatgggagcagaagccctcaaatgagtatgtgcctattatgtgctagggtttgaattcggtgtctcacaggcactgtcccatttagcgctccctactatgttgtgaggtcagcattgttatccccttgactcagctgcaaaatcagctcagggaagtgaaatggtccgaagccctagggactacatgtgatagaggcaagactcaagccacacctatctggttttaaagtccatgctctgagatgcagagaactgttgtaactgctaatgagatcaacgctacttactagaaaggggagacgtggtgtcctggaggcaggagaaagaataggcagggtgggagggctggatagaggactatgatgagcagtgccagacacagcatttgggctttcactgctcacgaccctaaggggggtcctcaagctcccgcctggggcagtctccttggagccttatgagagtcttgtgaagcaggacagaaaactgatgtgagccccaatttatagctatgaaaactgaggcccctagaggaaaagaggcttgtggcggtgctgggaccagagcgttgctgtcttatcttctggacttagaggaaaggttgaaggatccctgtgcttggtcattggcagaaggggacaacgcatctgcttgggcagatctcaagccacatgacttagttatagtccctctaccctgaccatgtggtaagatgacttgtgcgagacggttaagcttctaacaccctcatccctgcaggctggcatcggattctgttgatattccagactgtcataaagatgagattgtaaagctaagatggtagaagtcatctaattcagcttcgtgtttttcctggggaaattgagattcaagagggtagacgaggttccctaggacgtatagccaaacctggggtctatgcatttccgaggcatttatagtcacagctgttctcccccaacctgaagaagaaaatgagaacatgttgaactaggtgtggtatggtaggggtacagttcacagatcctgttttttgccatattttgtgctttcatttctgttattttccttctgcaaggtcataataaacttagatttcagcaaatattgttgcgcaactggttttttgaaggatgtttctaaatatcttgctcaaatatagaccaaataagatagggcaacaaggtaaaatttgccaagagggaataaagtggcatgttaccttgataaaggaaaaagaaaggaattgagaattatgaagagaaagacttgggacgggctgagaggcacagataggcctaacattcaggtgtgaccaggagaattatacaatccaattgagcaacagagaattgatccctaaaactcccatcagtacagggagatggaccacgggtcagggatggtacaggaagacctcactgcctgagctgggggaagggagagttttcttcctggagatctcagaccccaggacaaatctacagcacccaggcaggttccttcttctgccataaatggactgagggaagaaactaggagactgaggcaaatctgtgatcctggaagttctagtccctccacagacttggatagaaacccttcagattctgagtacctcagccccctgaaagaaactaccaaacgaatggaccgcagagtcatttgggaatggatcttagctgtcaaacatgacatgtaaagaattgatctgcagatgcaaactctacccaagtagtggggtcaggcctcccttggagacagctctcgactcagctctgaggtcggacacactttaccctggctctgccacctgctagcttggcgactttcctgtagttgctttgcctctctgtgcctcaacttcctcatcagtgaaatagagatatgaacagtaactaacccaatgggttggttgtgaggattaaagcaaatgatgtgtgcaaggcactcagcagacaaatggatcctaatgcgtgttccttctgcccttttaccttctctattaactggctcctagctggggacacccatgcagactggtgggactttgcgtcttcttgtctctgacatgggtacctcgtcctgtgtctggaatataagctcctgaggacagagaccatgttacatatttgttcaatctctccaattccttttgacttgcaggagaacatccttgggtcgtgcagtggagaggcactggctcagagctgtgtgtcctaatcccaggtggggtcccagctggtatcccagctcactgtgtgaccttagaccagcctctttccctctagaggcctcagtcttccttactacaaatccaggtaacttttctggaccagtgcctaccaatgctggatgccataggaatcgtctagggtgctccttaaaaatacagatttgaggtccacaagcctagatcttgctggagcagaatcaaatgcctgggtcccagtctgcaggactctctgctgatctagacacaaagttagcactcttcaaaatcatctggtttatctcataatgataacagtgagaatgatgaattaaaggcagttgactcttccaagaaccacttaccccccactgcctgtagataaaggggataccagggctccatagatgggatgtgctttcaatatcaacttctaagtcagctttctgagtgtgataatcatcccacccttccaagctaagatttcataacaattgtatttattctttggatttgctagctataagataaaaatatggcttaaaatgtgctccaaaagaaggctgccacaaaccatgaggcccacccttgtgagaagaacctaggatcctcaaggagaaacatttaacctcaaatgctccaccccaaagcagcaagttgagagatacttcaaatgtgaacatttatgctgttgaggacaagttgaaactagcacctcatatgattgctgattggtctaggaaaataaccaagatcttaaaaatgctcgttcctatggatcctatataactcggttctgaggttctgacttaaacaatttatctcaaagagggagaaaaaagttcgcaaaatagtatccatgattgtctctattttgattgggatgaggtactgcaaacaaatgaagctgcattttcatttgctcattttacttactgtatataagttatgctgtaattaaaaggggaatatttctgaaagagacattaaagcctgttctgaaacttgtcacctaaaacccatggaacctcatgcaagttacttgctgtctgtgcctctcattccccatctgcaaaatgtgagggttaaatgattgaagactagtttaactacttggtacactgcctgccacacagaaagctttcgataattgttcgccgtttttattatcattattgaaacagcagcttggtaaataatctaaatgttcagcaataagggcatgattaaataatgttgtggtcattaaaattattttaaattgagtttgcataacactaggcagtgtttatattatccctttaggtaatttaagagaaaaaagtcagaataatgagattgaatataaatcataacctcaattatgtttagaaacatgctaggaagaaagcatggaaagaaacaccgaggtcgtctctgggcatcgagacaatggatggtatttcttttcttcttttagctctccttcctgaggagcatagggcagagctctgcatgccttgaaggcagtctttctgtaagggttggccccgaagccttagagcaaggcaatttctccatttcaggcagtcccaagggggtagtgaaagcgaggctgaggtggggactgggccctctgttagccaagggagggcagtggggagcctggctagccacaagtaccgcaaagtgctaagtttctggggcaggcaagggagaggaaccaatggtaagagactgcccgtcactaacaacaccttccccttctctttgcagctcaactataaggactgtgagaaggcagtgaagaagtaccacatcgatggggctcgcttcttggtaagctctggctagtccaacacactgaaaccaagactgttcggcacttttccccatggctgcagggccaactggcctaccctttccctggggacacccgaggatccctttgctttttccagaaatttggtagggccccctctctcactacctttcaggatcctatcatccagaacccctctctgatcttccacttacaccttaaggaggaatccaagtatagtaaacaaataatctggaaaatctatttaaatgccatccatcctttgagaagcccaaggggaagaaggaccatatgggtgaacagaagcttctcacctccaatctctcactctggagcacatactcatgagtggaataaaggatggcatcaccctcattgtttcaattacttccttctttctcactaccaaattcataaagctgattttgcatcaagcacacatgtgatatggctgtctccactgtattatacttcaaaaagcttgaagtctaagaccaaggtgcaggtatgtattaaagactaagccattaaagggaaaaggatgcagctctaatggtggagacagaggtgctaggttgtggtcggggaggtggtttgagcattttccctgaaatgacacctttgcccatgggttaagaaagaccctgactgcaccaatccatcctttctgggaactttgctttactctttgaaaataagacttcaagggtctcatgggggtagatgttcctaatttaaattcagagtgaatagagtaagctaagttgtgtctccctgtaagacactgtcagtaagggaacttgaccatgagacttcaggccagttggatgagaccagagagatcacaagctccagcttgcccccagagaacaccaatccatttcttatattacatctctgctaccaacatcttcttgaattccttcagtgatggtgagctcaccaccacccacagtcatctgcccctttctaggcagctctcaagtcttgtgctgaaactaacctgtgctcctattggtctgagttttgcttccaggtgccatgtaagacatgtttattcactgtccacctaaatcattcattcattcgcctattcgttcacttgacaagcagtttcccgaactgcttttacatactggagagcattataggtggtggggatagagaaatggctaagatgtgatttctgccttctagaaacttgttttatagcagaaaggtatgttcagaaaggcttccaactacctcatttgcagatgaggaaacacatgcagagctgtgatgtgatttgttctatgtcacatacctactaattgaactaaggcatacacttaatttagtctgataccatttgactttttaacagtattatttatttgtattgagatttgagtcagtagaattcctggagctttagtgccattcttgcaaattactgctaaacccaaatatttcattctggtgctattagcactgagaacagagacttatcacagttgaatggaaagggaggaagacatctttgaggatggtgcctacgacgccctgttgcctgggtcaccctgagcaagtacttgccctctctgagcctgccttgcttcctaccctgttgactgagcacattggactgggtcatagtgggtgatggcccctcccggctctgtaattccccacaacagtcctggtgcgagtgtcaggcctggtagaacagggttgtttgagagatggtatctaggcagctatgtttcctctgctccaatcagtcctctatcagtccttcagacaatgtggcacattctgttcattgtatgaagaggaggaagtgcaaagtagggtgataggaaccagaagaaaagaagaagaatccagtgcctgtccctgcaactgggggatgtaaaggcagcttctgctgaaacccaccctccacccctagtgcactgggtacaatttgggacgcttgatctaagctctaattactaatctatcaccctttccagctctgtaatatccagggccactctgctattgaaggcaaaagtgaaaggccctagttatttttccttccttccttccttcctttcttccttccttccttccttccttcctgccttctttccttcctttcttccttcctcccttcccttgtcctcccctctccccttcccttgtcctcccctctccccttccctcttttcccttccctttccttccctgtcttctttcttctccctctctttcttttcttccttccttccctctctccatctctctttctttctctctttctttctctctttctttctctctttctttctttctttctttctttctttctttctttctttctttcttttctttctttctttcttctttctctctcttctttctttacttctttgccatttttgttttccactgaaaaggttagatccttatctggtagaagctatgcttctagaagttataaaaagaagagaaaaggagcttgagacttgtgtcagttgggaaggcatgtgaccccatgttgcagaaacctgaccacagtggcctaaccaaataaaggtcagtctgtttcaagtaataaatgtataggcgggtgccaggggatggtgaaagaagacatcaagaacccaggcttcatctaaccgatggaaaaagcctgtggcttctgtcctaacagttgtcagttggctactccacctttaggcatcatatctccatggcaggcagggagacggggagaaaggcaaagaggagaaggtgtatggtgaatggtaaatgcatgctcccttttttccaggaaagtagtaacttttccagaagctccatccagcagactttggttatatcttactgtccacaacagagtcatgtgacctccaccatctgcaagggagcctggagagttaaatattttgaacaagcacatttactgccctgaatgaaacccaggacctgtcagtaggaaaacaaagggagagtgggtattgggtaggcaagcagccatgtctgccacattgcctctcccaccagggcccagtttgtggctttcctctttctgtacccctcttctcaacacccacagcatataatcatactcccacaaagccataaatcttaactccaaaatcatcatgcaaataacccagagtttactggaggcttttggaaaaggtggaggagggggttacatcacatagcaaaactctccaaaaattctgtttcaacatctctcatctttcctcacagttcttgtccccgttctgaatgtcttcctctttcctgacaccctgctcctctgtgtctccagccaggctcatgtccacctcctcctccacaatcttcctgaaattccctcagcttacgccctcgtctcagcagagcagaagctggtggccagctgctcagtgctcagccgccacccctctggcagcccttaggaaggcttcaactcctcacaccacactcaaaacatgagtcttggtacctccctgagtgggagtagttcagaagcagggagatgctgctcagtgatgaaaaaaaaaaaagagaaagaaaagaaaagaaaagacaggaaaggaaaggaaaggaaagaaagaaagaaggaaagaaagaaagaaagagagagagagagaaagaaagaaagaaagaaagaaagaaagaaagaaagaaagaaagaaagaaagaaaaagaaagaaagaaagaaagaaagaaaaggagtagttaagaagcttaaccaaaagcccgatgccctcaggacttctggctgactcccttcaccagccccaccctgccgcaggtggtctgatcagcgtccagatcagaaaccatgcctgtgagctggatcagatggatccagtgaacacattgctaagatgccctagccccagcctctgtgccagctgatctcaaagaagagtgcccagatctttccagtggtcagaaaacctgacaggcagctcccagaacggaaaagaagcaaaaacactaaactctaagactcacccagacccctgctgcttccccaccaggggtagtaattcctcatcttactcctccatttctcagtcacacactgtgccaggcactgtgccaaaacacattacatacatcatctcactcagtcctcacaatcctgataggtgggtatcattattattattatggtccccattttacagataaggaaactgaggctcagagaggcaaagtgcatgccctaaatgacacagctgctaagtgaatgaaccaaaattcaaacccagcccatctgattccagagctcccaccctaactacccagccctctggccttaactagaatggtggtggagccctttgttggctcatcattggttctatggaaagcatgcccagtctcttttctgctcccaattctgacatgctctcctctcctcctcccttccagatgcctcctttcacctttccccccataatcctctccaacataggccacaggggccgtcaaaaggatcagacgtggtaggatggaggtttgcaggaagaaaatagactgtggatgtcacagagtggaattccagccccagctcatcccccacaagtggaaatccccttgatatccctgagcctcggctttctctctttcaaaatgggaatgctggtaactcctgcatcacagagttgatgtgaggattcactaaagcattaagaggtggaggcccagagttagttcttgacaaatatgagtttctttctcccctcccttctcagttccctcaagaaagccttttcatggcatccccatatcttgagaattctaccaacaaccctggtgaaagaggttctctgggatgtgatgttggtaaaagaggcacagactcctccaggctggcttctctgcagctgaccttgtggagactgagagggcctgaggtctggggtgtagggaagaggtcctaacatggccaaatgcagcccacacaacgagtcgtttggtttcacagatttagctctcacagtgtttaagtcaaaattatttgccaacatttggaactcagagcatttcacataaaacccagacttaaggattccctttgtaaaagcagatccagcaacagcaggcccacaggcttttaggcaaaacatctagaggctgcctacttggggagggtgggtgggcagggcggtttctcctctgtttgccacagtccccaccactccctatattgtttcacgtatcactcttcccctcctgctcagagccctttctgtgggttgtaacctgcctgccatatgtgtcttcatttcagaacctgacagaaaatgacatccagaagttccccaagctccgggtgccgtaagtactcctccaactctatgggtgatctgggagcagaggtgggaatggggagtagtgtgagtgggggctgggtcagttctatgtcattgtcggcttgaaataagaaagcaagtaggaaggatgagggcaagggcaggatgtggggaacagaagttacatgaagagctggaaaacagaagtcacagatccagcccagctggtgacctggatgctcttgccaaaaacaagcccaactctggccaatgttttcatttcctctcttctcatggggtgcttgggcctgtgaaaatagcatcagtgtcaaggtttcatcatggcatcaccactgactcagtgatggcttaagttttcttgacctccatttctcacacagtaaaatgagagccaaagcagatgacagcaatggatataattatgtgttgatactgagtgcttggaaatatctgacaggggtgttatgttgagaagaatcccgaggaaagggagctgtgattgatcattcatgtctgccataggtgctgaaaggggaagttgcagtatgcatgtcatgccatgtatttttcatccctctagtaaaggtctcacacactcaaatacctacaggagccaggcaggtgctataaatggtaaaattggtcaggttgaaaacacaaagccccgttgttttgttttgttttgttttatcatcattggacaaaacagtggtaaatattctgtatgaagaaatagttctccattataagaaaaataatagcacggttatcatatgatgaaaaaagtagccatcgcaaagcctcattgttggtgaagcaatagagaatggtggggattgtggcaaatcagatatcatatgttccattcaaagagtgcagcagctcctcagctccagctaatgtggacccaacaatgtcctatcttcaaatttatcaagaataactagaaatatgggtttcatgtgctatatctccatttttaaacattggctcaaatgtttcaagtattgtgaatgccacagtaaacacacctaagggctacatatagtctgtgtgttaccagtttgagttctcttctctggacattctataaggacccttctcttactctaagggtctcagagctcatcataataaaagggaagtaggccaaaggagtaggaggtggggagatctcatgaataggtaggaatgctggcagctcaattaaggagaatatttttagcatgactatagggtttcccttgtccggaagggggagggaaaagagaggaataaggatttgcctttggtgctgtctatctccagggacacgtattgttgaagatggcttgatctttctaaggatatcctctaaccacatgtggctacttcaatttgaattaaatttaaaattcattcccctgaggcactagccacattttaatagctacgtatagctggtgactactatgctggagagtgcagatatagaacatttctatgattgcagaaatgtgatgttgtagagataaaccatagttctttgcaaaagagggaactttccacacaggtgtcagaattggtggctggtgggctagtcccagactgcaggtatgttaaatttggtgaccactgtgctttgaaatcaggaaaactttcacaaaatccagcctctttagaaacaagtgaaagatgtggcaattgagggcttatattctactgtggcaatagtcagccggatctgatgtctgctgccctgtttagttgggatttgtgctccccagttcaccagggtcccaccattccctgagggatcgtcctaaggtacgtcaaccatttatatcatatcatgggaactttggctttcgaacaagattaagtaatagggatcagatttactttcccaactgaaataaccaaataaccaggcaaaatatatgaaagagcaattttcaagacattgagcatcagacaccgagggatggaaaacaaaggcggtgaagcctatggttgcttgctgctttgagaatctccaggccttggcacagggagcagggagcacagtgctgggtctggtggacgacttgagttgaggaggcagcggagagtccaggagcctagagttcattcaacgggtgtcagagaggagagagctgcatagagagagcattctggagagcttcagaggggcccctctttagcaaagcacagatcagtccatgcatgaaaggagagactacctgtaggtggcaaaagaactacccaacagtattggaggaaagagtagccactcacagggctggaaatggtgcttatttctaccagcctggctggaaaacatagtcattcggtagagtgcctagaaggatcttgccttagtggtggggaataattagccctaatctaaaaattgttcaggtcctggctagaaaaccttaaaagcaagacccaaaagaaacaaactgcttctaagtaacttaactgcatctcagaacaaaacttaaacctatttataggaatgcaaaaatattcactacccaacaaaataaaatttatgatattaggcatctaatcagagactaacaggcacacaaatgagcaggaaaatataacccacaacaaagagaaaaactaaaacatcaaaactgacccataactgacacagagattagaattagcagacaaggagaatgttgagtgtatttcatgtgttctagaagttaaatttgggcataagaaattcaaaaaaagacccaaacagaacttctagaaatgtaaactataaaatctgagattagaaatacactgcttgggattaacagcagattagatattgcaaaagaaaatagtagtagacatgaagatacagtaatagaaattgtccaaattgaaactcacagagaaaaaaaactaaaacaaaacactgaaaagagcatcaaggggccgggcacagtggctcacgcctgtaatcccagcactttgggaggctgaggtgggtggatcacctgagttcaggattttgagaccagcctggccaacatgacaaaaccccatctctactaaaaatacaaaaattcaccaggcttggtggcaggcgactgtagttccagctactgaagaggctgaggcaggagaatcacttgaacctgggaggtggaggctgcagtgagctgagatggcaccactgtactccagcctgggtgacagagcaagactccatctcaaaaaaaaaaaaaaagcatcaaggaactttgggacaatttcaaagaaccaaatatatatctaaagtccctaaaggagaggaaagaatgtgtatgtgagcggggaaggagagacagaaataaaacacttgaagacataatggctaaaaatttttcaaactggatgaaaattataaacccacagatccaagaggctcaacaaaccccaaatctaagaaacaggaagaaaactagctctgaggcacatcacaatcaaattgctcaaaaccaatgataaaaagaaaatcttaaaagcagtcagaaaaaaaaaaaaagacatattacatacagaggaacaaatgcaaggatcacaacagctttctcgaaagtaaaatagcaaaagaaaaatattgtcaacctagagttcaatactaggcaaaaatatctttcaaaaatgaagacgaaataaagactttttcagacacacaaaatctgaactgtactgccacaggtgctttttaaaagtccttcaagtggaaagggatgtgtacataggaatgaagggtgccagaaatggtaactacttaggtctgtgtatgtacgtggcccttgagggcatttgagtttgcatcttgtggtccctatacaagattaatatttcaataatactttattcatttaatgaactgctgttagataactacaatgtgtcaggcctttgttaaaattattcaggctgcaaagacatgggacagaatcctcatcctcaggacactcacattctaaagggaggtcagacagacaagcaaagcaattacactacaattacaacagtgcaatggtacatgcatgcacaagttcaagcgctcgtaggaaggcaggagtaattttccccacagtattcagggcagacaagggaggaagggaccctaagttaaatcttgaaataggagggatggattgtaggacattctagaaatgggaacatattacagaggcaccacccagtgtgcctggtggagcggcagtggggcagagcagctggggcatatacctgggggagtggaaagcaaagaggctgaagtgagtggttgttgtggggtgtgtccctcaatttataaaggtcccgtgagccattctcaggagccagagagtgttagtgaagtgagcatcaaggtaaatttgtgtcttatctctgtccagggcatgtaagtgatgatttggaggacagcccagctggggacatgggactgagttagttggtggtgaccaagatcctgccagtgagctaggagcctcccctagggctgtagctatgaagatggggggatggaagagatttaatcagaacagtggaaggacagagataaagaaggcactttcagcttggaagatcctttttcatcttaaggctaagctcaactgatgtcttctggcttttttgagagcctggagaaagtggtaggggtgggaaatggtttctggttagtgtgaacgggagaattatcaacacattgcgaatgggctggggtgggatctttctttagctctctggaaactaaaacaaaagcttggcctgcgatgtaatcccctcctccaatgtgtttgaatgtgcaccctagaaagactgtgaagcctgcccatagaacatgaagggttaatatggagaatgatggagaaaatatcaagggaaggtccaggctgccctgatgaggtgacttagagactcactgtccctcttggcagaaatgtataacaaggaccaattccagctctacttccaatgagttgtgtgacctgggacacatccctagaccaccctcagcttcctaaactataaaaggaaggaatgggttagagagactctacaagctcaccaattttaagtgctactatttggggtataaataggcagacaggagagcttagtgagaaaaagcgcaggctctgaggtcagatgcttgagacccaatccttccattcacaggctgtgagacttgagggcaagctagctcagctctccgagcctcagcttccttatctgtataatgctaataatgatagaacctacctcagagggttaatgggaaaattaggggaaataatgggaaaataacaatatgcactgaataagtgttggctattcttgctttatgtaaaatcccaattagaacaattttagctttttaactattctatctttctggagaggaggaattaaagaatagagaggacatagggttttggagtgagggagatccaggctctaaagctgactttgcctcccaccagctgtaggaccttggggaagtcatttaggcaatcagagcctcagcttccttgtctgtagaagggaaaagagctaacttttcaggagtggggaatattaaaggaggcagcacacagaaattgcctggtgctgtcctggatacttacaggcgttcaatactttattcattccatctcttgtacataagtttatttgtcttgttcattaccccaaaggcctttggaaaagaaattgtgttcatgtacagaaaaccaaaacaatattacactcttctgaatgtctctatttccttccctgacgtttacaatataagtattaaatagatttttaagaaggtaagttgtggtaaggaaggctctctcagcctgaaaatgcagtcactctctcaggacatggttgatcccaagacacctgcaacattgtaaaggtggaggatttttaaagaaaaaaaatgaaggctccctttatagggcctaggttggccctcatggtacagctgacaacggtctggttaaatcgatagaatacacgaatacacgttcaaatctgctggtgcctatttgaagttcattaaaggatgggatgttataagttttatatttaaatgcacagtgtaactttacggagaagagagtgacggggtgggtggtgcaggcagcaattaggtattggatgatgctctttctgctggttatccctgtagccattaccaatggtgcaattaggctgggaaaacctaagactcaagctgagaagtaatgcagaaatatttgtctgtcttcctgtaaggctgtgagtctaatggcagaaacaacgtactgaggcatctcctttgtacctatttctctacctgagacagagaagacaggaaaggtgtggaggaagggacgcagaggcgaaaggaacattctcatgcctgttaaagaatgtggccactcaaatgcctgtaatcccagcactttgggaggccaaggcgggcggatcacaaggtcaggagatcgagaccatcctggctaacacagtgaaacgctgtttctactaaaaatacaaaacaattagccgagtgtggtggcaggcacctgtagtcccagctactcgggaggctgaggcaggagaatggcgtgaacccgggaggcagaacttgcagtgagccaagatcgtggcactgcactccagcctgggggacagagcaagactccgtctcaaaaaaaaaagaaatatggccagaccccagcaaaaccaaaacagggcctctctccaacatggtcctcccctgtcccattcagtggctaattgccgtccagggacccagctcttgtcagtcctcaagggccctgccacaggaaaggtgcctcccttggctgtcccttcttctcttccagtgcaagcccacagcactcgacgtgaagcctcctctccccataaatgctggtcacgtgcctttagacagatgcctccctcagagccttgcctattattattattatttttatttttgagttggagtttcactcttgttgcccagactggagtgcagtggcgcaatcttggctcactgcaacctccgcctcctgggttcaagcgattctcctgcctcggcctcccgagtagctgggattacaggcatcaccatgcctggctaatttttgtattgttagcagagatggggttttgccatgttggccaggctggtctcgaactcctgacctcaagtgaaccacctgcctcagcctcccaaagtgctgggattacaggcatgagccaccacacctggccagccctgccttttttatttgtaaaaatgagaataattatacttgtctaccaggaaaatgatcgtgaggcaccaggaaaacactccatgtaaaactacaggggtaggggacatgggtgacaagtaaggagaacactgtgtcctcaaattattatgtcctactcttacactctcgaccgaggcctcaggtgatggtgaaaggctccttcctgagtcttaaaacatctggctgcccccggcttctcaggtgacaaggatagaatttagaaggtttggctcttggttcaagggggctggtctttaaagacggaaagaacactttgttccttggaaggaggattggaatgcagagcgagagcagggctgagagtgggaatgtgtgcagggaggaggggtggggaggagaaggagagttccagggtcccactgagagaacagcacagggggagaggcatctgccctacccaggagccgggagccttgtcccaggagggatcagcaggcagtctgaaatctgagcccagggaataaggctcccactgtgggagggctttggtcagaagttggccaaagctcttactatgtgagctgtggcaagaatgcgctctacatcataagccagtacacagctacacgtgccacagtagaggaaacaaagatggaattttcacaggacaatgcctattcctactgcatgctttgtgcactgatattttctattctataccccttccccttcccttcccttcccccctctctctctccctccttttccacctgcctggcagccttcttttcttgtatagtttctttcctcttgtgtcatcagcaaagttgatttctagacccactagtagggcttccttcactgttgttcaagtgtggggagaattaaagggctacatcagaggccagctaaggccccgcatacccccactctcctgtttcactcccttcataatcacaaagttccttctcctgcctttccttctcctccttttttaaaacaagcaaacaaacaaacaatttcatcagtgtcaagaatagcaggatttatttcacaagctttttggatgataataaaaatcacgtgggggccggttgatgtcactgagcctcaggcttctcctcagagagtccgttcaggtaggtctaggctgggcctggtgatcagtgtttgcaacaggtacagctaagtaatcatgatgatcaggcccatcagggattccctaatcaggtttaacccctgtattgtgctgataaggaatctggggccaagtgagggcagctgccttgtctgagatcacacagtgggcgccacccttggggccagacattgtagttagactgtctgtgcctgcaggccctgtaccttgtacattaccaggagagaccttagactgagaagatgaagactggcccccaccatgctgtaagttagggatgcagctgggctggaacctaggtcattgtagaatgctgccttcctacacgggcctggcttcctgtggggaggttcagcccatttccagggccagctagtcccttaaacaaaggcaagcagagaggactgctgtctatggctgcccagcccccatcacttcttgctctggtcctgagcgaggccaggggtttatggggtgaagggagaatgagtcacctccctccactcactgtcacttggtcctctgggggtagggtgtaatttgaaggtttgcacctagcaatagccatagcaaccacctccctgctatgcccaccatcactgttgcaccgtccaccagaccctggcagtggtcccacaggcttggaaggtgctttctgtagccccttaaagcaggaggaccctgggagcccacactttgctgcaagccaactgccaggacctgttctgcccccactcagctctttgctgctcctctgctgaggcctgcggtttgacatttccttcctcacccaattcgagccccggcagcctccagcctggctgctagagatactggtgagaggcaacaccgcagagagcaggaggttctttcaagatccaaagcagccttgtgagctggtcagagccctgtcaaactctgtaggaggagggcgttgaggtgagcctcagtcccacctcgctcaagtcattactgaaatgtcacctcttcagtgaggcctgatcattttaaatggcaaccgcatcccacccctgcactcccatcccccccagccccccacccctgcactcccatccccctcaccagccccccacccctgcactcccatccccccagccccccacccctgcactcccatcccccccgcccccaacccctgcactcccatccccctcgccagcccccacccctgcactcccatcccccccagcccccccctgcactcccatccccctccccagccccccactctgcatgtgcatggtgcatatgcagcacatttcacctccttaaagtttcctctccactagcagggatctttgttttgctcattgatgcaccttgagcacttctaagttcccagcacttagaaggccctcagtgcacattgttgaataaacaggtgacagaatgggagtggctgctgcagccagcaccacctgacacggccaggacacaggacactaacggggctcccttgccagctctgtaggagtccttttatcccacatgcccatcgtcttcttgaaacaaccacttaagggaaccaaaaagaaccatgtcacaagcattctgacggcatggtcaggaggcaactaggaagcccccgctgctgctcttaaagcctcgctctctctgcccagtcacaaaagcctggagttgtcaacaatattattacagagagtaaacctttccctccccttcctccttctctttcctcttaagtaccagtgtgtttatcaaaatttgtttatcccattgctctaatgaggtaggaggtttggataccatttctttcttttttttttttttttttttgagacgaagttttgctcctgtccccaggctggagtgcagtggcgtgatctcagctcactgcaacctctgactcccaggttcaagtggttctcctgcctcagcctcctgagtagctgggattacaggcgtgcaccatgcctgactaatttttgtagttttagtagagacggggtttcaccatgttggccaggctggtctcgaactcctgacctcagtgatctgctcacctcagcctcccaaagtgctaggattataggcgtgagccaccgcgcccagcctggagcccatatcttgggagaaatgagggagttgaggggcaggggaggtgatggaggaatcgagaaatggtggctgctaaggacttcctttgctaacttagcaagtttattttaggctaaacttgttacttcgagatggtcattaagcagaagaaatagagatcatgagccgttctcataggcaggccagggactcaacagtatctgcctccagagagcttgcagcagaaagggaactgacacaggggtgtgtgcgttgaaagggcactggcttggaaattagaaaggctagcttgtggtgctggtgtgagttgtgggaaaaggggtggcctttaccactaactactatgtggcttcaagctactccctttttttttttttttttttttttaagatggagtctccctctgtcaccaggctggagtgcagtggtgtgatctcggctcactgcaacctccacctcccaggttcaagtgattcttctgcctcagtctcccaagtagctgggaccacaggcacgtgccaccatgcccagcttttttttgtatttttagtagagacggggtttcaccatgttggccaggatggtctcgatctcttgacttcatgatccgccatctgccatctcctctgtaaaatgaaattggactgataatctgaggttccttccagttgccccaaatctcgaggaaacactaagcctattgactactaagggtctcgctggtctcatcagtgggtactaagtggggctgcagtctcgagttctggatatctgagagattggaatggatgcttgttgctagggcatgctggagatatggttctgtcggcaaagccctcctgccccagctcccccagctccatcctgggatttggggatttgctagttctgacatgaaggaacccagggactaagagtatcttcaagtgtcttggtcaaagctggcctcaagggcatgagtgattcagggagtctctcattctgcaacccctgcctttatagagaatacctccccaaacttttataagaatccgcatcaccaagtgggagtctgggaggggaagatggaaggagaaggcaggccacagaacagcccactagaggttgtgataagaaatctccaaggagcagctgattcctgtgggtctagatgatggtctgaagattcttaggaacaagacagcactgccaggtcatgcaaaagccaggggacctcagccccaggaatagtaagacaagaaaatacacagctatcgtatccagatcctaaggctcctgatttttggagggaaagccaggtgtgagctgacaagtctttaagggggagctctgagctggacttggaaggctcagccagacacagatcagcaaggaggagagagggcttcctgggcaggaggaaggtctggcccggggaataagatggcaagttctgggaggaagtgaagagcagagggtccctgcagaggtgacaaagaggagcctggccaaagttggccctggtgccccaagtttctatagaccaggggatatcaagggtcagggggaaggttgagactgagtgatggttttatctcttcatctgtctctttatcttgcaggattctcagtaagttaagtcaggaaatcaacaagaacgaagagaggaggagcatcttcacacgcaagtgagtgcggctggtgtaaggaaacgcaagatttttcagtcccgagttgaaccttaaaagggaggcacagaactgtttttgccctactttttgatctgcatttgtcccctgaatcccaggggtctggaagatggtgtccaacgaggggaaggggttccctcccctgctctgcatcctgtccctgggtctgggacatcaggggaacttcctctacagcatcagacagtcatgagcttccagtcatgccactgatgtggcttggtgatttccagaattttcagggtatcctagccccagttgctgagcagcaaggatacaaacctctcttgagcagtgagacatgccctccactggggactccctctcgctggaccaggttgaggaaagagggagatccccttaaatcgagaagaccattaatgcagtgctatttacctttgcagaccccaagtcccgcggtttcctgaagagacaggtaaagctctcagggctcagaggtgattgctttaggaggtgataggtatttcagttttcttgcctttctggttcctggggctccttgagttcattcaggtgaccttactgacttgtctgtcagccagttcttacccagaaaagggtttgggtctagatggaggggaggagatcttgctctgcaggccacctggcttatggcccctgttctgctgggaccatcttcagagacacactgaggagctctgggagctctgtagaggaaaacagagggaccccacctctgagtgagcacctgagcttagctagtccccctgcatctgagtttttttttttttttttttgagacagagtctcgctctgtcgcccaggctggagtgcagtggcacgatctcggctcactgcaagctctgcctcccgggttcacgccattctcctgcctcagcctcccgagtagctgggactacaggcacccgccaccatgcccagctactttttttgtatttttagtagagacggggtttcaccatgtcagccaggatggtctcgatctcctgacctcatgatctgcccgccttggcctcccaaagtgctaggattacagtaaagcagcttttcaactgttcagttgcacatagtgttgcaatgcagattcctggggcccagcctgtcccactgagtcagaagctgtaggcataggcccccaggtatctacaggtcttaaagcacttcctaagtcactgttacacacgagaaaggttgagaaccatcgccaccccctggttctctggtagaatgagcaccttgggcagggtcgctggagctgacagtaagtggctaaacctgcaggggtgtgggaggtaggtggaggccagggaaggggcattggtgagggaaggcatcagatggggaagctgctttgactttccctcaagtggtggcttttcttcagtgctgatggtggtgtcatctccttccacagaaagccacgaagaggacaatgggggctggtcgtcctttgtgagtatggtgtgggctgttcttgcacctttacagcagtgtccagggcagctttgtgataaggagccaggatggagccaagtgaagcggggctctaacatgatgccagcacacccacccagggcccagaaaaggtgctctgcacagggccagacaggaaatagttttggctttgggagccatgcactctctgtctcagctactcaactctgctactggagcacaaaagcagccacagacaatgagcaaacaaacaggcttggctttgcgcccataaaccttcatttgcaaacacagagggtaggctgcacgtggccctaggctgtactttgctgactgcacttcacccactgttaccaacccccacccactaccccccgtctccaaaaatggacactcctagaaatctactctcaagtagcttttctcatggacttaagtccccatcggtgacacggagggaaaagaacttcagaaccaactgttggccctgaaaagacctcaaagagggtgcaatccagttgatttttacattgaaaggtcacagttccccctctgagagtctgacggattgtacaacccctccccaggaacctgtatacacagtcaccacccatgaagcagtctcaggctaagaactctattatggaccgtagcccaatctgttcattttacagatgaggcaactgagtccacaggagagcagaacgtgacgtgcgtagaacacaaagttagttagaggcagacctaggacccaggtaaccagaccctcagtcacgtgggccttctggtaagaggccacctctagtgccttcagaaggcagaaacaaactgtcccttgacctattgggattctggtaaaagaaagtatttaatttgaaaaaaaacaaaaaaaagatttagctaagtttatgctttctacctgaaaatgaaggaatttgacagatttctttggtacaaagggaaaatagcccagagtttccgctggaatgtttctgtttactcacagaggcagaatccttgccatgcagcctctcttgtgctgtgcctgaggctagtcttcgatcctctctgtaaactgagggcttccattcactagtggctatagagcttggcagctccgttatgtgcccagctctttgcaagggcatactgggaaatgagtggagataaaggacccaatcataagcattttacagtatggataccccattttaaaaaggtaaactgaggcacaatgcaatttttttttttttttttaaggagtttatttgagcaaacagggattcatgaatcaggcagcaccaaaccagaaggaggctttgctgaagaaggatgagggacaagcatttataaagtgaatgtagatgtaatacaaagaaaatatttgaaccgggtgcggtggcttacacttgtaatcccaacactttgggaggccaaggcgggcagatcacaagatcaagagatcgagaccatcctggtcaacatggtgaaaccccatctctactaaaaaatacaaaaattagctgggcgtggtggtgcgtgcctgtagtcccagctacttgggcggctgaggcaggagaattgcttgaacccgggaggtggaggttgcagtaagccgagattgcaccattgcactactccagcctggtgacagagagagactccatctcaaaaaaaaaaaaaaaaaaaaaaaaaaaaagaaaatatttgatgggttacagttataaccgatctcatttagtctatcttgctggaaagctcctagttatataattatgagttggctggctacttctgattggttgggcttaagttctgtttttctttaatacaggcatttacaagaaatagcccaagttaacttttgcttatgctgcaaatcaagtaaggtttaggtcactgatgaggcccaactggttttgtctgctcagggattcttcaggcctggtctccattttaatttactttaacacacatatggcagaatataattagcaacaacatcatgcatacaaatttaggagccaaatgattgggagaaaataattgttctagaagcagagaggaaaattctgtcatttgagaaaggttgatggggtaaagagctggtgtaaagtcaggaatgatgggcctagggtagacagggtgaggaaagggtcagcagcctggagggaggccacgtgcctgcggacctccatgctgaggctcttgatctgaagcagcattcctctggggctctgcccacctgctcctaaagttataagaaccctgacagggcaggacaaagtctttttttggagttgggaaggcacccaatgctcactttgcccctctgttgttgatgtttttaatattcctcaagtcaaaaacaaacacaggactctctcaacagaacaacgtaaagacagtctgcctgaggccacccaaagctgtcaggatttctaggacactggaacatttctttcctcaaaaagtggccacttcccattgctttttcccacactgcccttgagtgttgaggtctgggctcattgactcaccccctggactttggcatgaccatgatgagcgctcatcactgctgctgatggtgccgcctttgcttgggaggtcattctgatgctcattcaccttcatggactgcttcaaaggcaagcatccagcacctcgggcttactttccctgagatccaagaagaagcaaaaataaaatacaataaaaaatctaaaatttagagattctttccaagagaacagcttcaaactcagtgtcagatttcatgaataatggatgtgttgatacactcaactttcagcaaaaagaacagcacagcctctgacggtcccctcctcgacacaacttaatctgccttccacttaacaggctttgtttatctgtttttccccttagccgggccttcaacgctgcaccaggttataatgagaggacattttttgagcacaggcacccttgaacagaaatggcaattaactagtatcatcacaaatgctccaggcctttagtctttctcatggtgatgcctggagcaaaaaatgtgtttactcaagacagagcctattccggtaccttctattccagcatccttcccctttcttctctctctgttgtgcagaaaggtgttgtgtaaaaaggtggtccgaagaccttcaccaaggtctcaagtccatgacttgctgcccctgtggtacagtgctccctgacctcagattcctcatctgtaaaatgggagtaaccatcttcaggctgcctggccccgggttatactgttgtgaggcttggcagggagagagtaggcacaggcacatcgagggccacagagcctctacaaactgcactgtccctatcactgtgtgggcaggaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcggtaagggcccgtttctggattttctggcccgagcagcccaaaggcaagctcgccactgctgcatggaaggctgatgccccagcttgcccatgtagcagaaagctctgggtctcgatatctgctcggcttcttaacagctatgtggctttgtacaagtaactctgtctctctgggcctcaatttcctcatctgtgaaataggataataaatgtacagaccacataggtttcctgtgaggactactaagactgcaaccaattcttgcctatggtggctgatatcagcattgaactaccacctaaggctatttggcagtttcaactcattctgcagtttactcaggtactccaagagtactttcctgttcctccccatcttttgaccaaattatagttacatggcattattatgctagaataaacatgaagatattgagtagggtttgactataactttaaaaaatattagatggtgtttacgatttttattgtctatctgtccttttagcccacttctctctccattcattcaacaaacattgttgatctgctgggagcccaggccccattctcagtgcttagaaatgatcaggaaagaagacatagcccctgcctcctggggcttacattctagtagtggtgttgacagaaaataaacaaatatattcttaaataatatactttcagagagtacgctgaaaattgaaggtcagtaccacaaaaaacgaataccatttaatcctttatgcggtataacccatttccattttaaagccctttcacaaaatgctgtctcaatatctcatggtggtttttaaacatctgtgtaataaggacaaccatgatcaagtctgtttcatatacagggaagtggaggtccggaaaagcaatggatgagtcagttgttgagtgccttgtgtgtgccagtcattaagatacagagtgaataagacagccctcgccaagggactgacagtctgtcaggtgacgcaccctccaacaaatgagccatgaggttacttggtgaaaccgtgatacagaggcacgaagacaagcacagatgaggctggagcgtttgcctgagggtgtatctttaagctgtgatattaaaccaaggttaaaggataaatacaagttggccaagtggaaatggatgtggtaagggaagaacatttggagcagtagaaatggctgtgcaaaggccctgaggctcaaaggagcatggcctattagagaagctgagagatggccagtgcgggtggagcagggtggaattagatcaggctgggccttgctcctacccttttccctgtggaagagctgcacctccccaaggctgggactagagtcaggcaagagaggcacccagggcacaaagcgtaaggaggccctacccactcacccctcttgcttgatggtcttgtcctggcctttccctgtcaaaggggtaggaaattgccagcctgtcaacctggcctagggacacttccctggagatgtggataatgtgagtttctgcccagataatgtgagtttctgctcaaggcaaatctagcttccacttaagagtctgtggtctggtaacagaagttggtgatcagctcctccctttatgggaagagatgagcaaaatgaggaagtgtcagggaggagatagcccaggacactggagaggggaaggaagggcagacagaacaagatccctatggcagtgagagctgacttcaccctgcacaggcagctgggtgtgcctgtgagatttttggcatgtgtgtgtgtctgtgtgcactcgtgtctctgtgtatgcatgtgtgtgcatatatatgcatgtgtgtgcatatatatgcatgtgtgtgcatatatatgcatgtgtgtgcatgcatgtgtgcacatgtgtatatctgtgtgtctgcatacagaggtatgcgtatgtttacttcttacaaaattgtctgaaaatcctcccttccagttctggctgagctggttacaaagaggcctttcttgattggcaaaatctctgataaatacctattcctgtgaaatgcaaagaaagctgagcctgtgtataaggagagtgacacaaactaggacagaaaaaatgggcagggaggggtgggtgagatccaggctgggtctccccgtggctgggtctcatgtgggcctgggggtcaaggatcatgcacccccggtgccccgagctgcatatctgttcctggagacccctgagcttggccgatactcccctttcactttaataaccttgtgtttccacagaccggcccccctctgggaaaaccccccagcagcctcctgtgcccccccagagaccgatggccgccctcccgcccccaccagccggccggaatcactcggtaggcctcctcccgttcttttacagtacttggtgtccactgcagttatttcctccgccagagagaaaaataaaactataaacatctttatctcattctaattttgtaagaaaagattataatcttttccctcggctggggaaaggcaaacccaagcattcacacgtgtttcttttttggggtaaaatactggtggtttttatttacttcccactatttgagagaagtgaaaactgtaaaataaacccaaagagaaccgaattaagtccgtggcacctactggtgttgcctgggtaccgagccttcctctctcctgcaaaaagacttgcgccaccttctggccgacacctgaaattccaaggacaggagccttcagaccggaggagacagaggtagcaaaccccgttttctccttcttcgagcatacagcccggtccttgtgaatctgataagttcccagagtgaccctgagaagctcagactaaggacttgatagttaggaatgtgttcccttcacaagtttatctacagatgtatattgcttttgagatttgaagaccttcttttgagatgcaggattcacttatttaatcagcaaatattgtctgagcagctactatgtgccaagcagagttctaggcgttggggataaagtgtgaacaagataaataaggtccctgctttcataaaactcaactagggctagttatcagacggtagacagatgtctgaaagagatcatttgagtagttatgtgtggttcgggggacggaagaccaggtaacatgacggtatgggggggggaggtgacaaggacctgggacagaatgagccagttgtgggaagagccgggagaagaacgttctaggcagaaggaaacaagtgtagggatgccaaagagggcataaccttgagattttccaggaactgcaagaagattctatggtagggaccccatgagtactgagaagggatcacaggaaagagttgagagggcagacatgggccagctcaggcagggcctcgcaggacattaacgagtttcaattttgtttctaatgtgataggaggcttagcaggaaagtgacatgctcactctgctgcctgcagaaaagagcttgcgtggcagagtctagaacagggagctcagataggaggctactgcggtagttcagtgaagaaatggacatggatgtttgtaggcagaacatgaagatgaggaaaagtgagcagatccagacaggttttgggagtgccggctcttgctgatgtattggaagtgcttcctaacgtttggatctttatgcagccactgcccccaccccagaccaaccacgaagaacccagcagaagcagaaaccacaaaacggcaaagcgtgagtacaagggctgctctctcttgccctgttcccaccaggcactcccctagccccgcccaacccccagccgactgctttcttcttttaattgatgtcagccttttccccttccagtccctgctccttcaatagacagaagcacgaaacctcccctagatcgttcattagctccgtttgatagagaacccttcacactaggtgggtatgattcacatttaatgcatagtaataatgataagctgttataaagtgcttcctgcatacgtttcacatgtaccatctcatttaactatggccacaatactaggaagtggagactagtagaatcatcctcattttacagataaggaaacggagacacaaagaggtaccttcccaagatcacacagctaccaagtgttgggagtagcgaccaaagcccatatcagcctcattagaaagctcctgcttgcagcttctgggggctgtgctgcttctctatgtgatgtggatgatctgtgtatacaaatcccattgtccttcagccaagaggctttagggtacagagagaggacctgaattgagacaaaagggttgggggagctgttgtctgctgccttgcctgctacttaatagctcacagaccacagggatgttagtttttcagagctcagtctcctaatctgtaaggtggatgttctgtacatagaaaatgctttataaatccctaaggtgctattcaaatgtcagggatgtttttgttttaggtatgcaattgaccaaacattgggtataccacagtgctttttcttcacaatttacgcagaatattcttggattgcagttaccttcacgtgcagctattttcaattcaattcttagctaccatttattgagcaactgctatggggcaagtgctctacctaccacaaatacacctacagtatctctaatcctcacagcaactcaacaaaggaggtgcatttttaacctcacttctcagatgataaaattaagggtcaaagaagttgaataatttgcctaaatttgcctaaattcgaacacttgtctttctgacttctaagtgggggctcttttccaccatatcaggctgcagttgaggaccctgggttttaacttgctgtgaactacatgagtctgaggaaggaactctgcaactgaacggaaaggagcccagaatcccagctgcccccacccctttcttggctatgctctgagcaaggcatttagctttctgtggcctcaatccctttttgtctgtcaacaaaatgactttcagttcttggatatgaggctgctgctcgctgctctttccccgaactacatcacagctctgctgtgtcatgcaaagctgtgctggctggtttggcttggaattgtctgctgtagagagctgtataattacatggaaatgaagatagatttgacttcagattccaaccctgctcactaccatgagccgagacatcagaaaagtggaacactgacatcaaatccttcgcaatcacctcctgacacaaaagttattcttttaaaatattctttttttctatatttaaaagcatttttaaatgacacacttttctgacaatttctgttttacccttgaattagtccgttttctgtgatgttttggaaggattactgtcttcttaaaatgtttacaccccacctgagacttttaacatgctcagagaatatgcaaaaattggcaaattttgctgggcatggtggctcatgcctgtaatcccagcactttgggaggctgaggcgggcagatcacaacgtcaggagatggagaccatcctggctaacacggtgaaaccccgtctctattaaaaatacaaaaaattaaccaggcatggtggtgggcacctgcagtcccagctactcaagaggctgaggcaggagaatggcgtgaacctgggaggcagagcttgcagtgagctgagatcatgccactgcactccagcctgggcgacagagcgagactctgtctcaaaaaaaaaaaaaaaaaaaaaaaaaaaggcaaattttgaaatacttattcaggccaaagaatataaatttaagtttcctgggtgcccctctaaagtagaggttccaccccaaaccaaacttttataagcatcttttataccgtcaaaactctccccattaccagcaagctcctttttatttttatttttttatttttagttttttttgagtcagggtctcactctgtcacctaggctggagtgcagtgacagcatcatagctcgttacggcctcaaactcctcgggtcaagcaatccttcttctccagcctcccaaggggctgaggttacaggtgcatgtccccatgcctggctaatttttaaatatactgtagagactgggatttccctgtgttcaccaggctgatcttgaactcctggcctcaagtgattctcctgtcttggcctcccagcaggcatgagccaccacactcagtgtcagtaagctcttcacagtgaggcaatattcttatcatgggcctggcatgtacttggtccttaaagaataaatcacgttgtgaaaatacaactccagggagataatatcaccattcgccatagggcactaactgtgcctgggtgtggaaggaagggaaagaaaggcgagttaactaacaattgtcagcccacatggaccatatcaaagtcaaaataaaaacgtagaagaaaatctctaaatttgttttatttaggaagaaagaattgcaatttggggcaattggtcttcagggtcttcagtatgtctgaagaacaaaaagaagattggaggttttataaaaaggagaagtgttacaatatcgctccttgagaaagttcatcggttctgggggctggcaagttttgattggtgagcaatggcagagggcaaaattaatcttcgagttgcagcagattatttcagcaactactagatgaaactggtttcaggttacaacagccaacctcacatagaatcacatttctggagcaatgttatgtgtcctgagtgcttttccctctggcttctcgactctgttttccttggaggtgataaaattcccaatttgtatgaccaactttcacaatcaagtgcctgatcctgcatgcaaattgtcacccaattcttatggcaaacctatagagttttagtctataatcttcattttgagatgataacattgggattcaaaaaccttaaataacttgttcttggtcatgtgggatttgcttctagacctggttgaattttgttagtaatattttcatcacattgaagacaaagggcatatttattctaggggactttagatagaatacaaattaaattactttgaataactttgtgatgcacaattatcaagtacacctggcatttcttcagggagcctgaatatcatccgttctagaagaaaagcaaaacaaacaatactaactaaaaacaagcagacaaaaaagatttgcagcataccaggagagtctcctgaaatgctctccccaagtgaaaagtttcttcagaaactaagtggagtgcttcatttaatatcaagtgtttcacagaattggataaaagttaccctctccgtggcaagtggatttatttcagatataaaaataaaacttaggctgcagaagaaatactttggccaattaaagaggcataaaatcccaaggaaacattaatccttttgatcatcagttatataaaagaaaatgtgattttatttaaaaaaagcacagaatccacaacactacttgtatgtacacaaagctgtgtgaccttcaaattaaatggtcaagccatttaatttctctgagcttataaaatttggtggtctctaacggacccttcctagtctgaagtttctgattctttaatgcttaaaccccatcaacccccaagagggttcagactcatagtttcatcaaactgtgtttttaaacctcatgcttatgaagttctgaactcatggcccatctgctctctgtcatttacaggaaagaaaccaccattttctgacaaggtaagctgtgaacttgttttttggttgtgtttgtttgtttcacatcttgtccttattctttgaaaagtgcttggacactcatacatttttcctcctgtcttgcagccctcgattccagcgggaaggtaagactgttgcatctacatgagggtacatgggacgttctgtagaactctgcctcggcaaagtttgtttcttacacatccttttcctgaactccacaggtcactcggggagcatttacccaagattcaaaagcctcctttaccaccgaccacggaaagacatgaaaggagcagccccctgccagggaagaagccacctgtgccaaagtaattgtctggtgttgcttgagcttgtcactcagagtggccggcagacaggctgccctgtgctgactctgcagtgggaaccgaggctcctcggtgctcccgggcagggtgggccttttcttgctgtggcttgagggatgttcaggcttcacaggttggctatgaaggatcagggtctctttgaaggaaatggactctactgagaaatgagtagagtgacatctaatcaagagtaaggggtgactgctgtttttagagattccagtcaaatatttcattgagttttccaacctcgttatagcaaagccttcacagtgcataggaactgtactcaccattttatttttcaatacaggtagcagacaggaaatggttgggggaggtttttcaggtcaccgcaagtgtcttccttactgctcaaccacatttgataattgcagaatactgagctctgccttagtatttttaactttgctgtgaagtagttttcagcctatttaccaaatggcgcgcatgtacctggggttaaggccaaccttgctacttgcaaagaatacaaccaaagcttccatctcatttgtgaatcaggggtcataactatcacccttgcttggctgttgtgaggattaaattaggaccagggctaaagtgtgccaaaaaacctcctcagtaatggagtttgataacattttagagtaatgtttttaaaaaatcaaaataaatgcagcaaactcataaggaacaaaattccaaaattttaaataaacacagaatgagatgatgatgtgtgaagcgtctgacacacaggaggtgttcaacaaattgtccagctcttccccttctccccagagaggacattatacggcccaggcagtgcagatgcctgtcgcagccctaaggcagctgtccccaagtctgtttgactagctcattcatctgggcaaagtgtaccaagccccctttggaatagtcccaaagcagcaacattttctaattgtcttctctttacaccaaggtgggccctgagagggctgttttaaaacaagagcaagggagaatattacctaaaatgttttcatttcttgggaaaaacaacagctcagtaaaatttaatagctactaaagagttagtttgctgactaaaccacatgtgtgtgtgtgtgtgtgtgtatatacatatagtgtgtgtgtacatatacatatagagtgtgtatatatatatatatacacacacacacacacacataattatttgctgcattagttatgcagaacaaaggtttgcctagctcagcttgcaatgatggcagaacatggagtaaccagatctcccttccaccccctctcccctgctctgtgggggtctgttgcttcccatcttccctaggctcagtgggttcgatttctcattattcaatgaagcaaaactgtattctaaggctggctctttgaaactcttcatgctcagttctttttatttgccctaattcatttcaggcatggatggggaccagacagaagagagaatgtaagtacaaaatgtcagtttgtaagtgcttgatacagggaaaagaagcataggctcttaggaggttgggactccatccaccttggccttggcccagaacctggagcaggtcctgcacccaggggtctcgtctcttaagggctggtgcctctgtctttgggccttggtcattgtctggagcccatcatgctgtgttgtttagctcatgtccctctaagagctcccagagtggctggcttaattgcagctccattaccaggggccggtaattacagggcacaaggagaaaaagaggataaagtaagggaaggccagaagtttggaccatgcctaaatttccaaggctactgttttccttttcaatacttccacaacctgaaaaagaggggaaatagcatttcttgaatgcttaccatatgcacattgccatgccagttaaatatgaccagttgtccctgtttgcgagggatgctgtcagttttagcactgaaaagtcccctgtcccaagaactatctccatcctaggaaaaccaggatagttgagtatttctcgctttacatatgagtataatgaacccataaggaaacatcttttctcttttacggagaggaaattgaggctcagaaggaataagatactctttgcaaattgcatgcttataaagagccaggatctgaacccagatctgctgagtttctctacaccataagccctctgaaggccatcagacccctgctgtcattcaagggctcagcccaaaagcgcctgctatttttgcagctctgtgctagatgctgtgcttgttccgatgaagtgctgagatcttatggaggcaggcacactcacaacccctcatgccagacagcatgcaatcacgggatgctctgtggggctgagggaagaaagtgtgccatgtggctcaaggagccagcagtgacttcctagaggaggtgagatttatgctggtcattcaatgatagggaggacacagaatagagtcattcttaaagaaagcccatggggattcccctcaggagtgtcctgagcaggtggataccagtgcccacggaggctgcagggacagtgagaacagtggcttggctgcagagataggaacaaggcagaggtaaggctggacagtgaggataacatcacattccaggttccctgtctctggaaggattgacacttgtgctcatgagaatctgggagttgtgttttctggaaccagagggaatatacttgcaaaagtattgaaaagtgattttgttgtgtggggtttatgagcccatgtgtgtttatttatgcagctctttgctgggactcccagttggccaactgggatgaatgattttgactgtggcctttttcgccttctctcagtgtgtgataggattgatgatggcaaacttttattaaagagcacttaacataagccagacacaagtagtagctaatttaatccttctaacaacactttgagaaagatgctgtttcatcattacagatctggcctaaccaaacaagttcaagctggcccttttggtctactagttggtggcaacatcattttttctctttgaacctcatttcttatctgagtggaagagaaaatagcccctcccttgtctaatttcccaaggttgctctgaagataaaaatggtgagggttgtagatgaaccttgtaagccaccgtataaatatggtcttattgatcttaagaagagtggccattgcaaaagagagccaaaaagaagactgagctttggtcagacatatttggggttgaatccatctctgcaactcctggcaagctaaggaagcttcctcagcatcatgcttttgtaaaatgaggatgttaaatttttggggggtcactaggggaactgaatgaaatcttgtgtatgaatcttttggacacattgtagatattgtcaatattattacatctttgggcccttttaggcacctcagaatctatttcatgctgagtatatgaggagagtctcatactggaatgcccttagatgactgtttgtattaagaaattgtaaaacacttagcaacttctattattctccacagtatatttattatgaaggtgtataactgccagagaaagaaacagatacctatttgatttatttgattgagaaatgcagtttttattttaagaattgtattttgatgatagcttaatatctttttttttcttccccttcccaggatgaagatgatggtatgttcggaaacacattcttacagcctataactcattctttcattttcctgctcaggcattcaagtggaattgtttagtacaggaaccccatagaatcaattataagtcttaaattagtattaagtagacttatgtcaattggcatactgcataactatcgtaaaatggattacttggttagattaccgaagaagactaaattcatgtgtaacagtgcagattatttaattgtatcacaaaatgtaaaattgcatgcatggtttgatggaaacatttctcacatttatgtcttctaacacacgtgggtaaagaatcagtaactgccaatgaatgagatagcataaaattttgactttcataaaacaaaacttgtaaatcatttctgaaatttataaggtttccagctgacaattttctgccaagttaacatttcaaaaatgaaaaacaaaatcaatgtgtattttagagtatcatctagatctgcgcccctttgtaaatggattctatggtggttaagtcatctagaaacaccctgggagcaaggttccatcctactacttcctaattacatctgatctgctttatttttgtgtcctctttatactagctgtttctaactggggggcggttatggaatgtttcttagtgacagctggggcctgccaatctcattcattgttttctacttctgcacagtgcatcagagacctttgccccagccagcactacttcctatgagctccaacactttcccttcaagatctactaagccaagtcccatgaaccctctcccatcctctcacatgcctggagcattctcagaaaggtttgtagctctgtcatgaaattctagcttaatataatgtttaggtccatccagtactgaagtaatgccaggcagattgagaaagaaggaaatgacgggtagatagtagggtctgaacattttgggtcttaagacataaaaccaaactgagcattaagaacgatatgttaatccaccagtgtcctctgagtctctgcttgaggtgagaggggtgaggaattgacttcctccttgatccctccagatagaatgggccttttggtagaaaacaaagaatattttcactttatgagttcaaacaaacaacaataattaagaaacccagttagtctaagtacttgaagttcatctgcatcttagttggggagactgagaaaatgcgcctcgtgcttggctgatgctaggaattcattgcagtctctgtccccctgttttctcagtagcagctgtgtttctcagggctggtatgaggccgcccaggggcagatgcatgaacaggagaaaggcccagtcattgtccccaaacaagcccacgggcagcctgtggtgtcccccaagtcctccagccctgtaggcttaccttctcccttaatattcaaggagagaagccaagatccttccctaatattgtagaaaactcaaccacccacaagactcatctacccccaccaactcctagcaggattctcacaatgtttcctctgccctgggaccctctggccctgagtttctgctgctcttctccctcttcccgctggcatctgctgcccttgtctgctgaccctcctgctgctttcctccatgctagccccaaccccatccttcatttgcacaaaatcccactcacacaaggttgctgtgcagagcagacttttcccaaaggtttagactgatgggtgcaggagttgctgctcagtgtggagggaacagactgcatttcagggccctctgggcccgcctccccaccccagccctgcaaatgctatcaccgtctgctgcagagcccacctaacatgcacttcccttctcacctggcttactctctccttgcagaccctaagccctggggattcactgctcaccaaagacaagcccattaatataatttcctagcaaaagggaagtcttctgagaagaggacttctgtattctcccaactcaaagagctcaagttgcagccaatttttaaagtaactgttaagtgccctttacacagttgaatgttgttgctgttctgctttataaagcttgttagactttggcatggtccacagcggaatgtagttccattccctgtgtgctgtgttctgtccctgtgcccagcccccatggttttgggggcagcagggaaagtgataccaaatcaagaagcatttgcagcctggcttccctaacccagctcccctgtctggccccatcaccccaatccaaataaattttgttctttttctgtctcctcagtaacagcagttttccacagagtgcctccctgccaccatacttctctcaaggtttgtactctgggcttttgtgacgtgcttcagccatcaagcctttatgactggatccctaacctgtcccaaaagctttcgacaaaggttttattgtttcctaaaagcatctgatttcctcattcaacatttaattccgtgtctgcagtgtgccaagggctgtcggaatgataggatagtacctaaaacacaacacatacacacacacgtatacatatacatgcccatacacacatgcacatatacatgcacacacacacatgcatacacatgtacacatatatacatgtgcacacaggtatacacatatatacacatacacaatacatgcacacacatgcacatgcatacacacatacatacatggacacacctacacacacttcaccaggaagccagccctcatccccaatcttcctgtgcagaactattcctccagctccggtttccctacggaatcctcagaatcctgtttgcctttctctgcagttttagatttccatgatcaatctgtccatggttgtgagttggggagcatgttcaaaatacaaactaagagaacttaacgtcacagattctgattcagtaagtccggagtgaagtcagggacctgtgtttttaataataccacctctggacgtccatgattagtattcgcttagagtgttctgcaacttgaaagtgcatatagatcacctgggaattgtgttaacatgcagattctaattcaggaggtctggggtgaggcctgagtttctgaatttctaacatattccatgcgatgctgtgactgctggttcatgaaccactttgaaaggcactggggcaggactaatttgtgctttttatccttaaagacttgcaagtgacaggcacttggtaggcactttaaaaatgcttgtcgaatgagcatcaaatgactagggaaagttacccaactctagtaagtagcattccaggaaactggcttagcattgccagattttccaatttttttctcaagaaaagtgaaattatttaatttttaaatgttgacttaaatttttaaaaaatgctgtgaagaatgacaacagaaaagccactttttttgcagtcatgttccacatgcagtgtgtgcacgggccagtgtgtgttcagtagaaaactatgttagtaaatgtgagttgatagcctgagaatcaacattttttccaagaacacatctagggtattcagttggatgcatcattccatagaggggcgagatcccactgctgacgccagtggcacccactaagttttcaatgttttctaagcatttgaggttatggtggtgtccacgttcaccacatggttttcacagtttctcgcccaacccctaattttccacaatccccaaaattctctgtgttttgcaaacacacatttgtgttacctccttgcctctgtagccatctgagtcccagacacatcacagcattattttccaaagcaagttccacagatctccagttttatgagtctgtgatggggcttattaatgcaaatagttaattatttttggaacattagcttgatccaaattgatctcttttcccctaagactgccaggacacctggtcctcggtcttctctactggttctactggttgttccaacatcagaaggataaagtttgtgctgtgcattgcccaaaaacctgtcatgactcccttgagagtctagatattaagggtggtaggtgactgcaataaaaaagtgtatgtgcttctctgttgtaacttagaactctatgatgctggcctgcaggtgcagaggcagaaagagaatcatttcttaactgtagaatggccatgcaatgcgggccttggttctgttactctcctgtattgttaggtttcattcattcaacaagcattataaaagtgcaagtgttggactgcaaaaaaaatggggatggggaagatctgtctaggcactgggaacttggagaaggaaggcactggcagctcagggccagcttgtttagaaacagggaaggagcatcttaaacaatcctgttgatgtggctcaggagacttgtttaaaaacagggaaggaccatcataaataatcttgatgatgcggctcaggaggctttagcccttacaggtgactctcctctcctcagtggtgtaacaaggtagacgtagtgacaatccgtggtgtagaaccaccggaagtacttgctaacatgcagatttctgagccccaggtgctcgcaagtcgcccagggattctgactcatgcacagtagcatttggtaaccacaggtttaagttttggctttgccactgatagcgcatgatttgcttagcctctgagcctgtatttccccatatgcaaaatgaagacaatacctaccttgtaatgttgctgtgaggattaaaaaaaatgtacacacgataccttactcaagatctggacagagttgtgctgaataaatatttgttgaaggtatgaatgaatgatggttaaataattaagagaacatttgactcacagaatttttctgtttttaaccacagcctggcacatagaaaataccctgggcaactgcaataaacacaactaaacctttcctgagattaggaaacattctcctaaagtttcaaggaactgtaaatgagaaaaaagagttttagagaagatgaggcacaagcactgggtaattaatagttgcccagtaaaaacttcctgatctgtagtgccttctatgtgagttgaacagtctacctgtttagttagaacagcgggtagccaactttgattctaaaagctagcaatattctcaaggtaattttgtcttctcttgggtcacttacatttctttttgtggaaacattaagaacataattatcttcatcattgcattgtccctacatcagctgttgggaatccattctgcctatgatgatattataagaatctatgaaaaatttgtctcttgagcattcattttgacgttcacattcattaaaacaattgcgaatttttttataaagggatctagtcactttatattatgtaacatgcacatttagaaaaatcactcaaagttgaggttctcttctcaaagttttactggcatgattacagaataatgcctgagcagcccccatggtttcaaacagatgaaaattatttttgaagcccttgtttcttaaaatgcgaactataggaccaatcgcaagggtatttttttgggggagtggggggaatgtgttttgtgttttgatagcagcaaacaatagcttacagtaaattaactgtcagaattctatacttttgaaggccctagcaacagaccacctatcagagccgaaggcagaaacttccccttgccacttccaaacaaacctcggcccccatcccccgcggaggaagaggtaagagagcatgtttttatttttgtttgtttgccttttccctggtaaaagaatcaccagaaactcccattgaatgttcttctgtacttttatcttccctttgttttattttatttatttgaaaaaaaagttaaaggagaagatccagatgaacaatatgttcttttcccttggcgttctttcagacgctttcaatggcaaacatgtgttttgcattaaacagcaagaaaaataatcctgttttttatgtttatgaccttgattcgtcacttaactgctcaataacccatttttttaatcaagcaggttattatgctaaactgaagaaattattgtatctgtatctttcctgaagaggttccatactgtaaggaactcttattcacaggcatttttgcaaccagtgtcatgataaaaagcagttcgcacaaaatatcttctatttagccccagctaaatgactctgaatgcaaattaagaaaacaaatgtttcagacctcctggaattgaggtgttgatttatggaaatgattactcagaggcttttcttttcacttacatctgtaactgtaaaatttattcagtttctaaaaatttacattttcagaattcattaaatgaagagtggtacgtttcttatattacccgaccagaggcagaagctgctcttagaaagataaaccaggtattgtgctatagtttattttaacatagttgtaaatattaatggcagagaagggaactgacctgtcctgagtaccaattacaagctaggaattctgctaggtgctgttgctttctgtaatacctaggagacccattagtgccagcttcacaactaccagcacccatagcagggattcctaggctcgggaatcattaggctggcagaagaatctcaaggcagtcatttggttggcagcatcttaggagattttattaatgaaagagtctgtcttgtcataggaatcacatggtgtcagaaggagactctctttcaaagttccaacatcgtaccagttctatcttcctcttaacacagacgtgccatccatgttgatgtgaaaggaccaatattaaagagacggcagcaactttttgctttttgccctagacgtttctagctagtcctttaatatcataaagtcttaaacatatttcccgtagccagtgccgaaactttaccttagatttatttatcagaaatgggaaagcaaaaatctttcatctttcacacttaaactccacaccagtagttctcagtagtagttgcacatttagatcacccggagaacttttgaaaaatcccgattcctgggtctcaccttgagattctaattattctgggggtgctgtgtcagctctgggagtcttcaaacttcccaggtaattctaatttgaagccaagactgtgaatcactggtccagaagtatgtttgtttagcagagatgttctgacaggctcaattaacttgcaataaaaggaacaaaggaaagtcattattgccaactcatggctatttaaagctatcctgatttggtatgaggagaagggagtagtttaaaggagtccttaccaattaattctattttaatattagatctttacagtattaatattatgtagcaataatttattgaatggaaatttaaagtacaggacaatcaaaacagtagtttagcaaatatcagaaaaaagaaaagaaaagagaacatctgcattcaattttgctcaagggtctgatgaaggaaagactatctagagatcacagggttttaagaagggtgaatttcatggcatgtggatgttttctgactttggatgtggaaaagaaagtttagggaattaactcacaggaatactaggaagatatatcttgagttaaccaataaagtattttatttctcctggccttttatccactcaaccacccattatttattactgaacaaaagattccgtttttatcaggaggctttaacgagattgacttggaaatttctttgatacaatctctgttgcctttcttaataacaaaataactcatgacacatgggatatgtagctgtttggagaactgaatgttcgttgaatgacaggttttgcactcaagaagctgcaaagtgcaactgacatgtttgtcagatccctagaggcttgtctactactcttacaagcaacaaaaatattgacttttactgctcccataataacaggaatttgtctttttaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggtaaggatttcaaatttcgacattttcccaaagtctttatttatgccactctgcatgccttcatggagcgatctttgagagtccgtgctgtatggcaaatttaggattaaatcacatgagtgaagcccttcatttattggaagagaaataaagcaaaatctttacaatggttacttctgccataggattctttcttgtatatcttttctttcaaataatcacatgtataattttcaaaatcaagaaaaactatgttaacttaaaaaaatctatttagatggtgtcaaaggaaagttcccactattattcacctctgtggcataattttaacgtaggctgcattttaagttgacaccacctggaaaaggggaaaaattagaatatttgctggggtgattattcaaatacttggctcatttcttaacaaaatggaggtttggctctgtgaggatggccagatcgccaaagaaattctctgttaggccaaggtttagattctcatgccagtcactttttgagtgctaatcagaacggatggaaagaaaccctcagggctagtttttcgcaaaggaaactaacaactgaaggtaacgccccaaacatactctaagttcaaagttccaagaggaggaccagctgaatcaaacatgtccagaatgagaaacagcttacccataacttctgcttcacatacttctgttatgataatgttaatgaatagaaaaaaaatgcatgcttgtgatcaaatgtttgaatcgctggttggcagtggatagagctgcacagaccctataggagcagaggtatttgcccttcaagatttatcttggtccagtgtggaaacacacaagtgcagaccaaccactcattgcagctcccatggagggaggcacctagcagattagtcttaaaggaagtgcattatcctgttagggttcctaggtgagttgtgacccacatctagaaaaatgagttaggcttttccctctctagcaagcaatcaaggctggggcgatccaggctatggctgcaaatattggttgctgagcctttatgagtgtgaaggtggcagtgaggacacagcagagagatcatgaaggaactcctgtgccatgctgcagatcccacctctagacaccatgaaccgtgtctgacctcctgagtccttatgtttcctaacactattaatgactgggggtgaaatagagatgcagaaaccaaaaccaaaaccaaaaacagagcaacccgaggcaagaatattgtaatagtgactatttaaatgaccccttcatatgaagttaaaaatatatgcatttcaaattacatatatatatatatagatatgtagatatatatatatatatatacacacgcatgcacatattttatctatttttttttgagatggagtttccttcttgttacccaggctggagtgcggcaatggcgcaatctcggctcactgcaacctctgcctcccaggttcaagcaattctcctgcctcagcctcccaagcagctgggattacaggcgcacaccagcacgcccagctaatatttttctattttctagtagagacagggtttcaccatgttggtcaagctggtctcaaactcctgacctcaggtgatccaccggccttagcctcccaaagtgctgggattacaggggtgaattactgcacccggcccatattttatctttatctatggtttgttggatgtttatgaggaattttttcaaagttctatagcagaaatcattaaactaattgccacatttacattttttccccccacaatcctcatcacttgaagaggcagcatatattatgcagataaaaaaactgaaagtgaagttcctgcttttcattccaatgttgactcatctccctatcttgactctttcaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttacttttttggtttcctaaaacaactttattgacttttagtccatactgttatatttttgtcttaaagaaaatttaaactacaaataccaaaagaaaacattttaaatttagggatgagactttggtgtatcgtgggtctaggtttaatgaacacatctggggttaagttggcatttcttcacatctccacacccacaccaaccatcacagccccccaccaaccttctcccaaccccaaaagcattgtccagggatatagattttaccaaaggcttcctgggaagacgagggagcaacactttagattaaatgtgatcagactttcctattagatatggctcttctgtctcttgttatccccctgacagctctgccataaagtcccttctcctcatccttcccaaacaggctgtataagtgctttgaggtaattaaactctttcctccagtttacaaatatcacttaacaaaaaatataggcattcagccagattaaaaaactggtattcagccaaatagtgacaatcagttgttcttcaagtttttccctttgggaccttggttgttattgcacaacttttattagcaacaatttttggcgtctctgcttaatctacaagttttcgaaatggaaaagagtatcttgcagcttcattttcatgagctaataaaaggggtattggaaggaatctaagaagtcaccattttaaaactgatgatatgttaaaataaggagtatgcagaaggtagagacttttaactgatgataaaaatggtgtttcacaaaatctcatccttaacaaccagaagttctcagtttagggtccaaaacttgggagtttaaggctgaaaaccctgcattcatttacacgtctacacaacgggctattcagcaagtatttacttagtggctcttctgtgttaaacaagtgagctaggtacaaggtagtaaggatagcatacaccataggttctagtatcgagtaagctccacttgtcttgctttgccgtattctatctttacaattcaaaaatatctaaaatgaaggacctgatagatttcaaagcaactatttggtagcgaatcatgtttataaaacaaaccaaagctcattttaagtctattagtggaaagtgccatcaggattaagatgttctgttccatggctatgactgaaatcaatgttgggaagctaatgttttcatgactagcattctctctctgttcaagcaccgacaactccttttggctgggccttgcctcttttggccacagaccttctatatgaccccaggtgcatcagtcacagttgctcagaaccctgctcagtgataaacatcttactaaagctgggtcaatcagggtcactctctggaatgttaaacatgaagcctgagacaagatctctcttttatctggggtccccaaaggcaatgctgtacacttggagctgcctgctgccctgcaactactcccatttaccaattatctggaagaaccagtctacaatagaagacaacgaggccaacacacaaaaacacagtaaaagtatggacaaatta

SEQ ID NO: 16093 - DNA, 97376 bp, Human
  misc_feature (1)...(97376): n = A,T,C or G
tagaagttcaaatttttttctgaacaccagtgaaaacaaagatttaggaggggtggttggtagcgtggatgtggaaaggagcctagcagtagactaggtaagaaataacagtatcttggattatggaggtagtgatggagagaaggggatggatttacatgtttagtaagtaaaattggactgcgtgatggcttggatatggaagttagggatgaataaagtgtcaaggatgactctttggtttctgacttgcataaatggattagagagtgagacacaggcagaggccataggaacaggttgggtcattctgctcagtttttctttggaccacagtagagaccacagcacactgctctttcaatactctgttaaatgacaaacttattacaggttatttctgtcataaacataaaagcttcactctgtcaattatgtttcctatcttgcgttaaaaattacatagtcaaaatttcatccattttcttttaaaaatgtggagttaagtcttataaaatggggaagtgaatgatagttgctgtaacaggctaatagaaggtttagcacccctcttctgtatactaactttttaagttatatttattcatcccttaagatgtgggacaggtggaaaaattacctttccactttgtatttatgatttctaagtactaaacttttaaagcctgttaatattatcccttcccaggtcttagaataattacacaaaagtactggactggtttaaaagatatttgattctagtctattttgttcatttgtagaatttctagtggtctaaaaacgattcttttacaaatcaggagaaataggaatacctactatcggtttgaatctcaaacgaacagccacaagaaaaatggactttttaaaaaaaattatctaacagcatgttgtcccaataaataatgctgaaggagattccttctcgtttcaaatttgccagaaacttcccgtttaacctcagcaaaatacagatcgttttgatctatggcgttaccgcacaaccctgtcaggtcacatcactaaactgcagataacagcgacaaggccgaaaactatgttagacggatccgcgtccataccccccatcagttaattttaactcttcattcggtacaggtcactctacacatgcttccctgcaaaatgcttaagctagacacagtgtacagataactttcacagaaccgcaagggcttgatgctcccccaacagaacggcttgagctttccccagcgcaattcagaaatgctgtggcggtcgccagactcttcgggtagctcccggcagctccgaggtagcgctcccctccccaaccatcgccctccgggatgggccgcaccgaagagcccgctcctcatctagggcacgaagtgcgccgccgagatgggcagctggaggaaggggcgtgacgcaagtggaactcccgcgtgacgtcgcgcgggctcccgggcggggcgggtccggccgcctccgagcccggccggcagcccccggccttaaagcccgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtgagtaaaagcaatctctttaccccacccggagctctgggtcggagcgactgcttctggtctggagctgcgtgcttggcgaagggctcccggggtaggggtggctcccggctctggggttgtgtctgatgaaataggccgggcccgggctacactcggtggtggtggaccggcgggaggacgagcgctacctcagtactacttctgggtctcccgcgcgggctgaggaagcgcctttcgccgccaagcccgccccgcgcatgcgccgactgcggctcgcgcgcgcgcttgggaggttttttggccagacccgcacgcggaaccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtaggtggaaagggttttgcgagccagaatttgcaagttgaatgttttgtttttatgttttgtttttaaagcactgtacatcacttacttgaagatagatacgtaaaggatgcttattttacactctttaaacgaatatgttaatactttttcggtcattgaagtaattaaaccttcattttaaactgttgacttaatagaaatcgtttatgtcttctttttttttctttttgctgcagagaggtattttttctttattttattattattttttatactttaagttctagggtacatatgcacgacgtgcaggtttgttacatatgcatacatgtgccatgttggtgtgctgcacccattaactcgtcatttactttaggtatatctcctaatcctatccctccccccaccccacggcaggccccggtgtgtgacgttccccttcctgtgtccaggtgttctcattgttcagttcccacctatgattgagaacatgcgggctacagagaggtattttacagttattggtctcatgacttgatttccatccctgacatagccatgtcccagctgtgtgaccttggacatttactgccttacgcctcttcccccaactctaaaatgaaattatagtagctgtcttacagagtttttctgaaggttaggtagaatataaatattctataatatataattatatattaaataatatataaatacaaatattaatattaatattctacagtttctggtatgtgggaaacaaatggtgacttttattcacaattatatataggcccatttgtttatctgttagagttaaagatagaataaaaacctctttggtaacaaaactaatgcagtgcacctaattctacttttaaaaacttttttacagaaataaatgtacacaagagaaatactggaattatgaaccccattgtatacgcacccacccagcttcagaaattgttgaagttcagcccttgtttcatctcttcacccaacatccatttttgtttgtttttgctggattttttttttttcaagcaaatcgcagagtatatccctttacctgtaaatatctcggtaaatatccctttaacagataaggcctttctaaaaaaaaaacaaacaaaaccgcatcattatcatacccaagaaaattaataatttcctaatatctaaaatccagctcatatttagtttctggattattttttaaaagtctaatcacaatttttgcaaagcttgatagtttatttttgtagctcttgacggttcaccaagtggcttcacatatactcctgctcccttcagaattactctttcagcccctttgtcagagacctcaggaaatggttagcaggaaacaatcagtttgctttggctaaggagccagatgtgaggtttagtagacttgctgatcactattactttttaagttgtagctaattaatggtttcattttaagaacacatattaaaatatttactaatccattcaaacttcttaacctgttggtttcttcaaggactatgtaataaacttaatgattcacctttattctaagagaggcatgaagtaacattaccctaattgtcttatgactctaagatgtttctgtattcatagatctttgctgtgtttaaatcttactgacttctcttgtttttggaaagttatacagatcctcatctgtgttaatacatcagtcaactgtctcttttataaaatatatatagatatgtgtatatatgtggatgcttgttaagtcaagactaagaatatttttcagttttgggctcagtatgtttcaccaattcaaaagttaaaaaaaacaatttttttttttaattgagacagggtctctgtcgctcaggctggaatgcagtggcacgatctccgctcactgcaaattccgcctcccagtttcaggcaattctcctgcctcaacctcctgagtagctggggccacaggcacgcactaccacacctggcaaatttttgtatttttagtaaagatggggtttcaccatggtggccaggctgatctcaaactcctggcctcaagtgatctgcccacctcagcctcccaaagagctaggattacaggcaagagccatctcccccagccaaaacaataaattagtttatagtggtaaattaatactgaccatgaatgataaaaacccctcaatatctgaatcctttctgtttaatataattgagataatttcttcctctaagagaaataagaaaatttgcctgaaaatttacctcatatagccaaataactgaaatcagaacttttctcaccattatcatctttccttattctttccttcccctcccaaattctaaaaatgattgattataggtaaataaggaaatggtaaatgaggatatctgggcttgtgtttcatcctgatttcaaagtacataaagataaatgcaaagttcatttatgttgcaatctgtcatttcaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtaaaatcttttcttaaatacttacagcagtattttgttgagactgtagtggctttgtatacctttgtatgacagtcctgtttattatttctatttcagcttttaggttccgggggtacatgtgcagatttggtacatggatagattgcatgttgctggggtttggtgtgcaaatgatttcatcacccaggtagtgagcatggtaccccataggtagtttttcaatccccaccctcttcccacccccctgaccctccaccctcatgtaggtcccagtacctgttgttcccctctttgtgtccatgtgtactaaatgtgtagctcccacttataaatgagaacatgcagtatttctgttgtctgctcagggtaatggcttcatctgcatccatgttgctgcaaagaaaataattttgttcttttttatggcttcattgtattccatgatgtatatatacttttttttaattcagtccactgttgaattttgtacatttaatggccatctttaaattcaaagatatcttttttttttttttattttttttgagacagggtctcactgtgtcaccaggctggggtgtagtggtgtgatcacagctcactgcagcttcaacctcccattctcaagtgagcctccctcctgtagttgggaccataggcacacgctgccatgcctggctaattttttattttttgtagagtcagggtctcactatgttgcccaggctggtcttgaactcctggcctcaagtgatccttctgtctctgcctcccaaagtggtgggattacagacgtgagccactgcgcctggcccaaagatctcattatttatttatttatttatatattcatgtatttatttatttactaattaattttcagagaggttctcactccgttgcccaggctggagtgcagtggtatggtcacagctcactgcagctttaacctcccaggctcaggtgttcctcccaccttagcctcctgggtacctgggactacaggtgtgcaccaccacgcccagctaattttatgtattttttgtagagacagagttttgcctttttgcccaggctggtcttgaacttctgggctcaagcagtccactggcctcagcctcccaaagtgctaggattacaggtgtccgctgctgtgcccagctgatctttttttctttttctttttgagacagggtcttgctttgtcacccatgctggagtgcagtggtgcaaacatggctcactatagtgtcaaactctcgggcccaagtgattgtcccacctcatcctcccaagtagttgggactacaggcgcacgcaccatgcccagctagtttgtttttgtttttgttttttttaaacttatccttcaccttagaacacctagctagtttttgtattttttgtggagtcagggtttcgctatgttgcccaggctggtctcaaactcctgagttcaggtgatctcccgccttggcctcccaaacagctaggattacaggcgtgagctgcgcccagccagatctcatttttagaggacatttacaattgtagtttttgtgattcatttttatggtcaaattggtgctttttaaccacagaacatagtttgtatacaacttgctgttatttacttgtggtaatatgtatgagatagtggaaaacgtatacaatttgttgactgaagacctgcatttgaattctgatttcatttacccacttgctctgtgatcttagcctaattacctaacctctaaatttaattttcttctataaaattctttgcaggatatagacataaaaatactacataaagtcatttgacaaacccgtagcactgaaatacaaaagtgaatggccacttaccttcagacagcctgcagtcttagtagagtcgtgtaaacagataattacagtacagtgaaataacagttaaaaggtttttatgacgtgcaaggagttttagaggattaagcaattgtggttgagatgagtaaatattatttgtgttaaaagatacaccatatgaagctaagctcaaggttttaatattaaattttaatatactttaattctgtaactttccctatgtccctatgtatgagaaatgcttcatattacatttgtttcttgattacctattataagtttaatattgcagtgctttatagctgtatcattacactggagtactattaaaacataatcaacctgaatctaaagtgtagtatgtgagtctgtattagaactttcttatggtaggctgggcacggtggctcacgcctgtaatcccagtgctttgggaggccaaggtgggcggatcacctgaggtcaggagttcgagaccagcctgaccaacatagagaaaccctgtctctactaaaaatacaaaattagccgggtgtggtggtgcgcacctgtaatccccgctactcaggaaggctgaggcaggagaatcgcttgaacccaggagaatcgtttgaacccaggaggcggaggttgcagtgagctgagatcacgctattgcactccaccctgggcaacaagagcgaaactccgtctcaaaaaaaaaaagaactttcccatggtaagtttagtttcttgcaaaacttctggtgacacccttattaattaatgagttttgaaatatgaacaaccccaaaagtattctttcaagccccagtgttcatggagacacaaagaaatgttcaagaaatgttttttgggcacttactatgtgccagaccttgtgaataagaataaatcctatatagtgctagctttaagggaatttctagtctagaattttaatgcagtatactatgttattatctgaaaacatgaaggaagaactgagggtgtgtgtggttgcatggggaagtgggtttgtgcatggtttatgtcagaccaggcttgataattaagtctaattagccaggcaaggaagatggtggaaggggagggaattttctgagtagagagaatagcacatgcaaaagtttgcagataagagcttgattttattcaaggaactctggatagttaggtttagttctaagaggaaatggaatgggagattggagttttgggggaggtggataggatatgatgctagaaatgtacatagatccaaattatgtaaaatggtatgtgctatgctgaagagattgtcatcttgccttgactttaggacagatttctctatttctgcaaaaaatgttgggattttgggatttgggattttgataggtaatgcattgaatctgtagattgctttatatagtattgacatcttaacaatattgttttgtagtccatgaacacgggatacctttctattagtgtcttctatatttcttttttttttttttttgagacagagtcttgctctgtagcccaggctggagtgcagtggcgcgatctcggctcactgcaagctccacctcctggattcatgccattctcctgcctcagcctcctgactagctgggactacaagcacccgccaccacgcccggctaattttttgtatttttagtagagacggggtttcactgtgttagccaggatggtgtcgatctcccgacctcgtgatccgcccgcctcagcctcccaaagtgctgggattacaggcgtgagccactgcgcccggtctatatttctttttaagattttttaatttttaattactaatttttagagatgaggtcttgcctcattgcccaggcttgagtgcagtggcacaatcatggttcgccgtagcctcaaattccagggtgcaggcaatccttccgcttccaccttcagagtagctaggactacaggcatgcaccaccgaacctggctaatttatttttttatagagacagggatctcattttgttgcccaggctagtatcaactcctgggctcaagcagtcctctgacctcattggcctccaaaagtgctaggattacaggtgtgagccaccacacctggtcattctataatttctttcagcaacattttctgattgtcattgtacaagttttttgtctccttggtgaaatgtattcttaagtattttattcttttgatgctactgtaaatagaattgtttttttaatttgcttttcagattgttcattgttagtgtatagaaatacaactggttttagtgagttgattttatattctgcaactttcttgaaactcttgatttctatttttgttttttatgttttgaaacagagtctcactctgtcacccaggctggagtgcagtggcatgatcgcagctcactgcaacctctgcctcccaggttgaagcagttctcctggctcagccccgcaagtagctgggactacaggcacgcaccaccactcctggctaatttttgtatttttagtagagatgaggtttcaccatgttggccaggctggtcttgaattgctgacctcaagcaagccgcccatctcggcctcccaaagtgctaggattacaggcaggagccactgtgcctggctatttataagctattaatttaatagaaataaaatatttgacagatttcttcttcctattctttggtgttacaggatcttcatgaaatccctattttacagtgaggaagcatcaagaaacaaatggtatactctttaataggaacaatatgccatatttatcaaattatagaatatataaagcttgcaaatattatgtagtagataattcctttaaagtgtactcctcatggttatgttctaatcacattcccacaaaagtttctatactctgaataactttaagggaggaatacagtaattgttggtgtatatgataaggtccatgtgttttatgaatattaggtattggatatatgagctcataagagaagataatctttggtacgttatattgatcatgccactttcccaatttcaaataacttatggattcttaaaggtattaaatgaataagtactattttttaagtagatatgtcattttaaaacattttggtttgggccatgccttcgtcaatatgttccacatagttccatataaaattagagtctctatatgataacatcaaagacatgcctgaagggaacttaatttttttaaggaggtggggaatccatttgtagaaaccagtgtaagaagctgtttgaaagacatcaaacatggacttgtctggactttgcaggttttaaggtatatataggaatcaaaattgactcatgacttttaaagcttcatgtcagtaaaaaataaaagagaaatgttgggaatggtaatatttgagatatatagtttttacttagctacagaaatgtacccataggaacttgcttgaatctgaatgctctgctacacgtgtttagaattatttttgcctcttttgccaaaacataataaaatgatagcaaaatatgacagtatgtgcactgatcacaacaatataataaactgcatccatgtcttttaaaactaggcaagaatagacaaaatgctctaatttctgttggagactagcaatatgcaaaccagaccatttttgttgaaaaattctggagacatttatgaccgagtttttatatcctttaagataattttatcctttcatgattgtatcatttcatgatatgttccttttgtgacaaatgctgctagtatcagtgtcacagattgttactgatgatatacagtgtttatgctttaaattccgaactcacagaatttaatggatacttcagaattctttaaatttcaaaagtcttaaagcatatttatttgggtacaaaattttattgcctttaaaaatctttttcagtatcaagtttattatcaaaagcacaaataataaaatagaatttaaaatatttattttcagaataccactattttaataaatgatcttttgcctatgccagcgtctgctattaacatctagctaatatattttctgtgtctagtaaatatggtaatcagtttcaaagaaaactaggtaggttttgtgaggcaaagttgaaacaccttgaagaaatgggaaagtttgggggctctaataggacaggataaatatttcttgattcattttttaattgctccatttattttctatacatagaatcaaaaattctaaaaagagaacattatcttaagactgcacaaattaacagtgaaaggaattgtcccactcattattaagaatgctgtcaggctgggcacagtggcacacacttgggaggccaaggcaggaggattacttgagtccgggagtctgagaccagcctggacaacaaagcgagaccctgtctctacaaaaaacatttttttaattagctaggcatggtggtgtgtgcctgtggtcccagctacttgagaggttgaggcaggaggatcgcttgggcctggtaagtcaaggctacagtgagccgtgattgcaccactgcaccccagcctgggtgacagaaatcctgtctcaaaaataataataatattattattattatcagtaactctcacaccttttattttttatttgcattcacatctgtaaataataaaatccacaaaaattaatttacccattttgagataattcaatcttaagcaaagtgagcacagcttaagtatggctttggaatttaaataatttgttaggcaattatagaaatgctagcagtagtagttttggttgaagtttaattacttcatttgtatataaagcccccactgtttgtcaagaaagtgatgttaggggtattatttataattcagaaccataaataacttgtttaaaatgacagtacatacattttatatatatatatggtttggtctgggtaaagaactaaaataagaacatagcagtgatttttgttaatgcataaggaattcttgcctcatttctgaactcttaaatttgctttgtgtattacaatatacaggcccttgattgtttcatttcctccaaaatttatgtatgagtgtgtgtaaggttaattgtagcacagtgcttggtcttgtgaacactgtttcctcaataggtatcttaggttgccagtgttacaatcccagatactttgttcaacagattacctgttcatacaggagctacattgttgtatagcctcattccttccgatgggtgtggagcaggattaaagcacactttataggggttctaattgtagattcctaattgacttggtgaatagcaaatgctaaaatttaaacacacacacatatacacatataaacctgtttcagggtgatctacgtgacagaacaaatgcctcacaggtgttgaatgcttaccagataaaagagtagttcttcccctgtttcccaaggattttcttttgaagtttatatggattttctgtctcattgtttcttctcttaaaatggtttgtggcaagaatccatttcatctttggctgcacttttcacttttaaaggcagaactgattgttagaagtcagccaaaattaaaaacaaaaaaaaaatctgtcaagtaaaatttcgcacatttttgagaagggaaaacatgtgcatggatgcaccacaggttttggttttttaaacaactcacttattgaaggatgtttgggttgtttctaatgtttggctaagactgctgtgaacattcaatacaggtttatctgtaacatttttttcaccatcttatttataacattttatttattcaaattatagagcatagaatcgaagataaaatgtgtcatatcagttggacattttctaaaggtgaaatttgagacataaggaaaaaatgtaacatccaaaaaattctccagggcctttatttttccacagtatatggatttcctggcaataaatcattactatggagggcaataagaagagatgacttcttctttagtgtctatgtgaccatggttgggaaatgtataggtttgtttttaaaatttgtatttgtctaaattatgttgtccaaaagattgtatcaagtttaacaaataaagaaaaattatgttcttaggaatgataaatatattaatgtttctatacacatatatgaaaaacttttctgatttataacttgatagaatctgtgaactaccaaaggcatatagtaaatattcttgggttcttcggaaatcagtcaactagtaattatttattggtaactaactgccaccaaataaaaattcttgagtagatctataattgggtaaattgtagaatagtaaaagcactgattgagaaattaaagagtaaatattgagggcttttttcccctttatgttaatcacattgcagaaaatggggagcatagagaaaatagagggcacagcaatattcaacagaaaaaattttctagttttttactattttaatatttgattaaataacttcattttattttattttgttttgttttattttattttattttattttttcagacggagtttcgctcttgttgcccacgctggagtgcaatggcgggatctcagctcaccgcagcctctgcctcccgggttcaagcgattctccccagcctcccgagtagctagggttacaagcatgtgccaccacacccggctaattttgtctttttattagagacggggtttctccacgttgatcgggctggtctcggaactcttgacctcgggtgatctgcccaccttggcctcccaaggtgctggtattacaggcatgaatcaccgtgcccagccgattaaataacatttttaaatcaatattgggttttataatttttacaattttgctagttgttttggtttgacttatatttagttgctgatgatgtatgtattttcatatttgttcagtgacttttttcttttgttaattactgttcatgaaaattagaaatgtcaccctgttttgtccatatccttccttgcagtttcaatgcctgtcagtctgctttcttctcagtaattacctgagtccataggcagtggtcttctcttatgttttgtatcagacttaattaaaattaaaaattcatgtaatagatatcttgagataaaacattcatgccttttgttaggtacttttccataaggaattttgctactagtccaggacttcctaccacagtctagtttaatcccagaagatttgtgcctacataaacaccattgctgttagcaaatacacaggctatgtcagaacatagaccttcatttacagtgaacttctaattatatgcttgccctgctattagaaaagtaataacttactttagatggggaaaatgttattccatttgactgtcatatgatagactaaaagcaatacattgcagatatgcttttgtgactgcagagtacacgtaaggggcatatactgtaaactaatgagacctggtttattatttagaggccagactgatgtgacttaatagtggagcatttgactcataaaggaactgttgtagaagtaataccttttctttttacttttcaggtttacaagtaaaagtaaccaagctaaaacaggaacgaatcttgtaagtatcagtatgtaatactcatgtgttatttatagagtagttgatactgatgtccaatttgacattcatagagtagttgatactgatgtccaatttgaccttaatgtcttatttataaaaaaaattagccctacttagtatgggccttggtagtcagcagcagttttttttttcaaattctaaagtaaaaagaataattttgcaattttaagtgtagccttaattatgtatgtttatattgtaatacaacttacatatgtaatcttttcccataaagtattaaaatgacaattgatctgtagtctcattttgatttgtcagcggagttctttgttgagccataattaacacatggaattcaacatgctacaagacaaggagcagaataattctgggatttctaaactcatatgaatggaaactaaatgggtattttaagactccttttaggtagtttgaaattacttgaagattctctgaattgttttgcttataaagttctaaatcagatctgattttttaagttcgggaacatattttactcatgattctctagagcttccacattcaggaatctgaaacagatggcagagtagctttgtaacacttactaagaaaattctctttagctgctgagaaatttagaaattctggaatatagactattcaccttcagataaactcttgttttcttttaaaattattttaattaagaaatttaaagaattgtaaagacaaaaaaaattttccagttgtgcagcactgttttcatgcttttgattccttatcacaaagtttctttgtagagggtataactcgaacataatgttttgtccattttattcatagtagttcctatccctccctatagatccccccaccccagcccccatatatgacatttgatttaaaagtaatgaaaaagttgttgaatgtgctgcataggtatgtaaaagagacaggaaggtttgttatctattttattacagttacattttcaaatacaagatttacccagcttcttatgccagttgtatttaaaatgttcagttaccttagaaagacagaaggccaccaattaggaaaatgatactgagtttttagtaaaatgctgctaatggcattgagcttgctttagaaatgaagttagtgattggtgtagtaataactcttcctttggatgaggtccagggtagacctgtctttaatatattagacacttccctgtttttgaaattgcatgactctttttgcactgtctggaattcatcaatttgcttttttaaagaccttgttaaattatttctgcaattagtaaatgctctttatgttaccactttcttgacctgaatattttattaagtaactgaagttagttttaacttcaacttaggttattcatctacataatagtttagctttaagacaaatactgtcatgctctgcgttattctaaatagaacagtaatggaatatatgaatatgggaaaatcagataactcactactattacagagttctgttcatcatttaagaaaaaaccctttgctattaacttttcactccttaagagtgaaaatgtatatgtgtgtaaatcttcaatgtgtgtgtaaatcttcaatttaatatttactgtattttatgatacagattatttaaggcaaatgtgtgtaaattttcaatgtaatatttactgtattttatgatacagattaagttaaatattaaatttgaatacatgttggcagtctgttttaggacatgattaatcacacctccaggcttagacaagttatctggttgtatttgctgaataggatcagtgaaaacctggtgttccttctgaattaaatatattttctagaagtagtaggaaatattttatttatttatttatttatttatttttgttaaatgagaaatggccaggttaacaagcttcaatgatatattactttctgttattttcaagttctcagatgtccctacatgctaccataactatatttgttgtatagccagaaggtgttgctcttacgtgtattggtttttcaattaatataaacttttcaacaaatatttaagaaattccctctatatttgatacctgacattttggcttagttgttttactcatctattttggtgccagtgacactatattctagccactttgacacaatcattttgacatctactttttatgacagactgatttgccactcttaattgatttgatattttagacccttcaagggactgggagaaggtgtttgaatcatagtattacattttcagcttcaagactatacagaaaatcctaatcaaatttctaatgggttttcttagaattaaaatatgtgaatactttatataataaggtgatttttaaaaataatgatagaggggtaaaatatgacaactttggaaggtaatcaggtttaagtagaagaagattctggttgtctttgttagttttttttctcactataaagtcataatggtaaacacttaacataaagcctactgtgtgccacactgttccgtatccaatacatacattaatacttatttctcagaccttttggagtagatattaatgtatctacacttggtgaggcacagagagtttaggttaattgtatcaggtcacacagctggtaaatgaagagctggactcaaacccattttgcatctgggcgtagggttcccgttcgtccacttcactgtaagctctgacttaaaagcaagaccaggtaaaaattttaaacaacacagaaattagtaaaatagaaagtatgagttccccataattgaagagatgatgtgagtagagaaatactatttacattaataaatatatgcaaaataataaaataatgtacattttgatagctattttgacaaagttgagtcaatagtggcatgatgactttatggtatataagagctctgcagagaaaattctggtataatttgaactgtgatttacaagatattccaacctgaccttttcagttgttttgttttggtacaagaaatttgttatataaacacggtggagctcttagaattatcctgttaagagtatttttatctgaaaaacttatttattttttgacctttagagatgcacaaagactagaagaattcttcaccaaaaatcaacagctgagggaacagcagaaagtccttcatgaaaccattaaagttttagaagatcggtgagtctggcacttaggtcttgagtaagaagtgatttcctccataataagaagtacattgactttcatttgtaattagttttgggattgaaagtgatctttcccacagccttctctcacctttgaatgaatactttatgaaaacaaggatctattctttaagattttcattaattctgagatcacatcagtttaccctttaaatgatatctttatctggtgtttgatgtagtggaagctcaagggtagcaatgttctaattcatttaatgctttaattccagttttacttctaagtaggtggaaactgcttcacaattctgtttctgtcgtcttttcttgttcttgctgttctcttttcttctttgcagatttcctcactttgagggagtctagggatcttctttctgagtattcctgaaataatattatcacttacttccatacacagacttctttctttcccactcctatgaggttaacactgaggattagaaaaggcttccagcatttgctgttttcccttttctgaattgtaagtgctatttaggacctataaactacctacctgctatagtaaacaatattccagccaagcgtggtggctcacacctgtaatctcaatactttgggaggctaaggtgggaggatcgcctgaggccagacattcaagaccagcctggacaaacaaagcgagaccctgtctctacaaaaaattttaaaagctgagcatgatggcctgaacctgtagtttcagctactctagaggatcgcttgagtccaaagtgattgaggctgcagtgagctatgatcgcactgctgcgctccagcctgggtgacagagcaagaccgtgtctccaaaaaaaaaaaaaaatacaaacccacaatatcccatactttctttatagtttttatttttccagggtaggcatagtggctcatgcctgtaacctcagttctttgggaagccaaggcaagaagatgattgcttgagtccagtagttcaaaaccagcgtcgcagtatagcaagaactcatctctacaaaaaattaaaaattagccaggcatgtgactggagtcctagctactcaggacactgagacgggaggattgcttgagtccaggagtttgagcaagctatgattgtgccattgcactccagcctgtgtaacagaacaagaccctgtctcttaaaaaaatttttttcttgatatttttgtatatgttacggaagggctgggtgatttgagtttgtctctatccttttagtggtgaaataatttaatattcttcatatgtgcaaactgaaattgagtactttctacaactaccaactcaatggatgcacatttgttggaataggcagtgtattgtggaataaagacctgtgcgctttagaatcacatatgtttttgaattccagcttcaccctgtgttcttaattcagattccacaacaaatatttgagtccttgctgtcttaggtgttgctctagggggctagggatgatacttttcctagtatgtcatggattaaatgagacagtgcaagtaacaatacataacagaagttgaataagacttacatatcttagttggtgaatataatttagcactcctgtctgtgcatatatttaattttcaaaggttgggagtgagccatacgacaaacaaatgagacaatttcagattataaatgctatgaagaaaataaaatcgaattatgtaattgagtaaccacaggatctgtgtagaaaaaaaaaccaaacgcagcttttcccactgtactcgtacaacatgcttcagacaccagatgtgaggaggagtttcccctaccaacaagcaaacaattaattctacagcagacactagctgggtatcctcttaattcaattcctacactggatatggcatcaggtcccacaggttgagggctttgtccccatgactgtgtccttccctcaattctgatgccaatttcaagccccaggttgtttacccatgctttggacagactctaaattggggttcccacaaccccctcctcgggttatatttactagagtgactcacgaaactcaggaaaacatttatatttatcagtttattacaaaaaatttgttaaaggttacaagtcaacagccaaatgaagagatacatggggtgaggtctagaaggatcctaaacacaggagcttctgtcaccatggagttggggtgctgtcttaactgagacttgattgacagaaaggaaccatccacttgaagaactagagacaaaaggaaatagaacagacaaatgtgaaagtctagggtagaaataagtttgaaatatttgaggaacagaaagtctactgtggttctagtttaatgagtaaaggggatgagtgataggagtgagattggaaatctagtggggcaacaactagatttcgtagggacataggcaaaaagtttggattttaattgtgatggaaaccacttaagcaggagaataacaaagggatataagtaggtagcaacagcctgtctatccaaatggaaatgtcaagtagatagatgtatatgtgaatctaggattcagtggatctcttaaggacatctttgaatagtataggaagaaagaagaggtcttagggctgaatcctttggcattcctgattaaggtttcatgaagaataaggacccagccagcaaaagattgagaaagagaaactattaaaatagaagaaaagccaggaacataggtcttgaccactaacaataccttctttgcagggctattttgaagtttaaatgagataatggaagcagcagtacataacagatatttaataagacatatactatctcctaattggaagatgattccaacttttagcactctaatctgtgttatataacacagccatgtctaggctgtctagctgagaagccaggaaactagaaagccatctctcccactcaccctttcccaggtcagcaatggaaaggaaatcattagttactcatctgtagtgtggtgaggcgcttccttctgttttctctggatatgtagtagaggatttcagggaacatatctctctcagcctttaactccagccattgaagagcttccttctcttatttcaccacgttttttctctcatttctaccattacaccactttctacaagcagtgaggttggagtgagtaatggcattaacgccaagagattaggaatgctttttgttccatcattcctatgtaaagaaaatttcaagattggtattaataactaaatatgttagcctgagttctctgagaagcaaacatcaataagactttggacactgaagagatttattgggaaaaatacctgtaagaaatgaggcgtctgggagagctgtcagaccctcatgcctctaactctgtgaagaagagagggaagaggatactgtacttgtaagagagctttgacaaagctaacagggagtcctggagccatagttgccctgctttcctcatttatagcaggatctgactatgggatgcctggtgtattcacctatgtggaaacaggtgaaggatttcacagcacagaaggtggagccagggattttattctcctactgtggtaggagacagtaagatgactggccaacttatattgacttccagtactcttcctgtttagttgttccttagcaagttgttagagcccaaaattattacactcaaatttactggataacattttcattatgtttttcttgaaacattggcttaatacaattggctctccatttcatccccaagatagtattcttcatcctgccccttgaagacattgctttccagtgtcttcaaaacactcttcattttatggcttaaagtttgagcttcctgttctggtaacctttgcagtcttgtacttcctttttaagtagtttttcttctccaggccgtttcagagaagaaatcagtggatgagtgcctcatctccttcccattaaattactttcttttatgtagtctatattttttttttttatttttatttttccctgtattagtccattttcacgctgatttaaaggactgcctgagattgggtagtttataaagaaaggtggtttagttgactcacagttctgcagagctggggaggcctcaggaaacttacaatcatggcagaaagggaagcaaacacatcctttttcacatgatggcaggaagaagtgccaagcaaaagggggataagccccttataaaaccatcagatctcatgagaactcactcactatccacaagaacagaagcatgggggtaaccacccccatgattcaattacttcccacagttgggactgtgggaactacaattcaagttgagatttgggtggggacacagccaaatcatatcattccactccttgccccttccaaatctcatgtcctcgcatttcaagacaatcattgccttccccacagtcgcctagaatcttaactcattacagcattaacccaaaagtccaagtccaaagtctcatctgagacaaggcaagttccttccgcctgtgagcctgtaaaatcaaaagcaagttagttacctcgtagatacagtggggatacaggcattgggtaaatacacccattccaaatgggagaaattggccaaaacaaaggggctgcaggccccatgcaaatccaaaatccagcagggcagtcaaattttaaaactccagaatgatcccctttgactccatgtctcacatccaggtcatgctgatacaagaggtgggttcccacagtcttgggcagctctgcccctgtgattttgcagggtacagccccattcccagcttccttcacaggctggcattgagtgtttgcggcttttccaggtgcacagtgcaagctgttggtggatctgggtgtttctggggtctggaggatgatggccgtcttattacagctccactagacagtgtcccagtggggactgtgtggaggctccaacccaacatttccctcccacacagttccacatggttggggaggcctcagaaaacttacaatcatggcgaagggggagtaaacacgtccttcttcacatgatggcaggaggaagtgccaagcaaaagggggaaaagccccttatgaaaccatcagatctcgttagaactcactatcaagagaacagcagcatagcgttaactgcccccatgattcagttacctcctaccagatccctccctcctgatttcaagcagttctcccacctcatcctcccaaagcgctggtattgtaggcataagccactgtgcgcagccagttgatacatttaattgttaaaattatgtgttttattctgcatttcttaaaactaggttcttttctctttaagatctattctacctctggtggatgccatgctgctttggtatttctcattctaaatattcccttgcctttcattccattcacctttacatcctcaggtacatgggcctgtaattcattaggtggtattaatttggtggcagggagtcggggtgggatgagggatatgtagctcgttgttttgtagacttgcttttgctcacctttcttcaaatgcaaatccaaaatttcctgtgggcacacttaaagatttatctcttgtttcatgaagctccatttaattaagctgaagatctgtttttttaaatacagtagttagtatgtattgaggattcactttgtacttaggcatccagcgctaaatctttctattaacgctacaggatagatgatagatccattttgcatgtgaggaaactagctggcaaagagcaaagaagctttcccaggatcacatagttaatacataattaggtttatatcttttttttttttttttgagacagagtcttgctctgtcacccaggctggagtgcagtggcgcgatctctgctcactgcaagctccgcctgccaggttcacgccattctcctgcctcagcctcccgagtggctgggactacaggcgcccactgcctcgcccggctaatttttttttgtatttttagtagagacgggttttcactgtgttcgccaggatggcctcgatctcctgacctcgtgatctgcccacctgggcctcccaaagtgctgggattacaggtgtgagccaccgcgcctggccaggtttatatcttaaatctgatccccgcttccatttttactatttcatgatgcctcccctttatattgtcttaactttattaatgttatataaattaattacatcttaaatgatcatctcaaagtatttgtgcttgatctaaagtttaccaaaacagacactctgaaatatcaggtcttcaacattgcctattgtatagtctgtttccttggaaggtttttttttcgtttttgtttttttaattgttgctaactaaatactacctttaaaggactaagtaggtaacttttggtgaatttctgctttatttaaaattttcttttagttctatgtcatatgtaagaatgattatctagagtaagctttaaaaatctgtacaaactaacattttgctgagacctttaaaagcaacatgtattttgttaatttttttttcttttgtttggtctttttgttttgttttgttttgtttagagacagggtcttactctgttgcccaggctggagtgtaatggcaccatcatagctcattacagcctcaaattccttggctcaagagatcttctcacatcagcccccccaggtagctaggactacaggcaagcaccacgccatgcctggctaatttttttgtttttatagagactgtcttgctgcgttgatcataggctggtcttgaactcctggcctcaagtgatcctcctgccttggccttccacggtattgggattacaggcatcagccactgtgttcagcctattttgttaaaatttctgaacagtaattcagcctactcttcataaaacaaagcaattcttagtatgttaatgggaaaacactgagatatttcaatgaagggaattacctagtaaaagtaaattagataataaaaagttctaagttctaattttatgtggctcatttatgtttaatgattattatgttttatattatgtttaataattattattatgtttaatgagtatatttacagactttccttccaggaactaaagtatttcactaaatctaagaaacagtcactgtgctggagaagtagatagaacgcattttttttgaaaatctgaacaaagaagttaaaacacagttgtctaatagagtttaatattttttaaagcattttggcagtcagtgagctcattttcagatgctgttaaaaggaaaattgatacttataatcaggagatgtatggttctgcaactatttttcaaacactgaagcaagtgtccgcttttgtgttgctgttattcatagatttgaatttaaacatcatattattcaggagactttctctaacttgctagactaggttaagttgctgtgtgctttcatagtactctgtatttctgctgtcacagtatgaattatactttgttgtaattactttttcttttttttttttttttttttgcctgtctttctctggtagactataagctttttaaagaaatggcattaccttcatctctgttgtatttacagcactgagcacattgtaagtaaacagtgaaaccatattgaatgaaaatgaataaatgtcaataaatctttttgggctatagcaaacaattgagcataattgttactctgataagttttagtagcaaatggaagcttttatttcttcatctttgtgaactggaataaactcagaatgcatgttgctttctgccttttgtggaattgcccttttttccctttacctgttacatagctactgaaactgcattctcttgtgaaattgggagtgttttttctttagcagcagcagtggaagataggcaagaggaaagcaatagaaccatgctgatggaaacaggagctagcacattttcttgcatctatttaaatttaaactaggatcagcaatcaaaaattgaccctttttcacagatactattatcaagaatggtaggtgataagaaaaactgaaagtaataagctagggaatattgcttcattttgtttcattttgtaaccatctagccagtgatattttaaaaatccctctcctgtatttgaaaagttattgttttagctcttctattttacctttcaaccttaatatatatatttaggtctttgttttatattgcttcacctgtgaacagtttccctgttcttaccattatgttacaggaagatactggtgtttcttaccctttcctctatcacttttccgctctttctaccatctgcctttgatgagctgaacctttacgatataaatatggtcaaggttgacaatagttatcttcttttctattaccagatttcagtcttttttgtattttgtttataagctgattctagaagttggaaaatagtaaactgagtttatttattgactgtataaatattcactgcagagctaggattgcatttctttacgtatctgatgtcatggcctttctgccactgagggaaattgtttccaatgtccagatgaaatacattgttttttactttgtccccaatcagttgttcaaatcagctcataattatgttatgataatgacttatttaaatgtttttttctagaatttctcactaccctttttcatgttgagacaagaaccatgtttccttacatcattaatattatttaatgccttagttattctactcattcattaatttttttttgttgtaggttttgtttgtttgttttgaggcagggtctcgctctgctggagtgcagtggcgcgaccttggctcacttcagcatctacctcccaggcccaagtgatcctcacacctcagccttagagtagctgggactacacataacactacacctgactaattttctgatttttttatagagacaaggtcctcctatgttgcccaggcttgtcttgaactcctaggctcagaccatcctcccacctcagcctcccagagtactgagattataggcatgagccactgtgctcagccagttctttttcttgaagaaatatttcttgggctaaaaaacttcttgtactaatttaggtcattcactttctagactattctagaaagctgtcattctggatttctcttcattagatccctgcattaattcagttatttcatttctctcatgttaaacagtcaacaaatacttaatgaaccacctgttttgttccaggcactgttttagaccttggggatacaccagtgaatgtgatcgataaatgtgggcctttctattggttttttaagctcattttgttacagcttaccctcaagtaactgctgaaaaagaaggcacaggaactaaattttcaaagggtccttgcattctcgaaaatatttttattctactgtttattatatagttgatattttgactggatataaatttctaggtttaaaatagttttccctgaaaactttgaaggcatttctcattgttagcattccagtactgatacagtctgccattctcgtgttaattcttttgtaggtaacagattttcttttcctttctgaaatttttccttgttctgatcaaccttcgtgatgctctgtgtgtgtgtgtttccttcattgcactggacactcaacctgttaacctaaaaactagcactcaaagtctggtaatttttttctgccactttctctattttttaatggtctctctttctggagcacttcttagtcagagactgattttttatcatcttttctcttattttctattacttgtttttcttccatgttctgtgagatttcttttattctccaaccctactattgaagttattttgacaatcacgtacgtaatatccaagaactttttattatttgttgattgttgctgtatatttatatgtgtgtgtgtgtttgtgtgtgtgtgtgtgtatactcttgttttatggctgtatcatttcccagatttttccaggaatgctagatagcttttgcttttccccctcaaggtctttttgtgtggtaaaaatctatataagatgaactttctttttttttttttttttttttttggtggtggttgttgttttgagacagagtctcgctctgtcacacacgctggagtacagtggtgcaatctcagctcactgcaagctccgcctcccaggttcacaccattctcctgcctcagcctcccgagtagctgggactacaggcacccgccaccacgcccaactaacttttttatattttttcgtagagacggggttttaccgtgttagccaggatggtctcaacctcctgaccttgtgatctgcccacctcggcctcccaaagtgctgggattacaggcatgagccaccacacctggccgaactttactattttttaaaaaacaactttattgagataaaattctcataacatacagtttaccaacttaaagtgtacagaggctggtgcattggctcacacctgtattcccagcatgggaggccaagtaggcagatcgctttagcccaaaagtttgagaccagccggggcaacgtggcaaaaccctgtctctaaaagtacaaaattacccagcatggtggtgagtgcctgtagtcccagctactcaggctgctgaggtgggaggatcacttgagcccaggaagtcaaggcagcagtgagcagtgatcatgccactgcactccagcctgggcgaaagagcaagaccctgtctcaacaaaaaagacaaatgattatcaatgcttatattacagtctccctttataaaaaaaaagtttttttcttctgacagtctcgttcagtcatccaagctggggcgcagtagtgcaataatagctcactgcagattctcctgcctcagcctcccaaagtgctaagattataggagtgagccactgtgcctggcctataaaaattttttataatgtaatttttagtatcctgaaatgaaatttaaataatataacctacctacatacataattattttttaaatatcacaactatatagagaaaattgatttgtagtatatcagaaagtaaatattacgggtatgtctgttctaaaagatgagttgttgagatactcgttcctttgtataaaatgatcattaatgtgactgatacaagtatgtttattgatgattcaagtaacactaactgcatttttcgtcagtgacatgatttttcaaaattgtaaagattattggtaaataggaacagttccaacagacctaatcatttttgtttgtttaattaaagttgtactagctcctagtttaacttgtaaaaagcattatatgtatgtgaccagtaatcagcaagaaataaggaaaagcgaatgacaaaaaagaaaaacttgcatgtgtagctgggagatcagcatcaatatcagatgcctgttagccttgtttaacccttctcttagctgtgagtttaagccagacttaaaagccaagcatgagtggaagagctgggggcccagctatacaggtaggaaagctaagcatgtaatgagtgctgatgatgaaacttattgcaagccatggatggctccataggttcaaggcataccatacttcttacactccagagtgagtggtagggcaagtgtgtatattttaagtactcaggcattagattttcactgttaacaaaatggctcaatataaggataagacatgaaaagaacataggtaggagaagatgagagtgccttattctaaagcaagcttgtctaacccacgacctgcgggctgcatgtggcccaggacagctttgaatgcagcccaacacaaatttgtaaactttcttaaaacattatgaaatttgtttgacttttattttttaagctcatcagctatcattagtgttagtgtatgtgggcccaagacagttcttccagggaagccaaaagattggacaccccgttctaaagctttaaggatcaatctgtgaagagaagcttctgagcagattcccgggccccgtccctgcagattctaattcagttgatcatgggtagacttacaaatctttttcctctctttctccctccctcccttttaaatctgcttaggtggttttgagaaatagccaggtttagggaccactgatctaacgatctattcaacatgtgtttaaaattaccttcctaatttctgagtgatcgtcttttctgtgcttaaacatgtccagtgacaaatgaaatcactcccttcttaggtaacacattccatccttaaatactgtaattggaaagttttctttatactaggtttatatctgtagaattgctgcccattggtcctagttttagtcctttagatcataaatctctttcacatgattaacttttcagatatttagacagctgtcagccctcagtacccttctgacttttttttttctcctgctgattttcctctttgctttactctactgaagttatactggcctccttgacatttctttaatagtccaggcacttttcaactgtaggaattttgtactctatcctcattcacctgtaacagtctcttgcaggtattcttaaaactcactccctctcatcatttacatctcctcgcaaatgttaacttcacagtgaagtttttcttcaatagcctatttaaaattgcaccaagttccccaacctaactggatcttctatctccctctgtgatttgtttcctcccaaagcacgtatcaccttgtttttttttcctttttctttttttgagacagagtctcactcactctgtcgcccaagctggagtgcagtggcataatcttggctcactgcaacctccacctctcgggttcaagtgatccccccgagctcacacacatacacaccccctcctctccaccccccctacctcaacctccctagtagctgggactacaggtgtgtgccaccatgtccagctaatttttctgatatttttcgtacggacagggtttcaccatgttggccaggctggtctcgaactcctggcctcaagtgatccacgtgcctcagcctcccaaagtactggagttacaggcatgagccaccgcacccagccccaaagtacataccaccttctaatacgctatacaacttactttactttcccttttttttgtctattttttattgtgtctcttctaccagattccaagtcaaacaattgtactgatctttctcatctttataatttcagccaaaagaacagacatttattcagagtaggagatcaacaaacataattaagttctccttctttccaatttccccttcttcagaagcagtcattttcaattcttcatattgttttgctgtttacttcaaaaatctctttttaaaaatgtttatgagctatctataaatttttcttgacttaggtgtttttttttcttttttctgctttctacatagacgccattcccatttccctcttcctcctatgtagtgtataataattttggttagatcactattgagtttttattttatgattatgtaaatgcagttcaaagctgaaacatattgtaaactgtaatttttcttcctatgcaaatttctgttgtccatagtgtttatgatggacctttttttcatatgcttagtgttcttaccaaccactagttcaaccacaacgttctatcatttatctaaatgtatcaaggtgtttagatgggttgtatcttctgtcatttcaccttttcaaacagatctgtctcagaggctctgatctgcttcaatttggactctgtcctctttacctgctacgtagtggtcatcagaggttccttttactgctttcctttttcatatatctaggacttcttttctattttttcttattttggtagaatgcctcctccagtagatttctgagacggagtgtatgagacctaaaaaaagtttattttagaaaatcacacatatataaaagtagacatagtagtataaccagttccgttgtacccatcacttggtttcagcagttaattgtggccattcttgtttcactttatttcgattagtccctctcactaccattttgagaccttgtctcaaaaaaagagtaccattgtcatgcttaaaaaaaattaatgataggaagcaaaatttttgagatttttacatgtctgaaaatttttgttgaaataatagttggagaatataggtttaggttggaaataattctctttcagaattccaagtcacttcttttagcttctaatgttgctgttgaaatcccacactattctgagttttcttttttcccccacaatccccaccaaaacagtgctgttagtctttgtttgtttttgagatgggatctcatgttgaccaggcttgtctagaactcctggcctcaagcgatcctcccatctctattctgattttttatcttttctgtgtactctttaaaaagaaaaaaatttcttctgaacgcttatgggctcttatctttgcagcatccagaaattccataatgatgagttcttttgtatagatctgttaacatccattgtgctggagacttaggtttttttttttttttttcttttcagtcctttaagtagtgggccatgttcttgattttcttcactattccccacactgcctcaaatcccctcctgcgtttccttgcttttcctggaactcctattctttatatgatagaccttctagaataattgcccagttttatctaaattttctctttactttttgagtagattttcttagctttactttcttaccttctatttgtagttctttcttaatatttttaatttttaatttttattttattttattttattttattttggtttttgtttaaatagtgacaggatctcactatgttgcctgtgctggtcttcatctggcctcaagcaattaattcttttttgcttcagcccccaaaaatgctgggattacaggcatgggctgccacacctggatactatttttaatttctaaagtctcttttttgttctcagaatatttccttttatggcaatcccattctcattttatagttttcacatcatttcttacctctagaatatagtatgtcctcacttaacattgtagataggttcttggaaactatgactttaaaagaaatgacctacagcagccttcaaataacatcctttcctttgacatcatttcattttaacagtgagggggaaaaattagcttgcttatacatcatttgacttaaagtcacagtttccaagaacctatcaatgatgttaagtgaaggcttactgtattctttataatttgatgattgtgactgtgatagcattggcattttttctttttctttctgtatagcttattatttcttccagattttttatttctttttttaatgttttgtttgctatggtttcttataatttataagcatttctcagatgccttttgatacttggttatttgttatatttaagagatgagaataaagtaattggaagctctgagtgcatgggtagagctgtagactgtgagcttctctgttagaatgatctggctggtctgtttcctcgaagatgccctaatgtcagtacctttaggtctttcctgtcaggttggtcagatttcctaaagaagactccttaattctattttctagaatgtgtaatagggctgactcccagtgttcttggagccaagtagatgacgagggcctaggctggaatctgagaatttggtgtgtatatatattcatttcattattgtactcctactcctaactgagcctcgtggctcccagaccagacactctctgttttagattgtctaagcattaaacctccagtctgctgctgggatgtcaaaggggtaatcacttgactgctcagaatataggagagaatgttcgtataataatttcttaaaacgtgcttttaatcagtcactcccagaaccaattgttgagccttttgggaattttacagtgtgaatcaggttggttctaggtcagtactgtctaatagcattttctgtgatcgtggaaattgttctaaatctgcactgttcaatatggtagcaagtagacatgtggctgctgagcacttgtctgcaactgagaagctcagtttttatttttattttatttatttaaattgaaatagccacatgtgtctgtgtctaccatcctggacaatgcaattctcagcttttcctatcattggcttatgatttagcattctcaggtcactttctatttgcccaccagctgccttgctttcgtttttttgttttgttttctcttccattcttcttgtcctcatgtgtttgtatctttaaaatatagatatatctttactgtaattttatgagattctagaaaggagcagaaatagttgcaagtgttgactttaccatctttagttaagtggtgttctttatacagtgtgattttaaggcttctgatctaattcctgtcttcagactgcattccacttaaatcatgatgcctagctgtttgttcattcattctagaaattccgattctattaatgctacatatgacttcctatcttttgattttacatctatatcaacattgtttcatatgagttttacttttgtataaaatgtctgggttctggccaggcacggtaactcatgcctgtaatcccagtactttgggaggccagggtgggaggatcacttgagctcaggagtttgagaccagcctgggcaacatagtgagaccccatctcattaaaaaaaaaaaaaaaaaggtctatgttcttttattttgctttgctttagttgtatacttttcatgttttatctctaacttattttaaaattcgtggcatatgctaccatgctgtgacttccacagacacttaaatacttactatctttttttttttttttttttttgggagagaaagagtcttactctgtcacccaggctggagtgcaatggcctatctcagcttactgtaatccctgcctccggggttcaagcatttatcctgcctcagcctcccgagtagctgggattacaagcatgagccaccacatccagctaatttttgtttttagtagagatgaggttttgccacattggccaggctggtctcttaacacctgacctcaggtgatctgaccacctcggcctcccaaagtactgggattacaggcgtaagccaccatgctctgccaacacttaaatacttattatattattggcttagttattgacttgaaattattatctttgggccaggtgcagcggctcacgcctgtaatcccagcactttgggaggcagaagcaagcggatcacgaggttgggagatcgagaccatcctggctaactcagtgaaaccccatctctatgaaaaatacaaaaaattagccaggagaggtggcgggcaccggtagtcccagctactcgggagactgaggcaggagaatggtgtgaacccaggaggcggagcttgcagtgagctgagattgcgccactgcactccagcctgggtgacagagcaggactccgtctcaaaaaaaaaaaaaaaacaattatcttcgaatttatttcctgaattcttaacgtggggtatgtgtctcctttttaactgtatttttttctgattaggtaaataatgaaattggaaaatgtttcaaaaatatggaaaatgaagaagagaaaatctcccataatactgtcacctacaagataactattattaacattttggaatataactcttcctcacctgcttgtgtgatatgtgtttttctcttcaacagtcacaaataattagtaaaagctatttcgtatttttttttttttttttttgagacggagtctcgctttgtcacccaggctggagtgcagtggtgcaatctcagctcactgcaagctccgcctcccaggctcacgccattctcctgcctcagcctcccgagtagctgggactacaggtgcccgccaccacgcacagctaattttttgtatttttagtagagacaggggtttcactgtgatagccaggatggtctcgatctcctgaccttgtgttccgcccgcctcggcctcccaaagtgttgggattacaggcgtgagccactgtgcccagcctgtaattttttttatgtaatacattgtgaatttttactaataatttttttaatgccaaaaggaaaatatgaggtgactttttctcccttgtatttcttgacctttattcaacaatattgacaaaaaaaaattttttttttttttgagtcagagtcttgctctgtcccccaggctggagtgcagtggcatgatctcagctcactgcaacctccacctcccgggttcaagcgattcttctgcctcagcctcccgagtagctgggactacaagcgagcaccaccacagctggctaatttttgtattttttagtagagacggtgtttactgtattggccaggctggtcttgaactcctgacctcatgatcctgtcgccgcagcctcccagagggctaagattacaggcatgagccactgtgccctgccaatgattggcaaataaattttgatgaatttaatttttcatcaaaaatattattgaacactcactatgggtgacatactgtgctgagcaaagcagctgcaaagttgcttcaggtataattctaccccttggtattagactagggttcatattttgaccataacaaattaaaacaaggtcagcttcttcaataaataagttcccttagcatgagtttaaaattggcagatttttatagaattgcaatctgaagaaaatggtggtataacatgatttcagcctatataagaatatgttaaaggtataataacatcattaatctagttgattttcacagtatttgccaagtcagttccttaaatctttataaaagtcttggaattccaaagaaggaaatctcttttagtggatgaaaaataccttgttttgtttcataggttaagagcaggcttatgtgatcgctgtgcagtaactgaagaacatatgcggaaaaaacagcaagagtttgaaaatatccggcagcagaatcttaaacttattacagaacttagtgagtttcctttcttcatttattatttaaagtatgtaatgtattatttttaagacctattagtaaattggttgtaattaaatggatggtttacatatatttttccttatttagtaaaagttcaaatgtccttttttgtactttttgtagatttaatctcatgcttaatttagtaagaaatagggtacaaaaaggttgtgcaaatactgtccacattggtcttaagtcatcagttgtaagacaagaagcaggtggtgttttttttttttggacatgtccatatttgcttctttggttttaatctttatttcatgtaaccttaatacttagtaaagttaaatacaaagcagacaatttattgttctacacttgttttctctcttggtatttatgacatactgttttcataagtatactattttcagtttattctccttacctattgagtgtagagtttttctacattcttagccgccttcttttattcttttaatacttctgttaaccttattctcttataactatttatttcttttggtgaccattacctggatttcccataagcaactcacaatcaatatattcaaaatctaattaattatcttcttttccaaactaattctgtcttttatttttttctgttaattatattgctaccctgtggttattcaagcaagaatattgaatatatgctcattgtttttaaaagaggtaagaaagaatatagctttattctgctcccagaggtaactactgttaatagtctgatacatatctgtccaggtccaggtttttctgtctctgtgccttgttagaccccgcttccctcccttctcttttgaattttaatgttatcataccatactttgtgttctaatgtgttacttcactttagactatgtcttggaagtctttacatgttaatatgtctatagattctgtggtgtatatgggtgaacgtgtgcatacatttatttaggaatgtaagaatattatcaatgagtagaaaattgttacatctcaataaatatgtagttgttccttgtcatctgtagggtattggttccaggaccctgacgcataccaaaatccttggatgctcaagtaccttatataaagtcacatagtattcgcatataacctacccacattctcttgcatactttaaatcatctctagattccttataataccaaatgcagtctctacgcatcacttcatttgtgtgaattaaatgtagtattcggtgtctggcaaattcaagttttgctttttggaactttgtagaatttttttttcccaaatgtttcccatccacagatttagaactcacagatatagaaggccaactgtagttgagatccacagtaatattattgttagtactactggaaataatctccaataatgtctacatatctaatagatttccagcaactttatctaaaatagagccaaaaactccaagcaagcaaaaaagcttatctaggtgttaaagtataagacaacgtttttttaaatggctgcattgtatgccatagtataggtgtcaattttttagctattgtcactttaatggactgctcaactttttgtttgaatgtttgagaatttttattttcttacatcctcttcagatttgggcaaaaatgtattaataatattcaatctggtgggtgaagaatgatacctttttaaaattggcattccctgttactgttccagtcaagtattattttatatgatcgtcttcttgggtgaatggcttatttattctttgcccagtcttaaactgccctatttgctgtttgtatcttttaatttagtgaataactaagagttatttatatattatggaaggattattacactttggtagatatgctgtgcatatattttctactttgccattacctgttgacttcattttataactacttgacaagtggaagttttgtatattttcttaccttgtttaggaaggctttctctatccccaagaatataaaaatacacacacgtaaatttgcatatttaatccatctggaatttttaacatggaatgtgaagtagaaatttaccatctttagaatttgcaggcattcatcctcaagcttactgtctcacagtcaaaagatggcaggtactttttcaggcctcgtaactgcattcatacaagaaggaagaagcagcagcaaaaggctgaaatgagcatgccaggagagtctttaaaaaaaaaaaaagcttctttgaacacccacccaataacttttgcttcagtctcactagccaggaaccaccccgaccctcccactcactccatcattggaagatgactaaggatttctgaggtctttcattagctttattttgctgtagattgtctaggtaaaaatatttgcaaatagtgacaatttcgtcttttctttcaattatttttacagtttcttttggtgattgtttttctttacatactttattggcctaaggggctttagaatactgcccagaatagcagttgatacataagggaagactagactatattacatttaagtgtgctgtggccttctagtagatacgtgaaattaagttatggatatttctttctgtacctcttttgccaagttttgcttaattgtgaatttataaaactcttagcatctgttcatgtagtaagttttactgatagcttttctagggtgaaccaatgtttaatttcttttttttttttttttttttttgagacggagtctcacactttcacctaggatggagtgcagtggcgtcatctctgctcactgcaacctctgccttccaggttcaagcagttctcctgcctcaacctcccaagtagctgggattacaggcgcccaccaccacgcccagctaattttttgtatttttagtagagaagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtgatttcatttgtcactggacatgtttaagcacagaaaagacgatcactcagaaattaggaaggtaattttaaacacatgttgaatagatcgttagatcagtggtccctaaacctggctatttctcaaaaccacctaagcagatttaaaagggagggagggagaaagagaggaaaaagatttgtaagtctacccatgatcaactgaattagaatctgcagggacggggcccgggaatctgctcagaagcttctcttcacagattgatccttaaagctttagaacggggtgtccaatcttttggcttccctggaagaactgtcttgggcccacatacactaacactaatgatagctgatgagcttaaaaaataaaagtcaaacaaatttcataatgttttaagaaagtttacaaatttgtgttgggctgcattcaaagctgtcctgggccacatgcagcccgcaggtggtgggttagaccaagcaattctcctgcctcagcctccccagtagctgggattataggcacgtgcgaccacgcccgactaatttttgtatttttagtagagatggggttttgccatgttggccaggctggcctcgaactcctaacctcggttgatccgctttgcatttttaaagttaatatcttaattctcttccgaataatataagaattttaaagcacttaactttgatgatcttctccacttacattctgctcttgcccagtatttcatttctgtatagttttggggttttttagccctacaagctagatatttttttaaaaaattacctttaagtaaaattacctttcaattagcccaagggagaatccttgctttgctgataataaatcttacagggaccctactctaatgactgaaaatgggagggaaagacaccttgctagagagcttttccgtatggatagttggtcttctgagcgtgaaagcgccttttcttgtgtctactataaattacttgggagcactgctctgattttcttgtctcggtatttattaatgactcctacgtcaaaacttttagagatctatcctcatgactttagcctaagggcaactattaggcaccttttatttacccgtttagcaatttgtgggccatgttgcctctgatactagaattggtatgagattcttctaagaatactcccttttttaaaggccctttttcattggattttaccatcaatctgagcctatttttaaataattcagaaattttttatagttctgatctgttagtgacaccctttctggctttttaatactgcagtagacttattttagagtgttgtcattttatttggatttggagagggaaaatcaagtaaaccatcttaatcagaaatctaaggtcatctttgacttctgtgaaccctacaaaggatgagttgccaaatactatgattctgcctctgttacagttcttctactggtctttacttcctgtttatccacctctacataggtccagatattcatttcttttaatgaccacctgactttttgtcttgtcaatactttcttctcacattggtatatgctatatgtactaacaaatcagtcttcccatcattcatctataaaaaatgattcctggtaatctataagataaagttttaatttcttaacctgctattgaaaactttctaccgtttattatacccagtctttgttccactgattctctctgtagaataatctcctgtccagctcagttgccctttttttgatgaatgccttcctgatcttctcaagggcccaaagtaacctctttctccttggaaatttccttagtactttatttgtacttctcgattgcccttgtcacttttaaacctataaaacatgtttatgtagtatcttgtctcctttgttagactgcacattgctttaggtcactgtctatatcttaatttttttggatcctccacgaaagtagtttaataacctcacatgttgtagatagtccagaaaatttactcagtgtaagaaaatatgtttagatttataaaccactaaattattaacaaattttagagtacaattaaccttctttggtgaaagttgattgtatttactgtgacctgatttctgggatccacttcttttactaaaacacatgcttaaccagtgacatcatactaagcattgatgagagttttatgctggttccagtagaagttacagcccaaaactggatttctgctttacaaattaaataaatacagataggaaaatttggtggagattcaaacaaacagatactcttcaatggatatatttaagttagtgataaccataattattcatgaaacctagagtatgactaagaagaaaatttgatttgataaatgtgcttgttataaaaattacactgatattcagcgtttttggtgtttttttgttttgttttgttttgtttttgagactctccgccacccaggctagagtgcagtggcactattttggctcactacaacctcagcgtcctaggttcaaatgattctcctgcctccacctcgaatagctgggattacaggcatgcgccaccatgtccggctgatttttgtgtttttagtggagacggggtttcaccatggtggccaggctggtctcgaactcctcacctcaaatgatccacccacctccgcctctgagtgctgggattacagctgtgagccactgcgcctggcctattttatttttatgatcaaattaatttcaagatagagactcttgctaaaatggtatttgaaattagtaggactgagtaaccagatggaatgctttcttgtcctcagtatgtataattatactccctagtacatgaagtaccctcttttgcctgcaagcattacataaaattatcagttaatcagttacatggaactggcacggtgtgagatgtagtactccctacctagtaacgaattagttttgcgcacactagtgttaaccctgaataaacattatgatttaggattagaagtactaatttcttcatacatgctgacatattttatttgaaagcctaacatagatgttaatataaatatattatttgccttctttttcacattgtttttaagtgaatgaaaggaatactctacaggaagaaaataaaaagctttctgaacaactccagcagaaaattgagtaagtattttcctccaaccttgttattttattttacttagctatacaaaccatgaagataactgtaagagttgcagatttcattttaaaaattatgaagtgttctgtagttaaaaaatacaaagaaaatcactacatttttgtgttttgagagtatagtgtgaatgcatctcttagattagtgcttgaagaaagtgtcaacattgtaattaaaacattttaatttttataatgatttattataaataatacattattaaaatacttatatttcaaacagatgtttgagttttgttagctcccttccagccctgtcccagaagcttcataagggcaaactgaataagtgtttcctcttatatagtactcaggcctgtagaacttcttccttcctctatttttctcccttttctccccatttctcttaaagaataaaaccagtaacttttatcttgtgtgccacttcctcttgtgttttatgtttattatttctaattctcactgtgactttgcaaagtagttttattatccccactttacaaatggggaaaccaaaggtcacagtcaaataacttgcctgtcgtcttacagctggtaggtaataggactgtcactcagacccatattttttctgaaaagcctcttttctttccattatccaacactgtctcaaaagaagaatatttttctagatatgatctgactaatgcagagcagagcagagatatgactaacttttagttcccatttatataaagcttatatactatttttgaaaacttaggattcaggataatcctaatggcgttatagcgttcctaaagatcctgttgcgtttaagtagacatctacaaaaacttcagtaaaactatgtagatgtaacattattttggcttagaatagttatttttgtatgaacacatctcacaagtagaattatcattcttactggtatacttttaggataatggatatccaatagaattctgatattcctcccatgtgattggtctactgaatactgatagccaaagggaattttgaggagaaataatagtcagatgaggaaaggaacctatgagatcagactgatgttataaaatgtttgtaagaaaatgtcaacactttctaattttaataacgctgtataatgaagagagaacacaggacacagatccacaatctgttacatagaattccaaaacccaaaaggttatttttgaaatgttgttcacaacctaacctcactgcaatggcagaatgctgtttatagtctttatcccacttcatgtgagtattcatatgttttgctgtgaaaatatcaatgtgtttgattacaggatgatgcttcagactccactggagctgttatgtaattatgtatatatgttctgtattactgtattactttcatttttttaaaaaaatatgaatttggaatcccgtctggttccaaggattttagataagtgattgttgacctacattaatttatgtgaagtgattatgtatgtacgtagcttatggtattttgaacacatcagccttgatctttatgagtaccaaagggatgagataccaagtgtgtagaagttaacacagaattagatagacgattgcctcaaaaaccaatgtgtataagttaggttgaaactatatcgtgtcatttgcttggtagaaatatgaattctaattagtttagaatttatttttagtgttctcaagcacatgcatttttcctgttgaaattcaaattttagaaaagaagtgaaggctaaagtttgaaattacaggaaagagtaatcatatagatgagcttaaggcatgtatgtttatttaggacatgcttagtcaaaagagtataggagatgatctgattgtgtcttttattctcttctgaaatataagatagttgtgattctcatgaaccaacttcttctgtagcttggtcgcaaagaaattgcattttgctcagcagttttgttttgttttgttttgtttttaaaaaagcaagtatcatcttgtaaaggcaacctaattttctctgatcacctaaaccactgtcatattatgctatttgtgcctgaaatttccctgaactttagaagaaaatattatttgacttctgcttgttaaatgcagtaactctaactcttctgagctagttttgatgttacaagatggcttatatgatagggcagttattagtgacaccaaaattattcagtaaaattttgccactataaagttaaaaatgtgtataaagctaggtattgaggtcatcattcttttcgttttagaaaatagatgtgatgggtcagtgaaagtcaagggagtctatacacgtaagagttcaaaggactgtagaactcattgcattcaaccctcttctaaattgaattccttatacagcttctttaacaaatagctattgtttgaacacgtctagtagaagtttactgtttcccaagcctatttaaatttagtgagacaaaattattagaaaattctaagtttatagaaattacactgcttataagttatatttcttgattatgactgccttccaggaccatcttaagcaagtctcttctcctgtgctacttgacgactcttttgatacatgaagacagctatcatggccctcctgagtcttgttttctctagagtaaatatcctctgttcattaactgtggcattaaatatcctctgttcattcatgtggcattacttcaactcttcaaactgtgaatttttaaaaatgttttagttcgtcaatatctgaattaagaaatcaatattctaggtatagcctgatcagtggagcagtactgccacctcccctacaatggctataatgttacttcgttaagtttaaattatgttttaactggaaatgtaagttcttcagagtagaaaaggaaaaaagctgaatatttaaaacttttttacagactcatgaagggaaaccccagatccataattataggtctttagggaagaaaccaactaaaacagttttgacaggagtttaagagggagcagaggtccataaatcaaacagctcaagccatcagaaggaaaagtgaaaggaggacaagtgtgcataattaatttaaccaaaagctgtgacgtgaactctttctctcagaaaatcagtgagactagtgttttaaaggatgaacttggttaacatatggagttttgttttttccttttatgacaaaggaagacaaagccagcactcatttacttagtttgggcacctctagttagagctagttttgtttttttttttgttttttccttttgtgatcccagcttcttccacattgactctgccaggaaatcaattgcttctcgtgactcattcatgtttcaggttgaatttttatgactaataggcaagcaggctgtgacgtgattagttaaagctaggtcagatagatttcacactccattaatttataagcctttctcatatgactttaacttactgtttttccagaataagaaaattacaggaagagattaaaaaattagatatcagatctattgcacagaatggtgacttaataatgattgtatatttcagaactgccaagtagattttaaatgtttttactacaaaaaaaagataagtatgtgaagtgatagatgttaattagcttgatttaatcattctacactgtaaacatgtatcaaaacattttgttgaacccagtaagtagatacaattattatttgtcaattaaaaataaaatttggctgggcacagtggctcatgcctgtagtctcagcactttgggaggccaaggtgggcagatcacttgaggtgaggagtttgagacagcctgggcaacatggtaaaaccctgtctccattaaaaatacaaaaactagccaggtatggttgcacgcgcagctgtagtcccagctactcgggaggctgagacacaagaatcacttgaacctggcagaggttgcagtgcgctgagatcgcaccactgcactccagcctgggcaacagaaggagactccgtctcaaaaacataaaataaaattttaaataattttatgtttattttattttatgtttatgtttattttatttaaaatttaaaaaattttaaataattagacattagctctaaagattgttccttggtataaaatgtaggattaaagcctacaaataatattggtatcattcaggaaattaaagtgtaaatcttttttgggaaaaattagtctttgtcttccaattaatgtttcttaaaaatctctgttggtcatagttcatacagttctcactatataagcttttatttggaaatagtattgcaagttgatacgagtctaataggacagactgatttggtcatgtaaagcctaaatgtctgacagactggtaacaattggttggcaaataaggtcagtaatggtttgacatgggaaagtcaattaactttatttttactcaacattcacaattcaattcaaacccaatctttcagttacagttgatcctgaattgagttgggcaagaacatatgcctagatccacacaaatttattctctagtggaatctgggaatgtctcctattcactcaacaaatgtttacgccatacctactgtatgtctactgtggtaggctcttgtgattcatcggttaaccaaagatcccatcctcttagaacttatattctaacaggtgagcaatagatacaataaataaattgcagctgggcgccgtggttcacgcctataatctcagcactttgggaggccgagacgggtggatcacttgaggtcaggagtttgggaccagcctggccaacgtggtgaaaccctgtctctactaaaaatacaaaaattagccaggcatggtgttgcacgcttgtaatcccacctactcaggaggctgaggcactagaatcactacaacccaggaggcagaggttgtagtgagccaagattggaccactgcactccagcctgggcaaaagagcaagactcagactcaaaaaaaaatctaaataaataaaaatgagtaaattgcatactatgttaaaaagcagtaaatgctgtggataaagtttatagagcagaataacagggaacaggagtactagggtgtgtgaagggaggttgcaattttaaacggtaaaattccagcagacttgaaggagattagagagataattaggtatgtaggtatctggggatgagcattccaagcaggtggaacaattggtgcaaagaacctaaggtgggagtatgcttggtgtgtttggggaacctcaaggaagagagtgtggcaggagtagagtataataggaaaaaaggtcagagaggaaaaatgggaggggcaccatcaggtcatgtaggatcttcatggatcaaaggactttggcttgtgttctcagtgaaatgagcagatgtgacagggttttcatgagatttcatccatatgacttaagtctttttggggtttttttttttttttttggagacagggtctcactgtgttgccgaggctggagtggagtggcatgatcatagctcactgcagcctcgacttcctgggctcaggcaaccctcccacctcaccctcccaagtagctgagactacaggtgtgtgccaccacgcctggcaaattttttaatatatttgtacgtagcaatagggttttgcctgggcctcccaaagtgctggaattgtaggtgtgagccacttatgtctttttttttttttttttttttttttgagacggagtctcgctctgttgcccaggctggagtgcagtggcacgatctcagctcactgcaagctccgactctgggttcacgccattctcctgcctcagtctcccgggagctgggactacaggcacctgccaccacacccagctaattttttgtatttttagtagagacagggtttcaccgtgttagccaggatggtctcgatctcctgaccttgtgatctgcccgcctcagcctcccaaagtgctgggattacacgtgtgagccaccgcgcccggccccaatttatctcttaataggactcttgtgactgttgttgagagtagactataagggggcctagataaaagcagtaacagaaactcaaattttgaagccttcttgtagactatggataacacatttggttaacaatgtgttattgttagggtctgactgctgagatttaaatcctgactctgttactattttagtaaatgacttctgtatcttcatttcctcatttgtaaaatgaaagtagtaatacctcacagagttgtgataattaaactcataatttaaatagtgccgggcagtgtaaacacataacaaaaattggttgttatcattgttagtgttctcatcctgtatttgtcaagcatgctaattctactaccatgatgtttaacgttctttcctttccatatgtacttaaaatattctagttcagaccgcagacagagcggcttgcctggactattatagccactaattgatttccttgcctcctgtccttctgtcccaatcttgcacaatactgttagattgtcacattatatccaagctctaaaaccttaatttctttcctcttgctttctacattatgtgcacattgagctcatggctctcgttcatgtaattccagctttcccttctccaacataagtacacagtactgcatgcctttcctcagactgtgggttctctcctgatcttgtctgcaatttgaaatacttttaatttcacctgaagtgctattgactatactttctacttcacttctcacatagtatttcccactgggtactgtaatcattcgtgtacttatctacttaggtttggaacattagatgcaagggattacatcccttagagcttcatgtttgtgttctactgtaactccatgccatgtagtaaatgttttaatactcattgaattgattttctttccattgtcattcttctctaggaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatggtaagagttggagttgtattttagttctctggttttgtaaaccagtgttcatctactagtttttatgttattcaatctagtgataagaagatagtcactattctggtatcccatggtacaactatgagtttaacttctatttgtaaagtgactgagaaggcattttctgcccgtgttatgtatagatacgtgtcatctatatgacatgtaaatataccatattttataaatgtagtaaatagtttcttttttctttttattttaaaaatattcctatgtgtatatatccaagtgggatagaaggaaaaaggaaaggaacttaatgttaatttctacctcctgtgtaccaggtattatgctgagtgatttgcatgtattattgctatgttttaattctcgtaacaggcttgtgagataactatcagctcttttgttttatagatgaggaaagatatgtttagaaaggttaactcactcaaggtcagctattatgtagatgagtcaaaattcaaatacagatcttcttagctctgaactttcctactctccaggtcttgccacatgggtactcctgccattggagctgtctgtaactggctatttttatttgttgtaatttgtaggagttagtggtaatcaagaaatggtgttataatatgtacactttgtggcttttcagtgacatgtttctaattccagcctagtttatcatttctgctaaatgctttaaaactgtcttttcacatagtcccaaaatttgttatgtgccatgatacaagtattacttttagtattaatctaaagcaaacagtaaagactttaatttttaacctaaactatttgcaacaaggaaagcatgggggacgggggatatatatgtactactatatttgtataatacaaataaattgttgacagtaaatatgcctttaaacaaataagcagatcttattcttagatgttggaacattgacagttttcccccactttataagcgtttgtatcaccatctagtggaaaacaaaagaactgttaaaaatcctacacttaaataggagctaagttaaaatgtaaaatcatagatctaaaatgaatatccgttgaccttttagtttgctatcagacaggacatgaatcattaaagataatcactgcataatttacatcaggtttaaattcacaaataagaatatctagaaaacaattccatattaggaaagtcttttgtaaccaatataaatgcttctggtttatttcttctttgtatgtaactatttagaaatttaattcacttgctttaaccttgttctgatcattttttacttggaatctgaaatttggttttaagatgtacgataaccttgagccatacaaatgattttaaaataattttaaattattttaaatagcatgtaactatttagaaatttaattcacttgctttaaccttgttctgatcattttttacttggaatctgaaatttggttttaagatgtacgataaccttgagccatacaaatgattttaaaataattttaaggccgggcacggtggctcacacctgtaatcccagcactttgggaggccaaggtgggtggatcacgaggtcaggagatcgagaccatcctggctaacatggtgaaaccctgtatgtactaaaaatataaaaaattagctgggcgtggtggcacacgcgtgcagtcccagctactcgagaggctgaagcaggagacttgcttgaaccctggaggtggaggttgcagtgagctgagatcatgccactgcactccagcctgggcaacagagcaagactccatctcaaaaataataataataataataattttaaatgctttaatgactaattagtcctgttctctaacttcccttgcttgcttattttaaggtttataatgctttttaatattactctcaagttataaatagtaaaaccatttcactttaccttgtccttattttggttttctttgaactaaatctttaaatattggagtgatttctgataaagcatgcttcagagtttccttcccaaaaatagaaactctaaaacaaagatcatggagataaatgatatagtatacattagattgattgatcatttgtttattgattgattatttgagatagggtctcactctgtcatccagggtggagtactgtggtgtgatctgtagcttactacagcctggaacttttaggctcaagagatcctcctgcctcagcctcccaaggtgctcagattacagtcatgagccactgtgcccagcccagtatacctttttaaattaacctgctgatttgtaacaaatataaaaagagaagtaacactaaaatgttactactctaggcaatttgggttagaagaagctgtctgttctagtcccctctctcccaatgtcttaacttaaacagctttgtttcttagtgaaattaaaggagcttacttcttagaatatgataattatgtcaataaaacagtacttatattggatttaaatacagataatacataaaaattttaaatatgaataaataaaaataatttgataatgcttttcatcattgtttattgtgtaatctcttatttttttctccccttagaaatgagaaaagtttccaagtcttcaactcatccacaacataatcctaatgaaaatgaaattctagtagctgacacttatgaccaaagtcaatctccaatggccagtaagcaagatactgagattactttacaagtttaaaattgtggttattggtgggtaacagtgacccacagtctaacttagacaatattttaaaggtattttccatataattttgtttatattactagtttactatctttttcatattggaaagtaatgttatcctattcatataaatatccctaatcatattaatataaattactaataattttaagtaaagaaggctttactgtgatttacttatttgttcaacaaatattgaagcatctgttgtataccaggcactgaataaaacaaagcccttgtcctcatggagcttatgatctagttgagggagaaataaaatttatgtcagatagaagcaagtgctctgaagaaaagtaaagcagggtaagaagggatattagaaagcctcacttgtaaagtgatgtttgcatagggactgagggagggaagtgagtcacgtggctatctgggagaagggcacccaggcagagaaattagcaagcccggaggctttgcagtgaagatgccatttggtttgtttgaggaacattaaggaaccctgtgtggctggagcagagtgagtaaaggggagattggtttggacaacaggaaaaatagagttaccatttactgagatggaagactgggagccgcaggtgtataggttggggcgggggtggttaaaattagaagtttggtttcggtaatattctgtttgaaatgcaaactcaacattcaggtagagtttggattcatgagtagatgtgagttagaatttagagaagttgaggatggagacacatatggaggtcatcagcaggtagatggcatctaagccatgaaactagatgagattaccaagcaagtgataatagatggggataagaagaagtccaagtattgagccttggggaacttcattatgtaaagtcatgattttcaacttttcttttgttgaacaacccccaccccagcatttttagacatttcccccctccccccagtcccttccctgctggaattttattactgcagatctactgtatatctgtttaggtgatacgtgtatgcatgtatgtctgtgctttatacatagtaaggttttttttgctcccccctgccccgaaccatttttcacccccttagagaaaatactgtagctgttgaggttgcgaaaatgagtaggaaccaacaaaacagagaaggagctgccaatgagataggaaaactaaaaatgatgtcctttaagccaagtggagagaggacgaagaggtgatcaactgtgtttaacaatgctaataagtcaagtaagatgaagacttcttagaattgaccatgagatttggttgcatgtagatcattgagtgttaaactagtaacatgataaaaattgttaaggtgtaatggtgaccatctgagatctgtctcatgttcaaaggaaactaaggacagagaaagtggaaagagcacacacaaacaagtactcccaagacattttgcagtaaagaggaggagagaacaggacagtggctaaggaagaacatgggtcaagggaggattttttttcaagatggaatattatagcatgatcggcatttatttatgttgataggatgatcaagtaaataggagaaaattaataattctggagaaagagggaacaattgctacatccttaaaaaggtcagaggagatgagatccagagcccagttgggagggttggtcaaggttaatcacttattcattttataatagtgtaaaagttacatactgaaagctacaaatcattttatattaacatgtgtgtctgtttgtctgtccatgagtatgtgtgcatgtgcatggaggctcagggtccagcaaagggtgctagggatacaacacagagggtggcagatccttgcttctcagctctctagaaccaattctgttctgctgctgccaggtctttgctccattatttgtcctatcttccttatacagtatctgcagcttctctgctggcttattattaagtatatacacatatatgttatcttccatctttaaaaaataatcccccttttaataatctccacctttagctacagcttctcttcagaggtgaaaaagtattaatagtctatactcaatatctctactttactaattcccattcactccaactcactgtaatatggattctattccccaacccccacctgcaagagaggaggagagagcaagagagagggaagggggagggaaggaggaagggaggagagagaaaagtgctagaggagtggggtacaggggaaggtagggagggagacttacagggattgaagagaggagaatgcattcacaaaccctttcttactccttacactggaactgattctgactgtaaacgtcgtcagtgttgctcttctccaaaatatatggtactgtgcctgttctatttctgtctctctatttatttatttattttttgagacggggtctgtccctgtcacccaggctggagtgcagtggcacaaacacagctcactgcagcctcaacctcccaggctcaagtgatcctcccacctcagcccctcaagaagctgagactacaggcacacaccaccatgtctggctgatatttgtatttttgtagaacagtgtttcaccatgttgccaaggctggtcttgctctcctagtctcaagcaggctccacctgcttcagcctgccaaagtgttgggattacaggcgtgaaccactgtacccggcttcactttctatctcttcctggaggaatgtcacctgcagtcagtagtcttctctgactcatacactaataaatcccaaacctgtatctctgtccgacttttttcctggtttcccaaccaatgtatctacctgctgttggatacctctacagggatatccttcaacttcagcatgtctacagttgacagttaacctgtcaaaccaactcttcatccttgcatttgcaatctcagtgaatgacactatacatgcctctttgagtcatcctagatttctgcttcatctgtttttgctaaacagcctctaagtcttactgattccacctcctgcatatctgttttacatattcttctgtgcccctattatactagtttaggctactagcatctctcatcaagacaacatgttctagtaatctaattagtcctcttgcctattagtgattgcttcttgcctaatgagtgtgtcacagccactaataccttttcagcccacacattgcatttgttttatttaaaactcttagatatctcttcattgtctacaggataaatttgaaactccttagcataacctgacccctaaccaacctaactgggttcatgtcctactcccatcttctgtagtttgacttctagcagtcaaaccacgcgtagttccctgaacaagcaattttgtttcactttctagacccttaattatacctagaattctactttctgtccccagtccagttaacttgccatattcttccttctctcgagtcagcttaggcatcacttgtaactttccttgatttcccagaagagatttaggagtccttattctgtgtttaaatcaccccttttatgtacctttattataatgtttatcacattctattgcagttctctttttacctttcaactatataagctccttgagaacaagaactttttcttttcatctactgcttagcacaatacctggaacataataagtgctccataaatatttgagttaacctttataaaatactagaacataggtgatttatgaatatgtgttagcttaacctgaaacatgcagtgctgacaacctctcctacaaagtatgttttcatgaaagagagcgtaaatatagtttgatattcatgctgtaacataagtcacaataattccactgtaaatccattttaagatttttttccccagtggcaataagaaaaattatctacctattacattcagttcatttaggaaaaacataaaatttacttgaaaaattttagcacgcatagacctgcaacttattgccatttatggtaggtattttggactttttgcacagaattttaaaatgtgtctagtgccatcttatgaagtgtgagccttttccttcatcttttgtcattttaatgtgtctagcttctacagttttgtaaaattggttttattatttattaaaatggtttattatttattcttagaagcacatggaacaagcagctatacccctgataagtcatcttttaatttagctacagttgttgctgaaacacttggacttggtgttcaagaagaatctgtaagtaattgtttagtttggcaataacatgaattaattttatgtctttttaggtcagttcttagagaattaagcaagagaattgttctatctaaagatcttgggtaaaggcctgaaacaaaacttacattgttagaaagtcctatttctgttgtccagcccagcagtctcagaaatgtagaatctagaattcttgggatatgggttgagtcaaaatttaggggagtaattatggcatagagattttgtcaactttcttcccttccccctctctcatgccccctccctgccctcatctaagagaagacctaaaccttcaggttgatttcagaattgttgttttgttttgttttgttttttagagatagggtctcattgtgttgcccagggtggagtgcagtggctattcacagacacagtcatggagccctatagcttcaaactcctggcctcaagtgatcctcccatctcagcctcccaaatagctgggactacagacatataccattatgcctagctaattttttttgtagagatgggggtctcaactgtgttgcccaggctgatctcaaacacttggcctcaagagatcctcctgcttcagcctctcaaagtgttgagattacaggtgtgagtcaccacatccagctgtactcttattaagttgtcttgctgttgaatttctaaaaattgaattagtttttcattacatatagatttttttgtcctttctagttttaaattcattcttaaatgataatgggtagtttttaacctttgaactttgaatgtgttttaatagtttctaattcccccctacccataaacctggcaagtcacagcttagacaccaaatagattaagggagctgaaatctaatgacttgctgcttgacgtgtgatccatgggccaatagcatctgcatcagttttgaagtttggtagagatgcagaatctcagacctactgaacttgcattttaacaaaatctccagttgacttgtatgcatgttaaagattgagaagcactgttctctaaaggattattttaaattcatctcctatcagtatgaatagttatctctattcccttcccctcatcttaatgttgttttttggaattggagttttatatacaaggagtagaatatacttgtgtaaaacattgaggcttttctctttaaacttaaaaagtgcttcatatttttcattgtggtgaaattaacataacataaattaattattttgaagtgtacaactcagtgatatttagtacattcataatattatgcagctatcacttctatccagttccaaagcatttttatcaccttcaaagaaaacctcatacccattaatcatgtatccccattctcctcccctcattcttccacctcccacttgcatcctctggcaacttccaatctgctttctgtccctagagatttacctattctgaatatttcatataaatggaatcatacattatgtggcctttgtctggcttcttagtatatttttgaggttcatctacatcataacatatatcagtacttcatccctttttaagaatgaacaaatcccattacatggatgtgcttcatattttactcttgaaggaaactcaaggtcccatgagcccccttggtgatgagctctaccactgtctggaaggaaatcacaagaaacagccttttgaggaatctacaagaaatactgaagatagtttaaggtaattaagggcacgttggtgaaaactgataagctattggtgagatcccattacaatgaatttcatataattaagccatttctctccttcaacatatagtttgttattgtggttatataaatgtttactttaaaaattgtctccctagtttctgaccaattgagagcttttttgcattacagtagaaaggtggatatcatttttagctactttctgtgtttctgtcaagcagtacttgttcccagtacttgtcactctgctcctttaaagagccagtcatcccttcggggtttatatttcccaaaactggatgttctacaaaatgcatctagaagcttggatgagcttccaagattgtgttgcatctcatttttactaatttcagaatacctattaactaataatacagccattccgtgatatcagtgggggattagttataggaccccctcccccatgggtaccaaaatccaaagatgctcaagtccgttacataaaatggccatcattattgcatataacctgtgcatatcctcctgtatattttatgtaatttccagattatttataatacctaatacaatgcctacatatcaatccatttgcaaagattcaacatagtacttggcacatggaaaattcaagttttgccttttggaatgttgtgaaatttggattttttacccaaattattttctagccacatggctgaatctacagatgcagaacccacagataaggagggccactgtacctgtatttatatagcattttgctttttaaaagagctttcagtttttagatatatagatatctatctatctatatatgtatatcacagtctgtcatcttagtaactgattaaagtagattttgttaccctaatttttgggtttattttacagattacaaaaatacagctccagaaaggttaaatgtcttgtttcaggccacatagctattaagtggtagagccagagatcttacccagcccacatcttcaaacttactgctctttctacgcatatttcctctgctagagacaggctgaatcttaatttatgttcaattctgtagtgtaagaattttgtttcttggagttactcatgatcaaatgtcgtaacaaaagaacttaggttctcagtggaatttattaaaatatgatttttgtttgtttgtttcttgagacagagtctcactctgtcacccaggcttagctcactgcaacctccacctcccaggttcaagtgattctcgtgccttagccaccagagtagctgggattactggcgtgtgccaccacacccggctaatttttgtatttttagtagagatggggtttcaccatgttagccaggctggcctcgaacttctggcctcaagtgatctgcccaccttggcctcccaaagtgctgggattacaggcatgagccactgcgcctggcaaaagatgattttttgtataataaagttatttaaagtacttaggaaaaatttttaaaatatgaatattatggtgttgagaaatacttcctatgtcattttcctctgcttttccccttctcttttgtcatctaaatgaagagaagccaaaagctgtaccttgtcttaaattttggttaatcatttgcttctaagaggtagataagaccttactattaattctgtattaaagaattgttatcactctttatttagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaaggtttgtgttaaatgttcaaggattttgattaaaatgattgcttgtgatttcatttagagctaacaattatttctgttttagagtgctggttctcatgagccaataaaaatacaaaccaggtcagaccatggaggatgtgaacttgcatcagttcttcagttaaatccatgtagaactggtaaaataaagtctctacaaaacaaccaaggtgtgtacaccataaacaggatctccacttttttaatgacttcagattgaatgtcattatttacttttttaaatagattgaattgttttggaaaaaaacttatttcttccttcaggtgtctgtatttataggacgattctcacattttaccggtgatttttctgttcttttttttttttttttttttttttttgagacggagtctcgctctgtcgcccaggctggagtgcagtggcgcgatctcggctcactgcaagctccgcctccccgggttcacaccattctcctgcctcagcctcccgagtagctgggactataggcgcccaccatgcccggctaattttttttttttgtatttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaggcaggagaatggtgtgaacccgggaggtggagcttgcagtgagccgagatcgtgccactgcactgcactccagcctgggtgacagagcaagactccgtctcaaaaaaaaaaaagaaaaaaaaaattgtttgccttaagatatataggcatcttttcataattttgctatattttattattattattattattatttgagacagggtcctactctgtcacccagactggagtgcagtggcatgatcacggctcacttgcagccttgacctcccaggctcaggtggatcctcccatctcagccccctggatagctgggactacaagcatgcaccaccacacccagctgatttttttattttttgaagtgactgggtttcgccttgttgcccaggttggtctcgaactactggactcaagccatctgcctgccttggcctcccaaagtgctgggattacaggtgtgaaccacccacgcccagcctgctatctttaaaaaagtaattttttttttcagccaccaaacatttctgtagttcaagtgcagtattttttcttgtattcttcattggcaagttattcctttattctgggtttattttccctttttcctgaagcacagtcattagttgtttttccagtgagtgttttagtctctatatgaaaacatttttttcactatcattcatgattttttttgagctttttgtttttatttttttcatggttgctctagggattacagtatctacctacttagccttttacaatctacttggagttaatgtactatttcatgttctgtaactacactttatgtagttcctgtgtattttatctacatatattgaaaaccccatcaatgttatagtttttaattttaaaaaattttaattgaaatataaatcacataccataaaaatcacccattaaaatgttcaattcagtggtttggtatacccacagagttgtacaaccatcactgtagtctaggtttacaacattttcatcactttccttccccatataccctctgcagtcctaggcaccttaaatctactttctctctttgtagatttgcctattctgggagttttcatataaatggaatcgtttaatatatgatcttttgttacttctttcacttggcataatgttttcagttatctgtgttacagcatatatcaatattttatttctttttattggataattttttattgcataagtataccatattttaggtatttattagctgacattcaagttgtcacttttttgctattatgaacaatgctgctatgaacatttgtatacaggtttttgtgtggatgtatgttttcatttttcttggattatacctaggagtggaattgttgggccatatgccaattctacattttaccttttgaaagactgcctgttttccaaagcagctacaccatttcacattcccaccagcagtatgtgagggtcccagtatctccacatcctcactagcacttgttatagctttttgatttttgccatctcgtggttttggtttgcatttccttgactgctgatgatgttgagcatcctttcatgtttattggcaatttgtatatcttctttggagaactgtctatttagatcctttgcccatctttaattgggatatttgtctttttattatggagctgtgagagttctttatatatcttagatataagtcctttaccagacatatgatttgcaaaaattttctattctttaggtcccataatattttaaagtgatgagaatttttgaaatcagttttttaattgcatgctctttccctttacctaagatgtatcctttgaaaatatccagtggagtatagatccgggagcagacctttctcagtataaaatggatgttactgtaatagatacaaaggtaagttaaaaagtaaaaccaaaactcatttgacttttattccaatgagttgttagtcaacctcctctcgtgactcactgtatcaccttaagataatcagatacgtcttaaaacctacatgtatttatgcagaaaattaagaaataaaaatgcttattcttctaactttatggtattttttaaagggtaatactttctgactttaaaggcctttactgaaaaatattaatatagtttttaaaagaatgcagtgggcaggcgcagtggctcatgcctgtaatcccaacactctgggaggtcgaagagagagaatcacttgaagccaggaattcgagaccagcctgggcaatatagcaaggccctgtctctataggaaattttaaagttagctgggcatggcagtgcatacctgtagtcctagctacttgggaggctgaggttgggaggataccttgaacccaggaattcgaggctgcagtgaggtatgatcacaccactgcacatccagcctaggcaaccagagcaagaccctgtctcataaattaaaataatgcaaaatgctgcatatcttatataattttatcattcattaaaataattcatcatgtcttcattacctttaaaataatgtaccataaaattcattttccaagttgactatttttaaaagttaaaattcatagtggaaatagttttttgtcttgtatttagcttctgtgtagtttcagaagttctctttcacttggtagcatattaataacaaagtatttaacatacgctgagtaatatatgcctatcaagaaatttaatttaatttttgaaagtgttcttagtgtacattgatgttcattactataaggcaaattggaaaataaaggcaggaaaagttcaggggtgtttagtgataaataattctccctttccttggcagcagtccttcttttcctaggcttgattatattgaagctaaaatgttttataagcagtaaaacctaaatccttacctgttcgtaaagtataaaagcaaataaagcttaatgcttaaaagttgtaaaatgtatgttatgtatattttaccaaaatgttttgtaaaaattaaatataagaccataaaggaataattgttaaaatttttgatttttaaaatatttatttaggatggcagtcagtcaaaattaggaggagagacagtggacatggactgtacattggttagtgaaaccgttctcttaaaaatgaagaagcaagagcagaagggagaaaaaagttcaagtaagatctgtttttgttttgttattttttttaataacgttgtgtgaagtttgtagttgtaccattgcactgattagctcaagtgacctcttcaccataaagcaggttttttcctgctctgttaactttatgttcctcttaggaaagctcagtttcagtgcgtcagaaaaaaagtctttaaccaaactaatttcatttcagaaaagattcatatggcttccagggatttgcaaatgacagccagctaccagttttgtaaataaagttctaccagagcacagccttattcatttctttatgtattgcccatcgctgtttgttccatacagctgcagagttgagtagttgatgcagagaccttatagccccacaagcctaaaatagttattttctgaccctttaagaaaaagtttgctgatccctggtgtagacaattttttataagtggtataacagtaagtcttgagtcctgtgttagaattaacgttttctaaagaaatttgataaggaaagaaaggagaaatctaccgagaagtcttagtatagttttacaggttaacattcagaatgatagtgtatatgctgagttaatctgctgtattccacctctactgataaggcaatttggccaaattagtggtctacagccctttgtagtgagaaactattaattctttacccaaagtcttgattttccggaagagatgagaacaataggaggattttggttagcagtaccttagcaacattcctaactgtagaggcacatgacatgagaacagctagactatgaacagttgtcatttatcatccttatgtattgaagagcgagggcctgccacatggggaagcagtgctaaaagcagagacattccccagtgatcatttgttagaagccgaatacattgaggctgggtgtgcattccttatcttctgctgaattttctatagtctacctgctcagagcaaaaaataaaatagtcttgccctggcttcttttgaatctacttatctactgctgccttaaatgcagtaaatcaaagaaaactttagtagtctttgccttatttgttcttcaatgacaaatagcaaaccatatgatgaagcagatggttacctgggtagagaagccaatacctattaaaagaaaaaaccttcacagtagtttattgccattttatggcttgtatgacactaaataactcttcttaagaggatactttgcttttaagattattttgttcctgatactagcctctgatcatgtttttctcatttttgtagaaaagagaaaatctaaagtatgaccactttaaatctattcagaagacaatagtttctcaaatttatttgatgcaagtatcatgtgaaagagaaattagcacttggactaatgaggggaaattatagagataattttggctaataaagtgctatggatagtattgctacataatgaatgaatcacttgaataactcagaggattcaaacaataccattttcttatcttcatagttcctgtggctcaggaattcaggaaaggcttggctggtcagttctgtttcagggtctcatgcagttgtaggcagatggtggctggaactgaaacagcagagggctgggcagctggagagtgaattggcatctcctcatttactctcagggcttattcacttaggctcatttgagcttcctcttcacatggaggataagttcccagagttggcaccccaacagaacaaagcagaagcaggtgacatttttatgacctcagaggtaacatagtgtcacaaagatctgcacaggcataaagcgaaatgaacaggccctcagtgacactcagtgggaggagtgttgacatcatgttgtaagaaccgcacatggaataggagacattagtgaggttatattaaaaaaaaaaaaaattaccccataaggtaaaacttttccagcacttagaattggtttaaaatgaaatataccaataaaaattccatattactgccagtatttcaattcagaaaattttcatgcacctactctgttagattttctaggtgctgtgacagaaagatcaacaaggatatactctctgtcttcaggtatttcgcaatcacaaatcaaacaaaaataaatcatcaatttaacattttgctttacaaacagcatacacagaatgttccgaggatgcctagcacaatgcctggtgcatagaagttgtattttatttacatatttgaccttcagcatgcagaataaatgtttaattatcaataaatatcaagcaaaaattttgtagtaggaagtattttaggaactagagataatgaataaacagaacaaaagtacttaccttatggaacgtacattctaatgagagaaataagcaattgtatatataatagatgatggtaagtccaggagaaaggtaaagcaaggtaagagtgagagagtgctgtgcgttgggagaggtggtacttatatagaataatcttaggcctcttttctgtcatatttgttagccaactggatttaaactctagtgttttttaaatgtgattatataatgggaaatgtggttagatctgtgaagatgaatttttcattttccgtgtcaaatatggcattgaattcctaatttctagtaatactaaactaccagatgctaatgaagatgaaagaaaatacttttttgctacttcattacaaaaagtaagcatgaaaggtcgagcacagtgactcgcacctgtaatcccagtattttgggaggcctaggtgggcggatcacttgaggtcaggagtttgagaccagcctggccaacacggtgaaaccccatctctactaaaaatacaaacattagccgggtatggtggcgcacacctctaattccagctacttgggaggctgaagcagaaggattgcttgaacccaggaggcgaggttgcagtgagccaatatcgcctcactgcactccagcccgggtgacagagcaagactccgtctcaaaaaaaaaaaaaaagcatgagtaaagaacatttaaagccataacataaagcctttgtaaatgtacagtaactacccagagttgggagtttattcttacctcatacacagattacaagaattaaacctcattataagaatcatgatttaagaagtgtctttaaacacttcattacatacgttacagtttgctactcactgagagtaactgaattaacactcagccttacagcttgcaactaatattcttagaatcatgttagcatgtgtccacaaacacttcactacatgcattacatctgttcaccaaaagaacactcttcacagctaggcctgcagccctcatcataataatcatgcctttaaacactttattacatacattatagtttgttactcacttatattcactgaatttaacactcttaacaagacagcttgcaagtaacattcttagaactatcttttacatacgtgtctacaagcctttcactacctatattacatctattcactgaaagaatactctgcaaagtaaggcctgtaatccacatttttttaaaacattttttaaactatcaaatttttattttaggtttgtgggtacataagaaggtttgtaacatagataaacacgtgtcatgggaatttgttgcacatattattacattacacagttactaagctcagtacccaatatataatccatattttaacaaccgtattttaagaagtgtctttaaggactgcattctgttattgtgtggtagttactacagtttcatgatggtctacatattaagcaaaagcttgcttattgccctaagccagtgctcttttacatagatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacagtaagatttttttctgtttaattatggcttctcagttgcagaattcagtaagttaagttatcaagctaattaacaaaggcttgatgacatatcaacaattgaagtttcatatttcttgtataaattttttcaggtttttaaaattttgagataattttacactgataagagttccagaaaatttttcagcattctcctgtacctttgacccaacctctccttatgttaatgtgttatatagctataaaatatttattagaactaagaaactaagattagtttggtattacaaatttctttctaaatacgcataaaattgataaaatttttgagaaatgtctattaattattaaattaattgtaatagagtagaaggagaaagttttgtacaacattcagatccagccaggcacagtggttcacacctgtaatcccagcactttggaaggccaaggcagacagattgcttgagctcaggagagttcaagaccagcctgggcaatgtgataaaacctcatttctacaaaaattagctcggcatgatggcacatacctgtagtcccagctacttgggggctggagcgagaagatcgcttgaacacccaggaggtcgtggctgcatcagtgaaccgctgactgtacttcagcctgggcgacagagtgagaccctgtctcaaaaaaataataattaattaattaaattcaaaaaaggaaaattcagatctgttttctgctgtgaatgctttatcttaccagacaaaatacctaatgtaactatgtgtattagtcttaatatctctttcattagaagcagtaactttataatgtaggatagcaatcagaaaaagaatactctaattgaaaatctaagtagataatctggattgaaaattgtaatttttgttaaatctctcatttttctccttgttttattaaattggtccgaatttttaatctagtgcaaagattgttttatgctggtttaaatgaacataccttctactgtggcacaatcttgattatgctcatgtttccatcaggtttttgaaacaacagcccttaactcaaaagtgagtgagacccaaaccaaagatagaggacagtaggcttttgcttgcttagtccatggcaaaaactccatcaagtaaattttgaaataaaaattcacagctgttcggtatcctttttccccccaagaaggaccttttgcaaataggtttcatttcaaagaaaaagactatttttcgcaaaggtgtacttattctgttccttcttttaagttacatttgacactgactatcccagaatttcttctcacttagcttttctgacgatgctgcctcgttcttttcatttgtcacagcttgtttcctagaatatccccaagactctttcttcctcacaacttttctctcacaacttttatcagccttacctctgaaaatgattccaaatctgcatctctaggtttgatttctctgatgaatcccagtcttgcatttctgagtactgtgagatacttttgcgtctcttcagcttaaacgtaatgtctaagccaatttccatttacttccaaccaaataatcttcaaacgtttttatttttcccagtcacccaggcatataatttaggatttgttacatatttattttattttctcaacccagttactaccttgtatgtgctttctcacataacccttagctgtctacctgcttaatgtttaactctctgcttgcttaatgtctattttcttcactgtaatgtaaactccatgaagacaggagacctgctctctcgttacacattgtatgtctggaacttagcacaatgctcagtaaattttgattctttgaatagatgctagcgtttagctatttgagtctagacatcttaggagtcaagtcccaagttctgagctctaggttttaatctttgtcaccaattttctgataaaatctttaatctgtttattccctagttataacttaccttaaagatgcattgtaaaaatcaacaggattggtgacaatgtaaattagtatagccattttagaaaatgatatgaagattcctcagaaaactaaaaatggccaaggcgggcggatcacgaggtcaggagatcgagaccatcctggctaacacgctgaaaccccgtctcctgaaaatacaaaaaaattaaccgggcatggtggcaggtgcctgtagtcccagctactcgggaggctcaggcaggagaatagcgtgaacccgggaggtggaacttgcagtgagccaagatcacgccactgtgctccagcctgggcaacagcgcaagaccccgtctcaaaaaaaaaaaaaaaaaaaaaaaaaaactaaaaatggaactgtcatagatccagcagtcccactactgggtgtatatccaaaggaaaggaaatcagtatgttaaagaggtatctgcactcacgtttattgcagcactgttcagaatagccaagatacggaatcagcctaagtgtctacttacagataaagaaaatgatatatagctagataggtgtatatatatatacacacacacacacacatatacatagacacacaaaaatactatttaaccactaaaaagaacaaaattctgtcatttgtgcaaacatcgatgagcttggagaacatcatattaagtgaaataagccaggcacagaaagataaataccacatgttcttattcatatgtggaatctaaaaaagttgatctcatagaagtagagagtagaatagcagttactagaggtggggaaggctgggatagccaaaggtgggttaattggtataaaaatatagctagccaagcaaggtggcaggcacccatagtcccagctacccaagaggctgaggcaggaggatagcttgagccttggagttcttggagtagtgctgtattggagttctgaggtatgatccatattaagtttggcatcaatatggtgacctcttagaagcaggagaccactaagttgctcaaggagcagtgaactggcccacttcaaaaatggagcaggtcaaaacttgcatgctgatcagtagtggtgcggtgcctatgaattgcccctgccctccagcctgggcaacatagcaacacctgatctctaagaaaaataaataagggagccgggcacagtggcttacgcctgtaatcccaacactttgggaggccgaggcaggcggatcacaaagtcaggagatcgagaccatcctggctaacacagtgaaaccccgtctctactaaagatacaaaacattagccgggtgtggtggcgtgcgcctagtagtcccagctacttgggaggctgaggcaagagaatctcttgaacctgggaggcagaagttgcagtgagcctagatcatgccactgcactccaacctaggcaacagagcaagactccatctcaagaaaacaaagaaaaataaaaagctaaatagaaggaataaattgtagtgttcaatagcactatatggtgactataattaacaacaatatatgttctcagatagctaaaagcacagattttgaatgttcccaacacaaagaaatgacaaatgtttgaggtgacagatatgctaattaccctaatttggtctttacacattgtgtacatatatcagagtatcacactgtataaagatgtatacttatgtgtaaattttttttatttttttgagacggagtcttgctctgttgccaggctggagtgcagtggccaatctcagctcactgcaacctccaactccctggttcaagagattctcctgcctcagcctcccgagtagctgggattacaggcatgtgccaccatgcccagctaatttttgtattttgagtagagacagggtttcaccacgttgccaaggctaatcttgaactcctgggctcaagccatccatctgcctcggcctctcaaagtgctgggattacaggcttgagccaccacacctggccagtcgagctgtctttgtcagagtatctctaaactgttaaattgctactttggttaaattaaaattatttacttnnnnnnnnnnnnnnnnnnnnacaatctcagctcactgcaacctccaactccctggttcaagaagattctcctgcctcagcctcccgagtagctgggattacaggcatgtgccaccatgcccagctaatttttgtattttgagtagagacagggtttcaccatgttggccaggctgatctcaaactcctgacctcaggtgatccacccacctcggcctcccaaagtgctgagattacaggtgtgagccaccacacccggccaaaattaatattgaaagctgtcttttgttgttctttcttgtcaaatgataatagtgggcatctgagtatttcttttatactctaaaatacttcctgagataatgacttttagctgtctagtaattttgagttgaatgaaacagcaccctcctcattatgcagatgcaaaagaaagaaaaaagtagttgcagaggcagggtgcagtggctcacgcctgtaatcccagcactttgggaggccgaggcgggcggatcatgaggtcaggagattgagaccatcctggctaacatggtgaaaccctgtctctactaaaaatacaaaagattagcccggcatggtggtgggcgcctgtagtcccaactactcaggaggctgaggcaagaggatggcgtgaacccgggaggtggagcttgcagtgagcagagattgtgccactgcactccagcctaagcaacagagcaagacaccggctcagaaaaaaaaaaaaatagttacaaagttgcagaaaatttaaatgagttgctcagaggcctggagcatgaaacccaataaaaatggaagtttgagtgcgtgtcattttcttccaagctagttaattatttctcattaagttctacatttagtttgtaatgtgcatgttttatttatagctcatggtgataaacaagacaaagtcaagcagaaagcgtttgtggagccgtattttaaaggtgatgaaaggtaagttggtttttatttataccagcaatgtgactggaagtacaatagagctgtcttttatttctctctcttttttctttttttttaaagacagagtcttgctctgtcacccaggctagagtgcaatggcgtaaactcagctcactgcaacctctgcctcctaggctcaagcaatactcccacctcagcctcctgagtatctgggactacaggcacatactaccacacctggctaacttttttattttttgtagagacagggtttcaccacgttgccaaggctaatcttgaactcctgggctcaagccatccatctgcctcggcctctcaaagtgctgggattacaggcttgagccaccacacctggccagtcgagctgtctttgtcagagtatctctaaactgttaaattgctactttggttaaattaaaattatttactttatggtcataaaaaagagactcaagcataaaaacgacaaattttacaaataaggaaatttttggcaccatcacctttttttggcagtggtaatagttattttctctgcttttgtgtgtgtgcgtgtgcgtgtgtgtgtgtgtatttcttttttttttttttttggagacagagtttcactctgttgccccggctggagtacagtggcgcaatctcggctcactgcaacctctgtctcctgggttcaagttattctcctgcccccgcctcccgagtagctgggattacaggtgcccaccaccaggcctggataatttgtgtatttttattagagatgggatttcaccatgttggccaggctggtctcgaactcctgacctcaggtgatccacccgcctcagcctcccaaactgctgggattacaggcatgagccaccacacccagcctgtctgttttattattttttttaaatgtctttttattctatcttttcaacttggggcatttattaaattgtataagttttatgtagtataagactttaggtaggccaggcatggtggctcacgcttgtaatcccagcactttgggaggcccaggcggggggatcaaaaggtcaggaaattgagaccatcctggataacatggtgaaaccccgtctctactaaaaatacaaaaaattagccaggtgtggtggcaggcacctgtagtcaccactactcaggaggcaggagaatggcgtgaactcgggaggtggagcttgcagtgtgccgagatcgcgccactgcactccagcctgggcaacagagcgagactccgtctcagaaaaaaaaaaaaaaaaagactttaggtagtaagacttaggtttattatgcttcagaattattttataaggatttttgaatctttaaaaacaaaacctttaagcatgttttgtttttttggtttttttttttgaaatggagtttcgctctggttgcccaggctggagtgcaatggcatgatcttggctcactgcaacctctgcctcctgggttcaagcaattctccttcatcagcctcgcgagtagctggaattacaggtgcccaccacaacacctggctaattttttgtatttttagtagagacagggtttcaccatgttagccaatatggtctcgatctcctgacctcgtgatccacccgcctcggcctcccaaagtgctgggattacaggcatgaaccaccacgcctggcgctaagcatcttgatttaaccataatgcgaccttctgcctttcacaaggactgcaaattctgttacttatagtcacctactatttgttcttaaagcaaattgaagacatagtaattcattcaaaaaaaattgttatttttttctttaagttaagatgttggtaaattgagttactcagtaaagttactccttttatttttatttctgttgagaattttagaaatctaacaggccaagattttttttattcctctgaaactcttaaagagctgtcattttgtttaatgcttaattcttcttttttagttaccagttttccaaacaaatggtactctagcattccaaatgtgactaggttgttttttgtttaggtgtcattatatactcatcaatttaagtatatttgatgtgttgtaatccattgcagtcattatccttagagatacccagattgtcccatctttgcctaaaggaaaaggaagcttctttcataggtttcttgcttctgttatctggaatctgccatttttcttggagccctagttccttttagtgagaaatggtgtttaggccacagtctggctgctagggttgcactttagtcattgtttctcagccttttaggtggacagagttaggaaaaagattttttgtatgactttgatttttttttttttttttttttttgagacagagtctcactctgtcacccaggctggagtgcagtggcacaatctcggctcactgcaagctctgcctcctgggttcacgccattctcctgcctcagcctcctgagtagctgggactacaggcgcccaccaccacacctggctaattttttgtatttttagtagagacagggtttcaccgtgttagccaggatggtctcgatctcctgacctcgtgatccacccgcttcggcctcccaaagtgctgggattacaggcgtgagccacctcgcccggccatatcactttgattttttaaggtaaactatacttcatactgatcgctctaactcaaattcaggaccacaggatatttatgtaaactcctctatcttacatctttatttactttcccacctactgaaaatcccacttctcagtgccaccaacataattccttaatttattttattccacaatacacataaagcagtttcagaataataccaccaataatataattaatgaaaattgtttgaaaactttttgtatgctcttttgtccttaaaatatattctattagaaatgtacagtaaaatcactgcgttttttttttaaagtcatttgggataattattttttgcagttatgccaccaactcagtaccttattttgcttttgattttttaggaattgggtttttttcttttcatatttaattcttttaaaagtacataaagtataatgtattttatatatatatatataaaatgtatataatggacacaaagtatgtacattgtaccagactacaagtatattcagataaatctcacgtctattcttggcctctatatcttatagctccctatccctataggtaatcatttgtttaaaatttatgatttttcttctatcctaaaaaatagaagcaaatacatgtatatagtcatgctatccatgactcatatagaatattatatatactttgctctactttgcttttttagacggagtcttgctctgtcaccaggctagggtgcaggggcgccatctcagctcactgcaacctccacctcctgggttcaagcgattctcctgcctcagcctcccgagtagctaggactacaggcatgcgccaccacgcgcagctaatttttgtatttttagtggagatggggtttcaccatgttggccaggatggtctcgatctcttgaccttgtgatctgcctgccttggcctcccaaagtgctgggattacaggcatgagccactgcacctggcctgctttttttatttaactatagatcctggaaatcactcaagttgtatatagcgatattcctcatttctttttagctccatagtacttcattatgtgaccctactgtagtttataccctagcagtggacacttgggttgttgacagttatgcctagtgcacacagtgctgcagtgaataaccttgcacattctcttttcatatttttgcctgtagatcattgagatagattcctagaagtaggactgcagagtaacaactgtcattttccaggtggctcatgcctgtaatcccagcacttcaagaggctttggcggaagaatcgcttgagcccaggagtttgagaccagcctgggcaacacagtgagacctcgtctctacaaaaattaaaaattagctaggtgtgatggtgtgtgcctatagtcccaactactcaggaagctttgagaagatcgcttgagcccaggaagtcaaggctgcagtaagctatgatcacaccactgcactccagcctgggccaacagagtgagaccctgtctccaaaaaaaaaaagaactgtcattttaaatgtttcatgttaaaggttcactagttttttagaaaatatgtatgagtagttttatttattctgaagcaattagatagctggagaacaagaggtgaatggaagtgtggggatggaggcatggagatgctagaattctcagagttacattgttgctttttccactgagaatactaagactgcaaacctgggaagatggattgtgtagtatcagggacaagaagcttgtttaagtgatgctttgaggtctactacagatgccgttctgctaggagattccctacgtcacgataagacactatagaagtggagtagttaatattcagaagaaaggatatggccaaaatgtgatctgcataatcttaggagtccataaactctttgaaagaaaatatagttgtggcaatattttttgtgtgtacttttctggtttcccttttctaattcacagatcacaccagagctgagggttcttgagttgaaacaaaaaaggacttatacttagagtgactaaaacttttctttttgagggaaagtgcttgccaactagaggggcatgtatgtgatctttttattacacttctatttaaggtatactttctgtttcacggtgctttattgcactttgcagatactgttttttacaaattgaaggtatgtggcaaccctgtttgaacaaatctgtcagcggcatttttccaacaacatgtgcttacttcatgtttctgtgtcacattttagtaattctcacaatatttcaaactttttcattattatatctgttacagtgttctgtgatcagtgatctttgatgctattttttttttttttttcgagacagagtctcgctctgtcgccaggctggagtgcagtggtgccatcttgtctcactgcaagctctgcctcccgggttcatgccattctcctgcctcagcctcctgtgtagctgggactacaagtgcccgccaccacgcctggctaatttttttgtgtttttttagtagagatggggtttcaccatgttagccaggatggtctcgatctcctgacctcatgatccgcctgcctaggtctcccaaagtgctgggatcacaggcgtgagccaccgtgcccggcctgatgctgttattataagtgttttgggtcatcatgaacgatgcccatgtaagacagcgaactcaatcaatgaatgtcgtgtgtgttctggctgctccaccaaccgaccattttcccatctctcctcctcttcttgggcctccctattccctgagacacaacaacattgaaattaggccagttaagaaccctgcaatggaagcaggcatggtggctcatgcctgtaattccagaactttgggaggctgtgatgagcaaatcgagaccagcctgggcaacatggaagaactccatctctacaaaaaatacaaaaaaaattagctgagcgtggtggcacacgcctgtagttccaactgttatactgcgggaggctgaggtgggaggattgcttgagcccaggaggtcgagactagtgagctgtgatcgcgccactgcactccagcctgggagacaaagtgagatgctgtctcaaaaaaaaaaaaaaaaaaaaaaaaaaaccaactatgatgccctttaagtatacaagtgaaaggaagagttgcacatctcttacttttaaatcaaatgctagaaatgattaagcttaatgaggaagatatttcaaaagccaagatgggtaaaaagctaggccttttacaccagtcagccaagttgcaaatgcaaaggaaagttcttgaagaaaatcacaagtgctactccagtgaacacatcaatggtaagaaagtgaaacagactcactgctgacatggaggaaatttcagtggtctagattgaagatcaaaccagccaccgcattcctttaagccagtgcctaatccagagcaagcctctaactatttagtttgaggaagctgcagaagaaaagtttgaaactagcagaggttggttcatgaggtttaaggaaagaagccatgtccataatataaaagtgcaaagcaaatggcaagtactgatatagaagctgtagcagcaaatgatctagaatatctggctgagatcagtgatgaaggtggctgaactaaacaatagattttcagtgcagatgaaacagccttctattggaagaagatgccatctatgactttgataactagagaggagaaaccagtgcctggcttcagagcttcaaaggacaggttgactcttgtttgggttaatgcgctggtgacttcaagttgaagccagtgctcatttaccattctgaaaatcctaggaccctgaagaattatgctcaatctgctgtgcctgtgctttagaaatagaacaacaaagcctggatgacagcacatctgtttatggcatggtttactaaatattttaagcctattgatcagaaaaaaaaaaaagatatcctttcaaaatattgtaatcatccaacagttgttttttctttttttcccaccatacaaatagagctgattcactgagacagtgatattatagtagagaaagagtgtaataattgcagagttagtcaagtgggaggactggagttattatttaaatcaccttcccctaaaatgtggaagctatggttttttaaggatagtttggcagagagggagctgggaacggggaatggagattggttgggttggggatgaaattataggggtcaaaggtgtctttttgcagagtcggtttttgggtgggatcacaagatcaattgaaccagttttttggtatgagttaccagcgcaggtgagcccacctggtccgtcagaatgtagggtctgaaaaatacctcacaccccaaggttttataatagtaatatcatttgtatgtaggagcaattgaggttagaaatcccatgacctctgtctgcatgactccactactgagctataattttaacctcttgactgatttgctggttttacatagatggtttaagtctctgagcaagaaggaggagttagttttgggaaggagctgataatcatctttgttttaaaataacctcgtggctaatttgttagttttacaaaggtggtttcagtccctgagcaaggacagggctgatttccagaaggagctgttgtcatctttgttttaaagttaaactaaatttttctcatagttaatttggcctatgcccaaaaataaagacagcttaaaggttaaaagcaagataaagtcagctaggtcagattttttccactgtcataatttttgcaaaggtgacctcaatactactgttcattgacaaagcacgttgtcacccaagagctctgatggagatgtacaaggagatgaattttttatttatttatttatttagagacagagtctcactctgtcacccaggctggagtgaatggcgcgatcttggctcattgcaacctccgcctcccgagttcaagtgattctcgtgcctcagcctcccaagtagctgggattacaggcatgtgccaccacgcctggctaattttttttttttgtatttttagtagagacagtgtttcaccatgttggccaggctggatgaatgttgttttcatgcccgctaacacgtatcgttctgcagactggatcaagtagtagtttgactttcaagttctcttatttaagaaatacagtttgtaaggctatccctgccattgattcctgtgatgggcaaagtaaactgaaaaccttctggaaaggattcaccattccagatgacattgaaaacattcatgaggccaggacttcaagaccaacctgggcaacatagtaagacctcatctctactaaaaagcaaaaattagctgggccttgtggcttgcacctgtagtcctagctaactcaggaggctgaggcagggggattacttgagcccaggagttcaggctgcagtaagctatgctcatgccacttcactccagcctgggcaacaaagcaagaacctgtcttaaaacaaactaactaaataataatgaataaaataaaatgttgtgcttcttgattgctttttcttcccaacgtactccatagcatattaatccatacctagtggctttgaccctcctaggtttccgtgattcacagtaggatcttattcatttaaaaataacaacaaatgatagttatgcctaatattttgaagaattcatggtaggtggaagcagcataaggtaatttttctttttcttttttctggtttttttttgttttgttttgttttgagacaggatctcactttgttacctaggctgaagtgcaatggcacaatcattattcactgcagcctcaaactcctgggctcaggcagtcctctcacctcagcctcctgagtacctgggactataggtgtgtgccaccacagccagctaattttttatttttattttttgtagagacaggtggtttgatatgttgcccaggctggtctcaaacccctggtgttggtctcaagcaactcttttgccccagtctccctaagtgctgggattataggcatgagccaccacacctggccagtaatgtttctcataaataggatggcaaatggcatacaaacagatgaatctgttctctgggcagaagaagttagtcctgaaatctgggttcttagtactggaaaacaggcagtatttttttttaatgttatacaatgccaatttatgagtttcataatacagtattcatttttaaataggttattatattttacctcctaacctaattgttattttcagccagtgaaaggcagaaataagaagtaatagtaattgcctttcagtataatcccacttgtatatttttgcttttattgtctgttattttgaggtcttattcataaaatcttttcccagaccattgtcctgaaacatttcccgtattttttttttctagtagttttatagttttgggtcttacatttagttctttgactcattttgagttgatttttatattgagtgagaaataggggcctattttcattcttctgcagtggatatccagttttaccagcaccgtttattaaatagactatcctttccccaatgaaggtgcgtggctcctatgtaaaaaaaatcagttgactatagaggcattcattaatttctggtactctgttccattgctctatgtgtctgtttttatgccagtaccatgctgttttggtaactgtagcttcgtatattttcaagtctgatagtatgttgccgccagcttgtttttgtttttgtttttttgctttttttctttttttgagacagagtctcacccaggctagagtgcagtggcatagtctcagctcgctgcaacatttgcctcccgggttcaagcggttcttgtgcctcagcctcctgagtagctgggattacaggcctgtgccaccacacccaactaatttttgtatttttaacacagacatggttttgtcacgttggccaggctggtctcgaactcctgacctcaagtgagccactgcgcccatccagctttgttcttttttgctcaggattgctttggctattggtatgactttactggtttcagactaattttaggattttttttttatatttctgtgaaagcctgggcacagtggctcacgcctgtaatcctagcactttgggaggctgaggcgggcagatcacctgaggttaggagttcaagactagcctggccaacatggtgaaaccccatctctactaaaaataaaaaattagccaggcgtggtggtacaggcctgtaatcccagctacgcagaaggctgaggcacaagagtcgcttgaacctgggaggtggaggttgcagtgagccaagatcatgtcatgcactcaagcctggccaacagagcaagactctgtctctaaataaataaatatttctgtgaaggacattattggtattttgatggggattacactgaatttgcaggtcactttggatagtaaatagttttaatttttttagttagaaaaaaatacccataaaaatacttggtgtatatatagtaagcacttaataagtatttgacgaagcaatatttttctaacatactgaataaacatttcaaataaaaatgaatgaatgttttggggattatttctcctctgaactctaagctttgttaatttaattcatttttcccccagagagactagcttgcaaaattttcctcatattgaggtggttcggaaaaaagaggagagaagaaaactgcttgggcacacgtgtaaggaatgtgaaattgtaagtactaatgtagatactaatttttttttaagtacggctttatagataataaatgcatgattttaaaatcacgtatacaaaccatattggttatagaaacctcttatttgagccaggcgtaacagcaggaataaggagtattctgggtcgggtgcggtggctcatgcctctaatctcagcattttgggaggccaaggagggcggatcacttgaggccagaagatcgagactggcctggccaacatggcgaaaccccatctctactaaaaatacaaaagtaagctgggtgtggtggtgcacacctgtaattctagctactcagaaggctgaggcaggagaatcgcttgaacccgggaggtggaggttgcagtgagccgagattgtgccattgcgctccagcctgggcaacaagagtgaaacttggtctcaaaaaaaaaaaaaaaatgccaggtgcagtggctcacacctgtaatcccagcactttgggaggccaaggcgggcggatcacgaggtaaggagatctagaccatcctggctaacatggtgaaaccccgtctctactaaaaacacattaaaaaaagccaggcatggtggcgggcgcctgtagtcccagctactcgggaagctgaggcaggagaatggcgtgaacccgggaggcagagcttgtagtgagccgagattgcaccactgcactccagcctgggcgagagagcgagactccgtctcaaaaaaaaaaaaattatttttaccaacattctcaggaaattaggtatactcataattttttaaaaataattggtaccaatataagttcttttttttttttttttttttttttgagacggagtcttgccctgttgcccaggctggaatgtagtggcgtgatcttggctcactgcaatctccacctcccaggttcaagcaattttcctgcctcagcttcccgggtagctgggattacaggcacctaccaccatgcatgactaatttttgtatttttagtagagacagggtttcactatttggccaggctggtctcgaactcctgacctcaattattccgcctgccttggcctcccaaagttctgggattacagacatgaaccaccatgctggccaagttcttttttgtttgtttgtttgacacagagttttgctcttgttgcctaggctggagcacaatagtgcaatctcagctcaccacaacctccatttcccgggttcagacgattctcctgcctctccctctgcctcccgagtagctgggattacaggcatgcgccaccatgcccggctaattttgtatttttagtagagacagggtttcaccatgttggtcaggctggcctcgaactcccgacctcaggtgatctgcccaccttggcctcccaaagtactgggattactggggtgagccactgcaccaaacatttttcttcctaaacaagatataatgaataaatacttaaacacttatatttttccttttatacattggctgtcttggatgttgaagtagatggtacagacattgctttgtatctgtgggaaactggcttcaggacctactgtggataccaaaatcacggatgctcaagtctctgatataaaatggcatagtacttgcctataacctatgcatattctttcatatgctttaaattacctctaattacttataatccctattacaatgtaaatgctttgtaaatagttgttatactgtattgtatagggaatgacaagaaaaatagtctgtacatgttaatacagatgaaggtttttttcctgaatatttttgatccacggctggttgaatccatgaatgtagaacccaaggatatgaagggccaactgtattgattgtccttttactgaatagtcccaggcaggttctgttttgacctggaacatgctgtttttatttcttcccttgttgtccattagctctcagatgcctgccctcagcaatttacttccccttttaaatttcatttttaacatacgggctagaaaatttaataaccaagcacattaaaattatatgtgaaagtatgactagattgtaatacaggtaagcattgggtaaaaatatgctcttatgtactaacaatgggaatataaattgggatcactattttgaaaagcagtttggcaatacaagcaaaagcctataatgtgagttcgtgagttttcattacacaaattgaatatatcacgatgtcttaaagaatatggtccacattgagtaaatctctggttttttagttataaccataattctatgatctagaattaatcctactagttagaaaaaagctattttgctagaaacactgttaagttacattcattctcaataatcatttcccgtgctttctgttatccaatctctgaaaaccattattgtatacattttagtttttctagttaatttacctaggaaggtaaatctgttctgttactccatcatgaccagaagtggaagtgccagtcccatgtacttaaatactaaccatatgcttacagttcttaaatttatcccattgcctattctgcaagtggagtgtgcaatactcatgtggatctgagatagtgatctcaaatttcacacatccaaaaacaaacatacaatatctgccctcaattcccaaacctcactgctgagtctcctatatgtcctgagatcttatagttattcactacttttttctttcacatctcaatannnnnnnnnnnnnnnnnnnnnnnnnnnnnnnnnnnnnnnnnnnnnnnnnnnnnnnnnnnnnnctttcacatctcaataacttttatatcaacaaaccccattgattcttccttcaaaatatatcccatatccatccacttactatcaccaccactaatgccctggaccaaggcaacattttataatttttttttttttttttttgagttggagtctcactctgttgcccaggctgaagcacagtggcgcgatttcggctcactgcaagctccgcctcctgggttcacaccattctcccgcctcagcctcctgagtagctgggactacaggagcccgccaccacgcctggctaatttttttgtattttcagtagagacggggtttcactgtgttagccaggatggtctcgatctcctgacctcgtgatccgcccgcttcagcctcccaaagtgctgggattacaggtgtgagccactgcacccggccaacattttataattgtaatagcttctaagtgctctcctggtcatttttttttttttttactctaaaacttgtattttggccaggcacagtagctcatgcctctaattccagcactttgggaggccgaggcgggtggatcacctgaggtcaggagttcaaggccagcctggccaacatggtaaaaccctgtctctactaataatacaaatattagctgagcgtggtggtgcatgcctgttatcccagctactctggaggctgaggcaggaaaatcacttgaacccaggaggcagaggttgcagtgagccgagattgctccattgcactccagcctgggtgacaagagcgaaactccatctcaataaataaataaataaataaataaaactttattttttagagcagttataggttcacagcaaagttgtacagaaagtacatacagttcccatgtacctctgtccccattctcttttacttttcattcttgtctcttaacaatgtactttcagctcagcaatgaatggcctttttttttttaaataatctttttagaataaaagttaaatcatgtcattcccagaatccttcattgtcttcccatcccactaagaaaaagaatctaaagtccttatcaaggacaacaaactctggctctgcacttcctctctgatttctgttcaaccactcacccatttgcttgctgtgttacaactgcactcaccgactactgtttctcaaatatgttttaattcagtggcagtgttttttccaataagccctgattctctaaggtcatctcatctcatcccaaagcccagactaaggtaacaaaggcttatacttagggcagtgagaatgatgaaaaagatacctgaatgaagttgtttcacagcttctttaaagcctttaatctgtgtaaaatagaaatgtattaaaagcttttacttcaaacttaaattctagttttaagtctgtcactttcaataggtgatatctttggcaaattaccactttcattttcagtttctcaagtgtaaagtgaaggaatcggctggattaaatatgtgattctgggtggctcacacctgtaatcccagcactttgggagtctgagacaggtggatcacttgaggtcaggaattcgagaccagcctggccaacatatagtaaaaccccgtccgtgtctactaaaaatacaaaattagctgagtgtggtggtgcatgcctatagtcccagctacttgggaagctgaggcaagagaatcacttgaacacaggagtgggaggttgcagtgagccaagatcgtgccactgcaccccagcctgggtgacagagcaggactctgtctctcaaaaaaaaagtgattctgtcatctatgttctattaaaccttaaactactgctttgttttcactaagtctaggccttaaaaacctgtacaatttttacgtataattttatccttgtgtgcatgaagttcgagttctttgttttcacagttgccaaaaaatagtaggcttttgatcctaactgaaatcttaaagggagaagtcatggagccttcaacattcagatctaaattattttttaaagccgtagagataagaaaattactttgaaacacacgttatattcaaataataattaagaaacatgtagacctctgaattttttttactggcctaataaggataaagactttgtaccagtgtataaatcagctgtatcactaagcacactgtcaagatcagctggctttttttttttttaattgcaacactttactgataaaggaagcactttattggtttacattgtgatacaagctccttttctcatcagtgaagcaggcacttcacagaccaacatcagcactgattactgttagtaattaatactgtctgtaagaattaattactaatagtatcatcaatgaggattaagtttccttagactgctgaatatcttagtaaatggcttttttagcttctagtttgtaatcaataagcataacactccatttattattctttagtgaaaaaacttaccagtttttattattagtattatgcagatatgccagcagaagaaagagaaaagaaattggcttcctgctcaagacaccgattccgctacattccacccaacacaccagagaatttttgggaagttggttttccttccactcagacttgtatggaaagaggtgagagtatagattgtaacattttataattattttttttaaatacttggccgggcacagtggctcacgcctataatcccaacactttgagaggccaaggtgggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttatagggcttcactctgtcacccaggctggagtgtagtggcatgcataatcatggctcactgatgcctccgacttatgggctcaaactctacctcagccttccaagtagctaggactacagccttgtgccgccatacccagcacttttttttttttccccctagagacagggtctcactatgttgctcaggctggtcgtgaactcctggcctcaagtggtcctcctgccttgacctcccaaaacactgggattacagccatgagccactgcacccagccaaaatgactttaaataaaataaataacctaacaaaaattaccaggaaagttatatttaaaaagagagaatcttaaaatctactgctatgaattttggattttaaaacctcacttacccagaatgctggatgtttataagtggtatctgaataaataaaaaagatgtttatttgttaggttgttgacatgcaactagcttgtttagatatgacacttacatttaatataatttgagaatatattcagcttttaggctgttaataaaaggtcatgagtagtaatttttctatgttaccagcagcataatgctaaaaagtatagatccacatttttctggttttatattttctaccaaaattaagttagttgggtatgtgatctgaagtcttcatgtcatttaactgtctttggggtagcatactcccatttctgtgctcaagctaggactatcaatctggacattaccactattccaggcatatagtaattcatagtcactaaggtctaaactttattgtaatcattggtttaaatgaaatgaaatgctcgagtccttagccttaaaagagctatttaattaagcagggtccatttcacagaccctttgttgtgaaagtataattccagaggagctcataagagcatttaatagctagtttttatgaaggggcctttttttttttttttttttttttgagatggagtctcactgtgaggcccaggctggagtgcaaatggcacaatctcggctcactgcaacctccacctcccaggttcaagcgattttcctgccccagcttcttgaatagctgggactacaggcacatgccaccatacccagcctattttttttttttttttttttttctagtagagacggggtttcaccatactggccaggctggtctcaaactcctgatctcaagtgatccacccgcctcagcctcccaaagtgctgggattacaggctcgagccaccacgcccggcctgaaggggcctctttaactgaagattttattctctacattattgtattcttagactttttttgtatgtggcacatatagttcaaaactcatttgttattaaatgaatgttggtacagacattcaatcaaacattcttttaataagacaacatactcttagttttatgaagaattttaattcaaaatcatcctaaaacatgagctaaatactgacattacatgtgtacagtttattacataccaagtgtacttgaatgaagctgttcagaaaaaaagccataagagaggaagaatattagctaagcagggacttttctgacctctttattattttttgctattttctccatggtccaaagaccatccagttacagactaagtcttaccttgtggtttaaaatactgagttttagctggtccagaggcaattagttatctcagttgatcattcaattacagattgaactgcttcttttactctttcccttcattctcactactgtacctgattcgtcttaagaaaaaaatactgagttttatgaaaacaagatatgttttctggtatgtgattgaaaagtatagtagtgtttagaatatttatgatttgactttttaattaattagtagccttcaggctttaggcctgtatttgtcagttacagataaatgtttaaaatttttacccacaagacgataaaatagcattaaataaatgtcaaatgataaaattataccacctagaatttcagttcagccttgccatcttatagaaactattctcagctgggcacagtatctcacacctataatcccagcactttgggaggccaagatgggaggatccattgagcccaggagttcgagaccagcctgggcaacagagtgagaccctggctctagacgaaataaataataaaattagccaggtatggtggtgcatgcctgtggtcccagcagtaactcaggaggctgagatgggaggattgcttgagccctggaggtggaggctgcagtgagccgttattgcaccactgcactccagcctgggcaacagagcaagaccctgtttcaaaaaaacaattaatttaatttaattttgaaaagaaactgttctcaatgaagagctctgatgatttagctgcacaacaaggagggagagaccttcttcacttttggagacgctccagatgtttaactgtaagatagtttttccaaaagatgcaaagtctctgacagctttcactgtatttctgctttccccattaataagccagattgagtcaactttgatgtgatatctcactgcctggtcaccagatagaatcagtctggatagagcctgtgattgcaccccatgcgtatggcagagcaaatacttcccctgaagattacatgcttagagacaccttaggagatctaatagtctgaagggtatagagggattgtcatctattgaaatagctactgtaaaaagtatttttgataagtacctgaaatttataatagtagagttcatgtttagcactttgtccccctttgcaactacctatgggaggcagaataggaaagtgtttaagagttctggttctggaataagaaagagcttgggccaggtcccagctcctctactttttagctttgtgaacttgaacaagtaatttaacttccttgggtctctattacctcatctgtcaaacaggtatagtagaaactacttcaaaggaatgtgagttatatgagatgatatatgtaaccatttggtaaatatttgctgtcattattataaatgaggaaactgatgctaaatagtgagatcaatcatcagcatcacacagctaataatcagaagaatcatgtaaacttacaaagcatcaaataagagaaatgtttactagatataagctgaaagaaatgcatgttgcacatacagtcttctaagtttatgatttgtttttaaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaatagttgtagtctgtgatttgttgcctttcagttcttttctttttacttcatcttcccttggtatttacattgagcagtgacttcatgttaatcattacagatttttcttcatcaattgctcttctctaggtcatatcagtgtctagcatttaagtctttttttaaaaaaacaaaaaagaaagactgtattttcatagtttttttaaactctccagcttttgttgaattggaatcaggtactacattgtcataaattcctttcaaggtgaccacaaatatcgactttttttcctttcccacatattgtaaacattattctctgatctggtcctacttttccagctcttcacatgttttcttttcatcatacttttttttctttttttttttttttccgagaaggagtctcgctctgtcgccaggctggagtgcaatggcacaatctcactcactgcaacctccgcctcccgggttcaagcaattctcctgcttcagcctcccaagtagctggcactacaggcgtgcgccaccatgcccagctaatttttgtatttttagtagagatggggtttcactgtgttggccaggatggtcttaatctcttgacctcgtgatccacctgcctcggcctcccaaagtgctgggattgcaggcatgagccactgtgcccagccatacttttttttttttttctggtgcatttctgaagttaaatatgttgagttctctgcccatttgttcaaattctattgtattatttctgtggattgacaaatgttatgaacaatttggtttcaaaatagatttttctatttagcaactttctattcctctaggacctagtattaaggtcattaagatggcttaatgagtcattaagccattaatgagtcattaagatggctgaccaatctgtgccatcttttttagtgacattttgtttatcagtgtctcttttgtgtatttctttgatttatatcttgacagtattacataagcaggaataaaagagacattgagtggaatgtctcgctcaaatataaataaccttataaatacaatctttacttctcagagtcctaaaatcttcttggttagtctggtcttccttgttgatcaaggttctcgtgactaaatggcattagtttgtgttctcacagataggataggaaaaggaattatacatattgattatgtactatatgtcagaccacttatgtaccttgtttggctctatgattctgaattttttatcaccctatcatcacttctgttcagcccttttcttcccttcccaagttgtttattctgtttgatttttgttctctgctggtagtcagataatctcccaaaaataatagttatcattgattggccacttcctgtgtgtcaagaactgttttatactcttcacatagatggttctcttttgatcctcaaccctgtgagcttatcacttaataaatattgttaagctgcaaaaaaaaaaaggatccaaaaaacagcagattaaacaacaaattactggctttatttttctcaccttaaaaagtctagaggtgagcagtccaatgccactagtgcagctccatagtggcctcagggacccagatgtctcctggttttctgctcttccatacttcgtattggtgttcaccctcgcatctgtaaagcagtctatgccactcgagcatcacgcccatgttctgcacaaaaggaagaaaaaaagtacgtgcatttgtttttgtcccctagaaaaaaaagtttccagaaagccctacctcataactttcctgacttctcagaggtcagaattatccatctcatggctacctctaataactagtagggatgaaattaggacccatggttgcctaattccagaatctactaattcatcttcactatagtatagtcctaaaggccagggtttgagagacacctggatttgaacaaggcaccacaggatgtgtggttggagttacatacttccaatggatt

SEQ ID NO: 16094 - DNA, 33099 bp, Human
  misc_feature (1)...(33099): n = A,T,C or G
agaagaatcgcttgaacccacgaggtggaggttgcagtgagccttgatcatgccactgcactccagcctggcgacagagcgagactctatttcaaaagaaaagaaaagaaaagaaaagaaaagaaaagaaaagaaaagaaaaaaaagaaaaaaaaaaaaaagttaaaaaaaaaaagatctgacctctctcctttacattcaaaacaaaacaaaaagaatattcagattcttagttttattttcgacttcctgtccttttctgatatatcccccaaatagtctctcactggcacatttttgtcatacactgcatctcagccttagcctttctttctggtctggtcttttccttttaatcttttttctcttttttttttttttgagacggagtctcactctgttgcccaggttggagtgcagtggcatgatcttggctaattgcaacctcggcctcccgaggtcaagtgattctcctgcctcagcctcctgagtagctgggattacaagtgcgtgtcaccacacccggctgctttttgtatttttagtagagatggggtttcaccgtgttggccaggctggtctcaaactcctgacctcaggtgatccacccaccttggcctcccaaagtgctgggattacaggcatgacccaccacgcccagccctctcctattttttcctagccagaattgagaagtccatttctattaatagttacacccatttttcttaaactatttatcgtccaattataatcctttgaacactaggaaggaacacaatttccacacacattcacatatataggcaacatttgccaagcacacatctgcaccctatcatatggctatagtttgccttattgcagtaggggtatttggaggattcagaacatgttttcacctggaatggaaaggaggcaaagattgtgtgctaatggaaatcattaagatcagtaacccagggctctcaagtatggacagttagagatactgactcggaactgagatttagggaaaacagttattcagtacctatttctagaatgtttgaatatacaacatatagacagtgtatagtttatagtcaaaatataatgtacagccagtccagttcccaaaccgattgtctgggttcaccccttattagctttgccacttgttatctgtgtgacctcaactaaattactttacctctctgtgcctcagtttcaatatcagtaaaatagagataatgacagaatttagctctcacggtaattttgaggactaaaaagttaatgaaagatttgaacagtgcattgatatactaagtgaaatgcaatgtttagttatcttttatctggtcattttattagaatctctacaaaatacagaaacaaaagttttattatgcagtcttatttttgttcactgttacgtaacacattttacacattttccgcattccacgccccgcccttcaacaacaacaaccacaaactccgaccgtcctttccaggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaaggtaagtggcagacgagactggagtactagccttggtcacacgggctggatctctcggaaagctcggagagggcggcttcgtgggcgattcgggaagttctggggcgggaccccgccgacctcggcaagggggcactggccgcgggggtgccgggatggggatggagggagcggaaagaggggcggagggcggctggatctcccaaaggccaccttgagtggttagggctctctatttcttcagcgtactttctgtatcaccgtagcatgtatttgagcaggactggcttacacaccctgatgatactggaggggaaacaagcacgatcttgtttttcactggccaagtgagtcagccgaatacacagctagccagacagaaagttggtttaggaagctgtttacttaatttgataagtgtggttatcccagtttggaaatgtcttgtttttgaagcagtaaaagataaaacccaggcgcaccctcctccctcgacgctgaaattcaagtgcgcaccacggactgtaaagtgcttatgaatttcattatctgcctaagctttgacgtttaaactttttcatagagtggcaaactaaagacctttatttcacatttgctttctggtttccaggcaggtccttttcatgatactttgattatatggatgaaaacacttttctgccactttatggagggtctgcttgagagcagagtgcttccattgggattttttgttccacaaattaaggtcgtaaaggagtctagcttttttagcttcatagttgttctttacatgctaacacagaatatttgttcccatttaaaaggtcttattagatcttcaggctaggccttaacaggaaaaggggtcaataattagctattaagtaaccaaaagttaattttgtaaaagttctcgtacagctgttggaagaatctgagatactgcgttggcaaatgtggttaagtctgcatgttattttgtgtatttttccttgagaccttgtttacaaggtcaagattagcagacataaaaggatgaaatcagtagacagactagtattatgaatatataccctgtatgttaaagtccttcagttaagcattggcagaggctggtaaaaatgtcaaatgagacagactctattcagaatacatcctaatctcagaacaaatttcacttacaaactaattcagtaataaactatttaacagtcatatttttatttaagtgtacatcatcagaactataaaattccattttcattgtgcaacaaaaatgcttctgggatttatagacgctctattgggaggacagtgttttgaaaggcaaaacaattagaaacaggctgaaagtactatcattaatcctttttttctctaaccttttggaaaaccaaagtgattacagaagcctacatggaggaggtgaagatttgaggagggttttgaaaaatggaaggattctcaaaactttttagtcaggacttctttccttccttccttccttcctttccttcctttcctttcctttctttccttcctttcttttctttcctttctttccttttcatttatttatttatttgagacggagtctcgccctatcgcccaggctggagtacagtggtttgctcccagctcactgcgacctctgccttccgggttcaggcaattcttgtgactcagcctcctgagtagctgggattacaggcgcctgccaccacgcccagctgattttcgtatttttttttgtagagatgggatttcaccgtattggccaggctggtctcaaactccgacctcaagtgtccacccgcctcggcctcccacactgctgggattacaggcgtgagccaccatgcccaacgtctttctttttttttttttctttttcttttttttttttgagacggagtctcgctttgttgcccaggctgtagtgcagtggcgcgatctcggctcactgcaagctccgcctcctgggttcaagcgattctcctgcctcagcctcccgagtagtgggaccacaggtgcccaccaccacacccggctaattttttgtatttttagtagaggcggggtttcaccgtgttagccaagatggtctcgatctcctgacctcgtgatccgcccaccttggcctctttcttttttaattgagacagggtctcactctgtcacccaggctggagtgcagtggcatgatcacatctcacactgtgccttgaccttgcaggctcccacctcggcctcctgattagctggactacaggccagtgccaccacacctagctaatttttgggttttttttgagacggagcctcgctctgtcaccaggctggagagcagtggcatgatctcagctcactgcaacctccgcctcctgggttcaagcaattcttcttcctcagcctcccaagtagctgggactacaggtgcatgccaccatgcccagctaatttttatatttttagtagagatggggtttcaccatgttggccaggatggtctcgatctcttgacattgtgatcctcccaccttggcctcccaaagtgctgggattacaggtgtgagccaccgcgcccagccaatttttgtatttttgtgtagagatcggatttcaccatgttgcctaggctggtcttgaactcctgggctcaagcagtaccccacccccttccgccctggcctctcaaaatgttaggattacaggcgtgagccaccacgcccagcccggacttctttatactctcaaaaattgaggaccccaaatgtcttttgtttacattgattatatcaattgatatttatcaatctgaagttaaaactgagaaatagaaaaattttaagtcatttaaaagtcatgctagtctgatggtagtgggttatcagaacttattaacattagtgtcactaaagttgatatacaacctccccgctgctaaatttggctggctttaaaaaaaaaagtcatatgttaacataaataacatttttatatctaaagaaaacttaaaaaaatagattagaacatgtgagaaaagtggaaaaagaaaacaaacaaaaaaatagagttgagatcttactgtgttgctcagctggtctggaacgtgtggcctcaagcagtcttcccaccatggcctcccaaagtgctagaattacaggtgtgaaccaccacacctggccaaaagaaaactatatttgaaaacaaaaattagtgaacagtattttatatttttgcaaatctctaacatctgacttattagaagatatctggattcttctatcttctttttttcattcaacctgttgtaaggttgaagtatttgaagaaaatccatcctcacagctaagtagattgtagcagatataagtgaaggtgggtaataagagcgtagtagaaatactgagaacaaactgggttaaatatctaaaaatgcatttatatcttaaatctactctttagaaaattttagaaaacacgagaataccaagcacacattccattggccatcagtgatgatgtcatcacatctgatgtagactctggaaaactccacactcttgggagaatgagagttaaaaagacaaataatgtaatattactattatgaaaattttgacttcatagaccctctgaatgggtgttggggatccttctcctagagtaccagggtgcaagttacaaaatgctgaactactattatggacaaagaattttaggggatattccaagaagagaggattggcaaactgtaagcaaaagtgaggaagtgtgtagctctgttgatagagagttgtaaaaaaaataaataaatagcggtactcctcaaaactgtcaaagttatcaaaaacaaggaaagtctgagaaactcaacagcctaagaggagcttaaggagacgtggcaactaaatgtaacgtggtattttgaatgggatcctggaacagaaaaaggatgttagagaaaaactaaggaaatcagagtagagtatggactttagttaataataattatgtatcaatattggttcgtgaattgtgacaaacgtataatactaatgcaaggtattaataggataaactaccgagtgtagtatttgggaactgtactgtcttggcagtttttttctagttttttaaaagtaagactattctaaaaccaaaaaaattttaaaaaatggattagtgttgttatgtagtcccagattatttttttcagagccacttgtcttgagttgaaaaattacttacttaaatattctgcttagattatgtcttctagctgtatggttagaaaggggaccttcctgtaggttatgtttctcttgactcgcttccagtagaggactgaatttttgttgctgtgtgcctctttcatgtttgctggttttcttttttttttttggagacagagtctcactctatcgcccaggctggagtgcagtggtgcaatcttggctcactgcaacctccacccctgggctcaagcaattcttgtgcttcagtctccagagtggctgagactacaagtgtgcatcaccacgcctggctagttgttttttttttttttgtattttagtggaaatggggtttcactgtgttgcccaggctggtgtcgaactcctgagctcaagcaatccgcctgcctcagcctcccaaagtgctagtattacaggcgagagccactgcccccggctgctgtttttaattttacttgattctttacccataattgtctgcaggaaacctttaaaaaaaatgatacaagcagcgaaggtcatatctttaggaagtggaaggaaagggagatgattccccactaatgtgcagccaggcaggtgggggagaatgcggtagtagtgaagaaccccaaggaacagagttcagtggtggcagttttgcaaaggagaggaaaacagggtgggtcttagggttatttagcaacaggaaagaaagaaccaggaggctggttaaaagcttgatggatgtcctttgaagtagaatcgctgactggaaaggattgtatggggtgtcccatcagattgtgacactatagggagtttgtgttgatgaatggaatagtaggaaatgactttggatagctaggacagagcaagattatggagggcgtttcccccatcttgttagattttttacaaaaagcggtttactgaagagtcacagatgacagaggattcccttatatacaacctatggtacctgttcataggaggagcctgcagtaaattttctgagcacttgggatagcaaaccactgtgcctatagggaaaacgcagcgggtcttcccccgaccccagaagctgtccgtctcacagcctggaaaaagtgtatggagggcttttaattgttggcttgaagagtttgggtttgatttcaaagtatgggagtggcagcctttctgaaatctttacttatttacctcacccaaggaagttgcctcagtgtgaagtggaccagttgagctgttacagggtagtatagtctctagagtctagggtcagtaggagtggacagcaagggtgctttggtgctgtttgaggtctctacttgtttcactttctgattcagtgtatctgtgagtagatcaatctctgcctcaaaataacaaaattcctgcctgtcatttttgcctcttctgacaaattgtcagctaatactttaataccttagcagaattaattgacagatggcaaaggagttgaaacctcagaagcgggcaggcaaaagggcaactttccaagatggggaaaaggacattagattagcagggatgtagaaaggcgtcagacctctgcagccaatcactccagtgttttcttttggcacatactgctcaggaaatactggaatgcctctttatatccaaagctctatgctgggctctgagggttgatgagaagtctctacccttcaaggggttcatgctccattgtggctaatgcatgaaccctaatacagtgatgagttctgcattaacagtgtttgcatactgctatgggaacacaaaggaaagggtccaactttggtaacattgagacagccttatagaggagatggcatttaattggtgtaaataaagaaggaagaaaaaccaatggtagagaaaggaatgtgtgaaggcatgcagcggggaaagtatgccatcttttttgtttggttttgagacagtctcgctctgtcacccgggctggagtgaagtggcgcaatcttggctcactgcaacctccgcctcctgggttcaagcgattcttctgcctcagccttctgagtagctggaactatgggcacctgccaccatgcctgtagtgtaaattagtataaaaaatactaatttttatatttttagtagagatggggtttctccatgttgaccagactggtctcgaactcctgacctcaggtgattcgcctgcctcggcctctcaaagtgctgggattacaggcgtgagccactgcacacggcctgagtatgccatctttggcatataattagtgttactagagtgtaggatagatgagggttgagattggaaagataaatcagggcaagttgtaaagggcatcctttgctgaggaacttggattttatttatttagagccagggtctcactctgtcacccaggctggagtgcagtggcacaatcatagggctcaaatgatccacctcctacttcagcctcctgagtagctgggactgcaggcatttgccactgtgcccagctagttttttaatttttttgtagagatgatatcttgctgtgttgcctagggtggggaatttggattttatattgcagtcagtagggcagtttgcttcacacatttcggggtgagatgatagggaagctgtatagcaaaatgctaagagtgcagcctggcattgccttggttcagagcttggtacttccatctatgatgttttcttgggttaaaagaaaagcctttgtgtacctcagttttaaaatccataaaatggggatggattgcaactactcaattgttgtgtgatttaagtaatctatgtaagttatgtatatttaaccaagtgacttaaatatagtgaatattcagatattgtctgttatgtaactgttagtcattgccaaatgtgagtgagaattctgagttagacagtcacctgccttttggaacctggactttgaaactgatcagatgaaacatttctaggctaaacagcattgtatcttctacctagaggatacagaaggaagtcaggagagtcatgaggccaaaaaattagctatgttctccagatgatagaaagcttcaagagtctagaccttaaaatccttaccaggagagttctccactcaattacagataagctctgagtgaatgaaagacacaccagactttcaggaagcctcttcttctctcccaagtctggccttacagaaggctggaagagttctgtgatagtgtattgtaggtatgtgctaggtaccaggtgtatttcctcaatctcagggtgagactagataaaacttgattctcattcactcaggcataaatatagttatcatttgtcgcctttaggtgctccacccaaacagcctgagctaagtaaattcctgaatgtcagtactgtggaacctgaacaaaggtcacttgcccagttgtctctgagtgtcatgcagcaggcctttagaccaactagagggcctatactggctgaacttgatcaaataattttgtggctaaaacagataacattttatgctatattctaaattagacactcagtagtagttaaggaatgagttttggactttatcctaaaagcaatgggaaacaataaaaaagattttgagtaaggagatggaacccatcacatctgcattttagaacaattactgtgttacagtgtgaagaatggaaactaccaagattgagagcagaaagattcgttaggatgctctgaaagtaacccagcgaatgggataccttggagtagaattatggaagagggatggaaagagttgggcaagttcaggagatgcttaggcatcttactaaatagtaaaggtcttaatcaataggctataaaatataatcatttgctgctgctaagtaaagcatcttgctccctcagaaattatgaatttgaaataaacctacagtttgatttcaagaaggctgaggcaggagtatgtcactgaggaaggtcaactgggtctgacagaatattactgtgtgtattggtattgttttaagagcctgtttctcagcttctaaagttcagaaataaaattggggctgcttgggtacacctgaatccagcactttgggagctgaggggtcagatcacctgaggttaggagttcgagaccagcctagacaacttggcaaaaccctatctctactaaaaatacaaaaattagctgggcatggtggcttatgcctataatcccagctactcagaaggctgaggcaggagaatcgcttgaacccggggaggtggagattgcagtgagccgagtatcgcgccactgtactccagcctgggtgacagaggaaactgtctccaaaaaaaaaaaaagaaataaaatttaaaaaaaaatgtgttgtttgttcttgctatttttttttttttttttttggcagggggtctcattctgtcacccaggctggagtgcagtggcgcgatctcgactcactgcaaccctaacctcccaggttcaagcgattctcctgcctcagcctcctgagtagctgggactacaggcatgcaccaccacagcccgctaattgtttgtatttctggtagagatggggtttcaccatgttggccaggctggtctcaaactcctgacctcaggttatccacccgccttggcctgccaaagtgctaggattacaggcgcgcgccaccgcgcctggcctgttcttgtttttgttttagcatatcctaagatgttttgagaggggctgacataatttgtacacttagatgactcaatgcttaaattagaatgagatataacttttcattaagcttcaaatggtgctagttggcatagtctattcctataagaaaatctacttgggaaatcagattataagcagaaggtagcttggtgagcaaggattggaataagaggaattacatgaactcattggctagtggggcgatgccagtgggcctgatgcttcccctcagctttaaggatatacctacttagcaggctagaaagtgcttttggctgttttagtttacatatatccttgactaaatttgacctgggagataattttacttttgagatgatttctgcaaatagctagttattcatttctggtttttaactacatagtttaattctcaaaatataacattatttgtaaaatgagaggtactttatttcattatgatgaattgagctgttcttttttcttttttcatagtgtccatgggctattcctcaaaatacaatatcttgttctttggctgatgtaatgagtgaacagctggccaaagaattgcagttagaagaagaagctgccgtttttcctgaagttgcgtaagtaaaattcacaaatactttatctagcaacttatagcagagttttaggatttgatgagtaattgtcatgacaagtggtttggaaaaagcagtgcagaagaaagcaccatattgagagtccagtgatacttgaattttggtcctgattttgcattggttttcattattatcttggacaaaccactgtttctgtgggttttagttatatcgcgttaatgctgcagttgaactagatgaggtacagttttgatcaagtgtttgtagtttatcttttcatgaatatgtatctattctttcattatggatgaatgaaacatccagactttcttttttttttttttttggagatggaatttcgctcttgtttcccaggctagagtgcaatggcacaatctcggctcggcacaacctccgtctcccgggttcaagtgattctcctgcctcagcctctcgagtagctgggattacaggcatgtgctgccacgtccggctaattttgtatttttagtagagatggggtttctccatgttggtcaggttggtctcgaactcctgacctcagatgatccgccagcctcagcctcccaaagtgctgggattacaggcatgagccactgcacctggcctcatactttcattcagaacaaatgaattctaggcctcagtttagctttctctcccagttctcttaatcctagttggtactcccacaggtgcatgccattggtcttaaggctagctgtgcaggagaaggtaaatggtttgatagagttctttcccattgttcaattttaacatggaaaaggcacctcctactctcataattggcaacctctgtttacttaagcacattacattagtttatattgccttattttgaatagtgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaaggtattataaccttattgtgacaacttcattgagtggtagaaaacactcataatgtgctcctaagtaaatcttcaactatttttgcttcttaagtttccatttcctttgaaaattatcgaaaagtgcatccttatgaagacagcgatagctctgaagatgaggttgactggcaggatactcgtgatgatccctacagaccaggtaccaaagtttttactttctgggggcagcagaatagaggtataggaagactaatcttttcaatgaactcttttagttttatatttttctttgaatctcatttggtaatttactcttagattcaaatgtcttttcagacaacgttgaatgcagcaatgtagtctttgctatttttatatacctggcttatttcaattgcctttagcaaaaccggttcccactcctaaaaagggctttattggaaaaggaaaagatatcaccaccaaacatgatgaagtagtatgtgggagaaagaacacagcaagaatggaaaatgtaagttacagaaaatatctatctctgaatttagagttttgtttgaatacctttcaaaaacaggattctaaatataataccttagatttctaaaaatgtctttctttctaaagatgtttttagataacaatatggcaatatcatggaaactgagacattaatgaaaatataaagtacctcagaataaaattccataacagtgttgaaaaactattttgactcacattgattctaaaattaataaatagttattatgaaattaacatttattcttcatcatatctctataaaatagcatccctacccaaaaaacagataacggtggcgattggggaatacaaatgggagggagaaatacttttcaccatatactcttttgtgcattttgaatttattatcttgtgcctgaactacctgtgtaaaatcagaagtaaagtgtaactttaaaaaatagcattctaggccgggcatggaggctcatgcctgtaatcccagtattttgggatgccgaggtgggcagatcacctgaggtcaggagttcaagaccagcctgaccaacatggaaaaaccccatctctactaaaaatacaaaattagccaggcatggtggcgcatgcctgtaatcccagttactcgggaggctgaggcaggagaattgcttgaacctgggaggcagaggttgtagtgagccgagatcgtgccacttcactccagcctgggcaacaagagtgaaactctgcctcaaaaaaacaaacaaaaaaaaagcattctaaatccttcataaatattgtggttaatataatatattaaacatttagattttaaagcacaaatgcttgttaagtaaacatattcaattatatcatttctagaaatattccagatctaattctagaagagttctgtccaatagaactttctgtggtaatggaaatgttctgtatgtgtgctgttcaatatggtagccacatttgctgttgagcacttgaaatttgggtggtataatagaggaactgaatttttaatttaattttaattaacttaaatatccaagtgtggctagtggctacctaactgaattgcacagttctagaacataattgtcatggtgtgaacatagtctgctataacaacccactctccacaaataattacaaaattgtatttctttggtaagatttggtgtagccttcacagttcaatattgtgtcctttggctaaaagcaaggtacaatgcacatgccgaaagaccttagttttggatgtgatgaaatgttttctatgcctggaataaatgccttcctttgggttgtaatttcttaaatagtattgctcctctttctgtgagttatttaatttttttctctgtagtagctatgatttctggttttctagtgtgatcatctattgagtaagaaagactaatctcatttggttgtttttgtttttgtttttaactgtccctattttaaaatatttagatgctaattcttccttttggcagtttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagtaaggatttatagatttttttttttcttttttactagaaagattcatattagaaaactttgggtaaagaaaaaaaaacttcatgtttgatattttttcatgagattggctttttaaatcaaagatgtaaataaatccagccactgtggtgcccgcctgtaatcccactactttgggatagcagatggagacaggaggattacttgagcctaggagtgcaagaacagcccaggcaacataatgatccccagctcacaaaaaaaattagctgggcatcatggcacacacctgtggtcccagctacccggggggctgaggtgggaggattggttgagcccaagaagttgaggctgcagtgaaccatgattgtgccactgtactgcagcctgggtgacagattgagaccctgccttaaaaaaaaaaaaaaaaaaaaaaatgtaaataagccaggtgaggtggctcccagcaccttgggaagccaaggtagaaggatcgcttgagcccaggagttcaagaccagcctgggcaacatagggagaccctgggagaccctgtctcagcaaaagttttaaaaaattagccgggcatgttggtgtgcacctttagtcccagctgctcaggaggctgaggtgggaggatcacttgaacccaggaatttgaagctgtagtgagccataatcatgtcactgcattccatcctggacaacagagtgagaccctgtctctctctctgtctctaaaaaaaaaaaagatattaggccaggcgtggtggctcacacctataatcccagcactttgggaggccaaggcgggcggatcatgaggtcaggagttcgagaccagcctggccaacatagtgaaaccccatctctagtaaaaatacaaaaattagccaggtgtggtggcgggcgcctgtaatcccagctactcgggaggctgaggcaggagaatcacttgaacctgggaggtggaggttgcagtgatcagagatggtgccattgtactctagcctgggtgacaagagcaagactccgtctcaaaaaaaaaaagttattagaagtggctcagaaaatattttgtgattagcagtcattttcacttacagtgctttatctcttgcaggaaaaagcagttgatcctaagacacgtttacttatgtataaaatggtcaactctggaatgttggagacaatcactggctgtattagtacaggaaaggagtctgttgtctttcatgcatatggagggaggtaaatgagcaaaatatgataccatgatatgaaaacttagtctcttctccccaagattaatgaatttacacagaatcaaagataatgctgcatggcaagcagagtaatttttaaagtgttattgtagaaagtctaggcagtataggaatgtataaaaaacacagtcatcctaataccaccacccagagataatcattaataattttgggtagacttctccagtttttttcaatgcgtatattattattattattattattattttttgagatggagtttcactcttgttccccaggctggagtgcagtggcgtgatcttggctcactgcaatctctgcctcccgggttcaagcaaggtctcctatcccagcctccagagtagctgggattacaggcacatgccaccacgcctggctaatttttgtatttttagtagagacagggtttcgccatgttggctaggctgtcctcaaactcctgaccttaggtgatccactcgccttggcctcccaaagtgctgggattacaggcgtgagccactgcttccgggcttcctcatctttatcagtgtttagtattatcaaatctaatgctttttgtcagtgtgagagatgaaaagtaacatcttggtattttggtgtgcatttatttaattatgattaagttgtacattttttccaagtgctttattggccatttgtatttctttttcttgtcttctctcttgtttatcctttgtccattttctgttatactcaatatactccttttttttttttttttttttttttgggagatggagttttgctcttgttgcccagggtggagtacaatggcgcaatctcagctcactgcaacctccatctcctgagttcaagcgattctcctgtctcagcctcccaagtagctgggattacaggcacgcaccaccacgcctggctaatttgtgtgtttttagtagagatgggctttcaccatgttagccaggctggtctcaaactcctgacatcaggtgatccacccatcttggcctcccaaagtgccaagattacaggcgtgagccactgcgcctggcctggtatacttaatatactctaatataataaatgttcagtctttctggtggaattggtatcataatctgtactttgacatttctaagttagcaaaactagagaacattcagttttctacagctaaaagttaatgcttttaaaagtttgttagttttctgtggtacataataaattgccacagacttagcagccaaaacagcatccatttattatctcatagtttctgttgacagaatccaggcatggcttaactaggttctctgttcagggtttcacaagcctgcagtctaggtgttggccaggctgtgttcctttctggagcttggcgtcctcttcccttggccacctttcagttgcagctatacgactgaggtcccactttcttgttggctgtcagcagtgggctgctctcaactccttgaggcccctgcagttccttgccatggggccgtctcacaggcctcttcacacactagctctcacactttcaaagccagcaggagaatctctccagtctgctaagactgagacttagtgttatgttatcatgggaatgactagaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccctttcccttttcccctctctcctctctctctctctctctccctctcctctctcctctctctctctctctttttctttctttctttctttttctttccttctttctttttttttttgagatggagtcttgctctgtcacccaggctggagtgcaatggcgcaatcttggctcactgcatcctctacctcccaagttcaagtgattctcctgcctcagcctccccggtagcggggattacaggtacacactaccatgcccggctaatttttgtatttttagtagagacggggtttcaccattttggccaggctggtctcaaattcctgaccttgtgatccaactgcctcagcctcccaaagtgctgggattacaggcgtgggccactgtgcctgggtcaaagctctggtttctgtcactctcaggttggtcaggcaatcaacaattattcaaacagtaatttgtgctagattactcagggaataaaatataagacatattttttactctcaaagagcttaagctttagctaaaaggagaacattacagtaagaaccattatggtcaatgaaagataattacataatagagtacccagttatgcaaacgagaccttatatgggataggaatagcgaatagaacaagatcattgccaggcacattcagggaagatatcataatgaagttggatctcaatctggattttaaaaataggttaaaaaaagaaatccgttggaggaccgatgggggcggatcacgaggtcaggagatcgagacgatcctggttaacacggtgaaactccgtctctactaaaaaatacaaaaaagttagccgggcatggtggcgggcatctgtactcccagctacttgggaggctgaggcaggagaatggcgtgaacctgggagcggagcttgcagtgagctgagatcgcgccactgcactccagcctgggtgacagagcaagattccgtctcaaaaaaaaaaaaaatccaatgttgagtataaaaagctagttgcagaatatatatacagtatatcatctatttaaattttttaagtcatacagaaaattacagagatgtttatagatgcttgtggatacttatatattatcttttaaaagagactagaaatacagcatttatgatagttattgcctctggtgagttaagatggggaatggtaatcagagggcacttcagcgtcatctgtaatgtttaattctttaagaaaaaggctaagggtgggagagttgaagtttaggcactgagaagattaggaaggtatgtgcttagaggtagtaggtagtaaagtggtgtaagcaaactggaaattggtaaggaggaccttaaaagctaggcagagggatgtgtcatttgctgagaaacaggatctttttgtagtaggacaatgacaaggcaaatcttataaattggactctatcctagagaccttccaagtaagggatctcttgtatggcatttttgctagggcctcacctactatgtggttaaactagtccaatgaaaggagcttatctcaaaatctagcctattctgtcataatgtcttttaagttattagagatttcttccctgaaaattgtgtcatctgttaaccaaatagttgagcagctgtcaagtaccaggtactcttccaggtactagggatacagcaatgaatggtacaaggaaggtctctggtctaatggaatatgcttcccccatcctcaacccctctccatgacaataataaacaaaaaatatcagatatatgctatgcagatagttaaaataggatgatgtcatagtgacaggctgactagctttattagtaggacagggaacgcttctccaatgaagtgacatgtgagtgacacatctaagatacatcaaagatcaggtggatgggcattctggactagagaacagctagtgctaatgccttaggacaggtacaaagttagtatctttgagggaagcgtaagaaacccagtctccctggagcataggatgtgaatgggagagagggggctggaggagtaagcaggggctggaccaggtaggattttgtaggccagggtaaggagtctgctctttgactgccctggaaccaaagctatgagttgattcttattttcaaaagattgctgtgtggaaaatgaattataggaggagaagagaagaagcagtaagatcagttaaaacgttgtagtagttgaagtgagaaatggtgaagggttggactagggagggcggtagtggaagtgaagagtaggagagcgttggtgtgtgttttgaaggtagagagaacagcacacgctgttggattggaagtgggtgtaggaggatagattctgggctagagcagctgatggtggtaccgtttgacgaggtgagagcctggggaagggtagggtgaggactcagcatgagttttgttttgggcatattaaatttgagatgcctgttagacttctaagtgatgtcatgtagttgttggataaatgggcctgaagttctagggaaagtcaggactgggatagaaatgtgggagttatcggccaggcgcggtggctcacgcctgtaatcccagcacttttggaggccaagatgggtggatcacctgaggtcaggagttcgagaccagcctggccaacatggtgaaaccccgtctctactaaaaatacaaaaattagccgggcgtggtggcatgcacgtgtaatcccagctactcaagaggctgaggcaggagaatagcttgaacccgggaggtggaggttgcagtgagccaggattgcaccactgtactccagcctgggtgacaaagtgagactctgtctcaaaaaaaaaaagaaatgtgggagttgtctatatagagatgatatttagagccatggggctaagtgaaattgcccaggaagagaaggaaggtttcttagaaccaggtgaaggactttaaccttttgagactaaatggaagaggagtcagctgggagaatatggtacagaaggaggtttgattcagattctgtcctttggaaatatagttcctttctttcccagattaacatcctatcagatatttaaaggtaaatattaatattgtttctcattccatccactttttcattcccactgccaccatcatgactgaagctcactattgggggactattgcagtagcatcctgagtcgaccccacacctctagcctgtccctgtgcccttccattctgacagtatcgttcactcgatcttcatgaagcacgcatttgagagtgccatacacagaaaccctcgcgattccccaccacctctaggaatttgtccaggctcttcacagatgtgcctctgtcctgtcctttagctccaattttttttcattatctctctccagccaagtcttaactatagtgtttgttgttcctcagacatgtcctgtggtttcctgcctctgcttttgttcatgctgttcaaatcctacccattgtcctgtttctgtttcagatggcacttgtgccatgaagtcttgcctgacctttccaatgaagagggacctttcctattcatgtacttcttttattctccgttgccacttcttgcagacttgtggggcaggaaccatttgattcacctttatgtctgctaggagtgaaagagttattttttaaaaagctgttttatttgttgctttttattgaattttgctcctgaaccatattgggaagactgtagcctattttcaagtgcatatgtcttcattgtatttcaagcttgattccgtagtcattaagtgaagaacattatgtgatagatggttgaaaatcggttgacaatttatttgaaagtttattttatttaaaaaatcaaaccaaaacctaaggctttattaagatccaaaacctaaaggcttaaaaaaacaagacttgacactgagagaaggtagatctaatttagtgttacagaatctttattttgaaattgttgtacttgtgagctggcaacttgtactgacttgattttttttcttccacttagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaaggtaaagaaaatattgtgctagacgtaatcttgggtaaatacctttttgcattaggataaaaaaatccatgctttcttttacattcatttatagaaataatgaaaggccaggtgtataacctcgattcatacttttaggatgaaaaagccattttcttttttctttcctcaatgaagcttgagggaaatctgggcattttctgccttagacactttatcatatatctaaatgccatttttaaattgcttttatcacgaagtaaaacttccagcatccaattaggcttagcataaaaaaatggtttcttttttgtttcagaaaatgtttgttgcatttaatttgttaattttgtgggagtaagttcttaccaatcaaattacattttgttttaatttttatacttgtatctgaattttctaagcaatttattttctatcaaagaatttgttttgtcaaccaagaaattcagtaataatccttctcattaaaaacctttctattatcttaatttattaaaagcttaattttagtttgttattttctaaagatatttgctttcaaaagtaattattcatatatatcagttacaaaattcttctactgagagttccccaccaaaataagccaggcatggtgtgcacgtgtactcccagctacttgggaggctgagatgggaggactgcttgaacctaggagttcaaaaccagcctggaaacgttagactcccgagaccttgtctcaaaaagaaaaaaaaatgttttttcaattaattaattaattccaggtagaatcattttctagaaggtcttgctgtcctccagtctcttttctgtactcctgaaattcctgcctttcttaaaattcttcaacagttttccatagtggagcttgcctgtctttgtagcctcagcccacattgcccttcctcctactcacagatccagctatgttgattgatatacattccccaaatggactgtgctcttgaacacctccctgcattcccttgcactgtctttatctggctaattcctgttccctacctcttcttctaataagccatccttggtgctgtgtgctcctgtagctcctacccatacctctgccagtgcgtaattgtaattgtctcttgtctgtcatttccatcagtccctgagctctctatgggcagaggctgtgttttactgtctttgtattcccacatcaccagggtagaacatagtgccagctcattgcaggccctgattagatatttattgaataaatgacatattttctctccttctgatctgtatattctgaatcatttctttatgtatagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatgtaagttgtgcttttaaaagcattcacacactacctttaaaaaatatttcctctaaactttaaaaaaatttccttaaagaagccaggcatgttggctcacacttgtaatctagaactttgggaggctcaggcagtaggatcacttgagcccaggagtttgagaccagcctgggcaacatggtgaaaccctgtctctactaaaaatacaaaaaaattagctgggcgtgtgcctgtaatcccagctactcgggatgctgaggcaggggaattgcttgaaccagggaggtagaggttgcagtgaaccaagattgcaccactgcactccagcctgggtgacagagtaagactctgtctcaaaaaaaaaaaaaaaaaattaaaaattagctgggcacacacctgtagtcccagctactcgggagtctaaggtgggaggatcacttgcacccaggaatttaaggcagcagtgagctatgattgtgccactgcaccccagcctgggcaagaaatagagcaagaccctatgtcttaaaaaacaaacaaaaaaacccaagttccttagatagtgctatttcaaggtgctataacaaagacaagttgaagtttgtgaaagaatgttaacactgaagagttgtttttctatcaatatgtgtgtgtcttaaatagttttagaaaacttacagacttaaccagggaagtcgtcattgttaggattagtgacacagtgcatgaagctatttttcaccaaacttcattaaataaaatttgctgttagtacatttagcaaagtgcctcattagtttgtgagctttcatgaatgttatagttttttggggcttttttttttttttttttttttcaaataagaaacagggtctcactatgttgcccaggctggtctcgaactcctgggctcaagtgatcctcttgcctcagcatcccaaagtgctgggattactggtgtgagccaccacacccagccattgaatgttacagctttaacagtgaaggaaaggaagcaggtctggtctcatcataagagagtgatgatgaaaattgaaaacagtagggagtgcaggtgttaagttggaaggcatgttgggaatctcaaggaaactacatgctttgaaatagcaactgaattcaatctgagggccttccaggttgagacaatgctcctaatactgccattatccctctgtgttttaattgaacactggagaaacttaatgtgctactttatgcaatctccacatgaagctgtcatgtaatgcagccattgatctagatatggaaattttaatccaaattaatttttaaagatatagctagaaaggtgatccacctttctctgcctccaaaggtaaacattgaaaggaaaatcaagtatgtttttctggcctctttgggaggtggggtggctggggaagagattaaatagtgatgaaacttttctatttaattctattaaggctggaaaacaaatgcattaatgttgatttctactgtaagactttgaggggggctgggcgcagtggctcacgcctgtaatcccagcactctgggaggccgaggtgggcaggtcacgaggtcaggagattgagaccatcctaactaacatggtgaaaccccatctctactaaaaaaaattacaaaaaattagccaggagtggtggtgggtgcctgtagtccgagctacttgggaggctgaggcaggagaatggtgtgaaccagggaggcggagcttgcagtgagctgagatcacaccactgcactccagcctgggcgacagagtgagactctgtctccaaaaaaataaaaaataaaaaactttcaggggtgtcatcatcaataataccacttaattattcatttcctaatgtgtgccttccctcttcacagttgatgcggcagttatatcatgaatgtacgcttgtccatgctgacctcagtgagtataacatgctgtggcatgctggaaaggtgaggagcacattttgttaacattcagatttaattactgtaagtaaaatttaaaatgtaaatacatcagttcatgttctgtattgaaataggtctggttgatcgatgtcagtcagtcagtagaacctacccaccctcacggcctggagttcttgttccgggactgcaggaatgtctcgcaggtagacgtgtaaaccaatatgcctttttttgttggatgtaacagctgcaggtatttttctcactcctaagataagtaagaggaccatattcttagaaattgaaggaagggatacgggctgctttcaggacaaggatataaagatcaatttgtcatatttcattttgcaagaatttgattccatgtcttacagttgggtaaaatgttcaaggggtgccaggtatggtggctcacgcctgtaatcccagcactttgggagggtgaggtgggtggatcatttgatgtcagaggttcaagaccagcctggccaacatggtgaaaccccatctctactaaaaatgcaaaattagccgggcatggtggcaggcgcctgtaatcccagctacttgggaggctgaggcaggagactcacttgaacctgggaggcagaggctgcagtgagccaagaacgtgctactgcactccacccagcctgggcaacagagtgaggctccgtctcaaaaaaaaaaaaaaaaaaatatgccaggtgcagtggttcatgcctgtaatcccagcactttgggaggccaaggtgggtggatcacctgaggtcaggagttcaagaccagcccggccaacatggtgaaacgctgtctgtacgaaaaatacaaaaaaattagttgggtgcggtagcgtgtgcctgtaatcccagctagttgggaggctgaggaaggagaatcacttgagcctgggaatcggaggttgcagtgagccaaggttgcgccattgcactccagcctgggtgacagagcaagactccttctccaaaaaaaaaaaaaaaaatgttaaagggaataagtgagtgttttggttccttgtatataagcagtcgagtagacatttaatgtgtgcatagtgcttaaacagaagctggtgtgcctgtatgcttgctgccattattaccattaaaagagggacagtctctattgtgggacagtgtctgatcactgtcactgtgaagcatggtaagaagattaggtggctgggcatggtgattcacgcttacaatctcacactttgggaagccagggagggaggattgcttgagcccaggagtttgagaccagcctgggcaacatagtgagactcctatctctacaaaaaaatttaaaaagtagctgggtgtggtggaacatgtctgtagtcctagctgctttaactgggaggctgttttactagggaggctgaggcaggaggattgtttgagtccagaagttcaagattatagcgagctgtgattgtgccactgcactccagcctggatgacagtgctaggccctgtctcttaaaaaaacaaaacatatatatatatatggtaaaatttagtaagcacagggttgggtcacacttgtttggcatttctaagggaaatgaattgttggcagtagattcagatagcaatgatctttctaaaggatagagtaacttcatattggaaataacctctgagcctgcttgaaatttttaatttctggggtttagtgaaagtatttcctttacatattcaaagcaatgccaagtggttttatttatagcactcatttttatagctatagaaggtgcagtggtatgagctaaatccagaaggcaggatggatgtgtgagaggatgaaaagcaactagaacctgagtatagtccagcttggaagcaggaaaatcgatggttgagaaatgaggcaaggaatgtagtggctcaagagatcctccctccttggcctcccaaagtgttgggataacaaggataacaggagtgagccgccatgcctggctgagccagtaatttttactctcttaaaaactaggttattcctaatgattctgcctttgagttgaaattactgtgtgtgtgtgtgtgtgcgtgtgcacacgtgcatgcatccaagtctttttataaatgtgctgctccctgtttttagtttataagagaacattgctaatacttcttactgactttcttgtatttccttactagtttttccagaaaggaggagtcaaggaagcccttagtgaacgagaactcttcaatgctgtttcaggcttaaacatcacagcagataatgaagctgattttttagctgaggtatgtgataaacagctgtttttcaccttgctggtcatgcagaactgcatagaggagataactgaaacccagagctagttttatcctccctttcccccaaaacaaaattaatttgagatttttcttttcttaagatgtttttggttttttctttttttctttttttttttgagatggagtcttggtttgtcactcaggctggaatgcagtggcgtgatcttggctcactgcaacctctgcctcttgggttcaagcgattctcctgcctcagcctcctgagtagctgggattacaggtgtgtgccaccatgcttggctaatttttgtatttttggtagagacagggtttcgccatgttggccaggccggtcttgaactcctggcctcaagggatccacccaccttggcctcccaaagtgctgagattacaggcatgagccactgtgcccggcctgtttttttctatacttaaaattcagaatacacacacagcaaaacatttcttcacggagggcaccatttggttaagatgggcaaactgtacatttccagtagactcctatttcccctatttaatgaatgaggaagttgaacactctgagtgatacaaaaaatagtaacatgtggtccctgccctttactaaacatagaaagttagaagtgcctatctttggaaatacccggttattataatatcagatctagagaaccatgaaaaagcttcctccagagaaagtctcttaaaattgaacaaaatctaaaaggtgaaatagcagttaattattcccaacattataccaaagcagagagtgattactgagtctgttccagaaatccccaggatgacttgagtttgggtaagctgggcctagcctaaggctagagagaaataacagaaagatggtaaattcattcttccagcacaatacagttgctcagtaagtaagtgatactgttgtttgatgaatggtagagttttctttttcctgtttctggaatgttttatagaatacatttcaaaacatagatgattccaattgctagctggataaagatagtaaatattgacccttgcaatcaagttaaaaaaaatacatgtatgtatgactatttgtgtatacttggatgcacgcacacacacacacacacacacacacacacacacacatagtaatttcaactcaaaggcagaatcattaggaataacctagtttttaagcgagtaaaaattactggctcagccaggcatggcagctcactcctgttatatctgttatcccaacactttgggaggccaaggagggaggatctcttgagcccaggagtttgagaccagcctgagcaacataaactccattaaaaaataaaaaataaaaaaactggctggacacggtggctcacgcctgtaatcctagcactctgagaggccaaggcgggtggaacacctgaggtcaggagttcgagaccagcctgggcaacatagtgaaacccgtctttactaaaaatacaaaaattagctggcgtggtggcacatgtgtcccagctactagggaggctgaggcaggagaattgcttgaacccaggaggcagaggttgcagtgagccgagattgcaccactgcactccagcctggacgacagagtgagactccatctcaaaaaaagaaaaaaattactagcacaatctaaaatatggtttctgtgaaaagtaggattttgacaaatggattcaatgtattatttttgtagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactgctgtgtggcattcttggagtgtgctgtgaatgtgctttttaagaaattaaaaagagatcattttaaaattggttctttgtgtggtatcttcctgttccttatattaacttatgtcctggtaccaagttgctgtttctgtataaagttaagcaatgctattttaagtagattattccccctcaacttctcattgttagatttcaatcgcaaatggcctacttcacattacaaataggttccccccctcacaccttgtagattagagagtagatttttttcccatagtagaaaaagaaagtgaaaaatactggtttgctaagtaaataaaaaatcaaatactggctgggcgtggtggctcacacctgtaatcccaatacgttgggatgctgaggcaggatgatcacttgagcctaggagtttgagatctgcctgagcagcatagcagacctcatctctacaaaacattaggtgagtgtggtggcatgcatctctggtcccagctacttgggaggctgaggcaggaggattcttagagctcaggagatcaagcctgcagtgagctatggtcacacgactacactccagcctgggtgatagataaagacttggtctcaaataaattaataaaatgaaaatatataaaatacggaaatagggatattttgtctcacattaagttatcaaaataaggatgactagataacttttatttcaacaagataattaccagttttcttttcataaaaattagtttttcttgcttacaaaagtaagtcatttatttgaatttaaatattgtaggaattcagaaatgttcaagtaaaagtccctcggccaggcgcagtggctcaggcctgtaatcccagcactttgggaagccgaggtgggcaggtcacctgaggtcaggagtttgagaccagtctggccaacatggtgaattcctgtctctactaaaaatacaaaaattagccgggtgtggtggcacatgcctgtaatcccagctacttgggaggctaaggcaggagaatcacttgaacccaggaggcagaggagctgagatggtgccactgcactccagcctgggcaacagagcaagactctgtctcagaaaaaaaagtaaaagtccttcatattccaaagaccattgtttatagtgtggcatacatccctgcaatttttttcccctcagcatatggtatttccttttttaaaaaacctttgaacaaaaagcaggatgaagcgaggcagctgatggggaaatgttgagcacgggagactctaaggaagatgaagacaataggccctaagatgtgttaggagtacatttcttactgctcatttgggctccgggcatcagaagagattgttttctgcaccttttgaaattccaagctctataggagcag

SEQ ID NO: 16095 - DNA, 28933 bp, Human
gttcgcatcactgctctccagcctgggcacagagacactctgtctctgaaacaaacaaaaaaagaggggctaacatggtaaatttcatgtttcttatcaagtaaaaaggcttgctgacccacaatctatattaggtttccctgttactagcaaggagtgaaggatgtgctatcccaaaatatgtccaaaaattggtatattattttgagctaaaaacaccggagaaattgtagtttcagaaagggctagatgacctgtcgtttcctacagggaataagcagtaaagattcctctgggagtggcaccctctctgtacccgggtcagaaaatagcccttatcaccagagactgggagttggggctgcaatggacctgaataaatgaacttcccaagtaacacttaccttccactaattttacaccctccccaatatttctcctagtgactctcttagaaatgtatcgccccagccagatgccttttgtgctttcttctcaaatgcatcattctttgtctaaaaagtataaaagcatcttgctgtggccacttcttcagacctcactctcttttgaaggtccccatgaaaaactaataaagtgtgtatgcttttcttttgtttatctgcctcttgtcaattcggtttctggctccagcggaagagcccgcagaagcgctgaggggactggagacggtctctggcgcccctacacctgctcagtgagccttcagccccttctccctgacgaagctcccagaggctggaactctggcgcgggaggcacttgggaaatcctcccgaaagcaaggaggagcctttcctagaccgggagcggtcccacgcgggggtacaggttggggcaggggcgaccgagccgggcacaggaactcgcagcagggtagggttggcggctacgccgccctcggtccgcggggaaccacgcgggcttccgggtcacgccgccgcgttccgaccgccctcggggagaggggaggagcctccagcgccgggcggggcgtggttaaggccggtgggccccaccgcagccagacgctgcccgtttaagcgcagagggccgcgggtcacgtggtgggcggggtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtccggcgcgcccgcgcttcctcccccgcgcggccctgccggggtcgtgggcgcgccaaggccggtcccgcgcgaccaggcccgagcgtcccctcctgtcctgtcccgtcccgtcccagcgcgggaggcggcgcgcgctccttccttgttgggtgggctcagccgcggccaggtgtcctcgcaggtgacctcggggctggacccccgagccagctgcgcggatgcagtggccccgtggccagtgtctcaattgttggcgcgcccgtcttatctaggcttcttttgttgtgtttgtcattagttacactcgtagtcaagggtttagacgtcgagattttcattttccttgaaattttgtaaagggggaaaagactgtacttcaggcgtatcagcggcgccgatgcgcgaaccggcgttagaacttggagcctcgggaacccgacccggtgtcacggtggcatccttttcgctctctgctcttggtttttaaaattcacctgagcagccaaacatctgtaccttgatatgtgccgtgttactttagttgaacccagggtggtgtataacagaaataatcgcttgcgggttggcttctgagtttagatcctttcagagttcaggctgttaaccttgctgcttttccctctcaggtttttgctgttcgatctggtggagctactggcgtggtagttaaaggcccagatgataggaatcccatctcatttaggtaatggtatagacactttcagatcattttgtcatgtaaacagaatgatgtttttctaattcaaatggttttttataattttgtcatttggtctgccctaagaggcctgaagtctgtgtgcgcacatggaattcctgtctgtagggagggtcttcgtggcacttactagcacctcttgtcagagtggaatatctggagcagttgatttgggagccaaatacttcaaaagtggggcagccacttcctagcactggaaattaacaagtcagcgtgatgatgtgcccatttctggtttgttcacagaggagggcgttcatttctttagcccaggtctttccagagtggcaggtggaggagattcattgtttctcatgtaataatacaagaaaatcatggcttccactatacttaaggtgactgcatagtcccagttcgcactgttgaacaggtttaatgatcaacagcagggcctttcactttcagaagtgtctcgatttggatgataagctatctggccaccgtaacactggtgcttacagaaggtgaaagtataatgtaggccctcaattcagtagtgacttaaaaaattttactgttggtctgtgttaatgagaaactgtccttttttgagagggagcctccctctgttccccagggtggagtgcagtggtgcgatcttggctgactgcaacctccgcctcccaggttcaagtgattctcctgcttcagcttcccaagtagctgggattagaggcgcccaccaccacgcccggctaattttttttgtatttttagtagagatggggtttcaccgtgttggccaggctggtttcgaactcctgacctcaaaacgatccgcccgcctcagactcccacagtgctaggattacaggcatgagccgctgcacccggcctgagcaaggttttaaagtatggatggggttcgagcatggtgttttggggaactctgggtctgtgtaactgaaggttacatagggtgtctccacagggaaggggaaatggtggtggtgtggccactggcaggggccagcttgaaccttacatattctcctatgaaattagagctttatcttcttattgaaacttatcaggtggggtgtgggatgatcatgtcagtgtttggcaagatcatgctgttcacagcacggaggctggcttagttgggagcctgtcagagttagggatgctatggagagtagcaatcagcgagccatgtgtggtgaagagcagcgctctggtggtgtagagtggcattgcataggcaatcaagggatacttaggaagatgggtctctcgtaagacccgggggtcggttgggtgtggaaaacgagtgagcccgtgataatctagattgggggctctaagaagtttgtgggtggggggaaggtactgaatttaacttaaaaagagtttttagactgggcgcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactccgtctcaaaaaaaaaaaaaaaaagatttttaaaagcagctttattgaggcatagttgacacataataaactgtacacacttaatattatgcaatatgtgagttttgacatgtatacacccatgaaaccatcaccacaatcaaggcaatgaacatgttcagaccccgaaaagtttccttgggcccttctgtaatccatcccttgagttttttttttttaaatgaatttttaatttaaaaaatgtatgtattggaatagagacggggtctcactgtgttgctgaggctggtctcgaattcctgtgatcctcctgcttcatcctctcacagtgctgggattacaggtgtaggccgctgtgcccagctgagttcactttttaacatctgtctgaggcggtcatgagacactgtagtggagccatctgggttgcataatgaatgtgctgtgagatgcacaagtagatagttctttccagaagctttgctgtgagagagaaacagcagttacggagaaggctcctgagcgggtctatagttatttatgttggaacaattctcaggtgatatgtgtgtgtgatctgaattcttcaatcacttgttacccataatactgtaagtttcccagcaagttctttccagttggatttggtagtttgaaaagaggtcctactgatggcttccgaaacataattttaattttagactagaatttgctgcctcctgaatatagattgtgtcttttgccttttcaataaatggtagtagctagaattcggttatttaactactaacacaatctttcttcttaaagaatggatgacaaaggagaagtgaagtgcattaagttttccttagaaaataagatattggctgttcagaggacctcaaagactgtggtaagacttatctttaaaatacagcattaaagggcattagaaatacatttggaagagaaggaatcgcaaattttcagtgttaaaggaaacttttattatcttactgttgtgaaaggtatagttatgttgcattgtattagagccttcaaaaacgaaaaagacatttgagtgggttaaaaaaatgaccttagtttgatttttaaattaaattaaaaatttttttttgagccagtcttcctttgttgcccaggctggagtgcagtgatgtgatctcggctcactgcagcctcgatctctcaggctcaagtgattctctcgcctcagtctcccttaaaaattgttaaaaaataatttggaacttcatgtgtcttttgtattgcttgatagcagcatagaatatgtgaggtatttttggctactttgtgaattagccttttcatctctcatttctgagtgctagatctgataggagcagatattccaagttgaagcagcctacaggcactttagcccgtgtaaatgttcaccattgccgtttgtagagtagagggaaggctgttagaaacaggcagaatcctctgttagtttcttccatcagttttaagtgttaaagtcttggggaagcctcttagtgcagcaacacatttctctgacatcagctgcttgaggaatgaatttttgaaaggagttactaaactgtaactgaatatttgtattaacttaaaaaaaattgaatcgtaagcctgctgctgttgagacagatgatccgaattggtctttttatctttcctgtgttttggttgtcttcagttattttctggtcactttttaagttaatatttatttttcttgtcttgtagtatgccaacgtaggttggcagtatgctgcctaatccaaatttgtgtgtgtctgtgtgtttttcctttcaggatttttgtaattttatccctgataattcccagctggaatacacacaggagtgcaaggtatgaccccaggccctttctcagctgctggtgtcagtggtgttgagctgggttatgtagtggagagcggggcatcggggtcgcagggagcacagacttgaagtcagactgtccctcatgttgattcccaaactggagtcaggcggggtgtttgctttgtgacactgaacagttttctaagtttgaaagcttgttcctttggagggggagggttcaatggatgatgcgtggtgaacacccagtagtgctagcccttggggctgtcgtctgtcttgccctttttctcctcactgggctgacagcacatctgggtctgggccctgggatgcctcacagccacctggagtggaggtttctggtgaggagtttctttttctgtttcctgaagtttcctttcctcaatttgttgtctttgtcttgtccttactctttctttcttctcctaggtgttgattctaatccacattaatgagatttgctgggtgtagtaaactaggctagagggagctgagctaaaattggcagtgtggcaccttgggcgctgacagaagctgctagtggttggggtagggctttctgcatttttgtgactgttttgctcaatggagttcagggcggactctttggtgaggagaggtgcatccccaccactgtcctgcctgccctgcagtggccccgtgtgaagagaccctcagcccggcccttctcaaacctgtctgccctcaagcgagtcgggtgtgtgtctcagggtcctcaacccattttagtcaacactcactaaagacccttaggcctttgtacatttttaataaccatttttataacgtgggtgactaagaatgttggcagtatggtgattcctgcaggtagaagctgctgtctgtgagctctggtcagttacttttctacaaaacacagacttctcctgttctgtttagtagaaggaattaggattcaggttcttgaatgaagagttatgggcaaaaatcagggaacattgtatttaaaagaaaatttgttttgttaattagtaaacattccggggaacgttcattaaagaatgacaaactgcagagtttgtgaagcttttgaagagagttatatgtgttttttcttattaattaaaaatatttttaaaaaatttttcttagactaagaatgccaacattctaggattctgctggactagttcaactgaaattgtcttcataacagatcaaggaatcgaattttaccaggtattatgtttatcatttatgtttgttggttaaagttcagtgatagcattctggcagccttttgaattcagtactgaatatatatatatatattttaaacattttctagagatggagtcttgctctgttgcccaggctgcagtgcagtggcaccatcatggctcactgtaatctcaaactcctgggctcaagcaatcctcctgcctcagtctcctgagtaggtgggactacaggcatgtaccaccatgcctggctaatttttctttttattattttattttattttattttatttttgagacggagtttcgctcttgttgcccaggctggtggagtgcaatggcgcgatctcggctcaccgcaacctccgcctcccaggttcaagcgattctcctgtctcagcctcgtgagtagatgggattacaggcatgcatcaccatgcccgggtaattttgtatttttagtagagacgggatttctccatgttgagactggtctcgaactcccgacctcaggtgatccacccgcctcggcctcccaaagtgctgggattacaggcgtgagccactgcgcccggccctggctaatttttaaacttttttgtagagacgaagtcttgctatgttgcccaggctggtgtcaaactcctaacctcaactcctgccttggccactcagctttagtctcttgctggggattttattctttttttttttttttataattgcaagtaataaattaaaaaaaaaaaaaagaaaagaaaaagggcttggtggcccatgcctgtaattccagctctttggaaggccaaggtgggtggatggcttgagtccaggagtctgagaccagccaggccaacatgatgaaatcccatctctataaaaaatacaaaatgttagtcaggcatggtggtgtgcgcctgtagtcccagctacttgggaggctgaagtgggaggattgcttgagcctgggaggcaggaggttgcagtgagccaagatcacagcactgcactccagcctggatgacagtgagaccccatctcaaaaaaaaaaacaaaaacacaacaacattaaaaagtgggcaaaggccaggtacagtggctcacacctgtaatcccagcactttgggagaccgaggtgggcagatcacctgaggtcaggagttcgagaccagcatggccaacatgacgaaaccctgtctctattaaaaatacaaaaattagccaggttggtggcaggcacctgtaatcccagctactagggaggctgaggccagggaattgcttgaacctggaaggcggagcttgtagtgagctgagatggtgccactgcactccagcctgggcaacagagcgagactccgtctcaaaaaaaaaaaagtgggcaaaggacatgagcagacactttttaaaagaagacacacatgcgaccaacaaacataaaagagctcaacatcactgatcattagagaaatgcaaatcaaaaccacaatgagaaactatctcacactagtcagcatagccattataaaaaagtcaaagaataacagatactggcaaggttgtggagaaaagggaacccttatgcactattgctgggagtgtaaattagttcaacctttgtggaaaacagtatggcgattcctcagagagctaaaagcagaactactgtttgacctagcagccccattactgggtgtaatatgcagaggaatataaattattctaccataaaggcacatgcacgtgaatgttcattgcagcactgttcacaatggcaaagacatggaatcatcctaaatgcccatcagtgacagattggataaagaaaatgtggtacatatataccatggaatactatgcagccataaaaatgaacaagatcatgtcttttgtgggaacatggatggagctggaggccatcatccttagcaaactaacacaggaacagaaaaccaaataccacatgttctcacttctaagtgggagctaaatgtaagttatgaatgcaaagaaggaaacaacagacacggggggctacttgagcaggggagggtgggaggagggagaggagcagaaaagataactattgggtactggacttaatacctgggtgatgaaataatctgtaccacaaaccccgtgacatgagtttacgtatgtaacaaaccttcacatctatccctgaacctaaaagttaaaacaaaaaacattcaaacattgcaagatatgtaatatggaaagcaaatgttccctataatcccgataaataattattatgaacagtttggtgcatattcctctatttttaaaaataaatacaaacttctttttaacaaaaaggggaatgttgtatataaacttttgcagctagctttttttttttttgtccaaagtgtatcttggacatctttctatattttattctgactgggtagtattccactgtatggatggactgcagtttaaaaattttcttgttattggacattggctggttttccatttttttgtgattacaaataacccttcagtaacatgcttgtacacacttctttatattagagggagagttgcagtataggtacgaacatctgaaaagctgaaccagtatcgccaaatttcttctagacatgtgtattttcactagcaatataggaacttctgcttttcatacctttaggaggactggatattatcagtctatagacatttgccaacctgagaggtagaaagacttttttttttttttttttttctgagacagagtctcactccgtcgcccaggctggagtgcaatggtgcgatctcggctcacggcaacctccacctcctgggttcaagcaattctcctgcctcagcctcccaagtagctgggtctacaggcgcccagcaccacgcctggctaatttttgtatttttagaagaggtggggtttcaccatgttggccaggctggtcttgaacccctggcctcaaataatccacctatctcggccccctaaagtgctgggattacaggcgtgagccaccatgcctggccgaaagacattttaatttgcattttacattactagggaagtaagcatcttttcatttgtatattgtccatttgtattttgttaacttcctcttaaaatttttttattttgtaataattattttgagacaggatctctgtcacccaggctggagtacagtggcacaatcacggctcactgcagcctcgacctcctagcctcacgtagtcctcccacctcagcttcctgagtagctggaactacaggtgtgtgccagcacgcccaacttaatttttttttcctttttttttttttgtagagatgaggtcttgctgtgttgcctagactggtcttgaactcctaggttcaagccattcttctgccttggcctcccagagtgctgggatttatgggcatgagccactgtgtgtggtcaaaaatattttttttactgtggtaaaaaaacatacaacatttattatcttaactgtttttaagtgttcagttcagtagtgttaagtatattcattcacattgttatgaaatagctccagaacttttttcatcttgtgaaaccaaaactatccagtaaacaactccccttatcccttccctgcagccccagcaatctctattttactttctgtttctatgaatttgactcctttttttttaagatggagtcttgctctgttgcccaggctggagtgcagtggcgtgatctcagctcactgcaacctctgtctcctgggttcaggcgattctcctgtctcagcttcctgaatagctgggattacaggtgtgcgccaccacgcctggctaatttttgtatttttggtagagatggggtttcaccatgttggccaagctggtcttgaactcctgacttcaggtgatccactcacctcagcctcccaaagtgctgggattacaggcgtgagccactgtgtccggccgaatttgattaccttttatacttcatataagtgaaattatacagtatttgtccctttgtgactggcttatttcatctaccataatttcctacaggttcccccatgccatagcatgtgatagggtttcctttttaagactgataataccgcactgagcgtatacaccacattttgcttatccattcatctgttgagggacatttgggttgcttctgcctcttggccattgtgaatagtgctgctgtcaatacaggtatgcagataccgcttcaagatcccgttttcagttcttttagatttatacccagagtgagattgctggagcagatggtagttctgtttctgaatattttagggaaccgctatactgttttccatagcagttacaccattttgcaatccctccaagtgtacaagggtcccagtttctccatatcctcaccaacacttgctgttttgttttgttttgtttttgatactagccatcttaattgtggttttgatttgcgctctttgttgattagtgatgttgagcacttttgtgtgtgtgttttggccactttgtgtatcatctttggagaaatgactaattcgggtcattgtgcctatttttaaaatcaaattactattatttgttgaattgtagttctttatatattctgatattaacaccttcttagagatacaatttgcaagtattttctccgaatccggaggttgcctttccactctgtggattgtgtcctttgatgtacctgcctgtttcttttcatctgttccagcttcctgacctattaagcatgcttctgagatctctaaggggaactaatttagagggtgttaagagttctttcaggttttaattttgttgacctaatgaaagtcatataatttagaatgtatggttagagaaaatacacctgtgtgttaatgccatggtgctttgctgtaaggccatcatcgaaatcttagtaatgactggctgggcacggtggctcatgcctgtaatcctagcactttgggaggccgaggtgggcgatcatctgaggtcaggagttcgagaccagcctggccgccatggcgaaaccccgtctctattaaactccatctttactaagtgccgtctctactgtctcaaaataaaaatacaaaaattagctgggtgtggtggtgggcgcctataatcccagttacttgggaggctgaggcagaagaatcccttgaacgtgggaggtggaggttgcggtgagccgagattgtgccactgcactccagcctgggcaacaagagtgaaactccgtctcaaaaaaaaaaaaaatttgtaatgaccaataggagaactttaaacaaactttagacaaattccatacacacagaaatagaattttgtacatgtgattgcatgggaaggatggcttgctttctgggggagttccctatggtaatcatttaaaagtctgtctttctgttctctgcagtgggaaagtataccttaaggttacctagatggcttcagatcttcaagaaaaaagttaaaaagaaagaagactctagcacatcctaattattatagttcttaagaagcttacggctcctgcccctgacttgcgcagcagttcttcagtgcagtgtaccatgagcattaatgtcttgggggctctgtacagtgttctgtaatatcggaatatttagggtacattgaaaatgtgcctggattataaagtactgcatttgtatggagtcttatgaacacatctgctagaagaagggagctcctcccaggcccagtgtagactggagtcgaggtggaggccaagcagaaggcagatctgccatggtctgggaggtggccgagttaacacatggggtcctggaggtgtcagtttcttttggccgtttcctggatgaggagaaatttgttgtaaattgctcttaggtgtatccatgtgctccacatgcccaggcatgtggaggcacagataaggattttggagggaaacagcctacccaggctataattgctttgttaaggggcaggttccctaatccactcttggagccttgtttctcatctggctaatagggccagtgatgcctgcctctcagtcgtggcaaagagtaaatgagttaggaggctctgtaaagcaccaagcatagggctggttaagtagtagctgtaataagtacaagtgagaatgttcatttcacttagtgggtttcttctgctttttattctcagagcgcactgtaaggatcttctgacagtttgctgttattgatttatttattaattgagactgaatctcgctctgtcactcacgctggagtgtgatggtgcaatcttgactcactgcaacctctgcctcctgggttcattcaagcaattcttgtgcctcagccttctgagtagctggaattacaggcatgtgccaccacgcctggctaatttttgtatttttagtagagatggggttttaccattttgtccaggctggtctcgaactcctgacctcaggtgatccgcccaccttagcctcccaaagtgctgggattagtttgccgttttttaaatgaagatcctgtttcttaaactctgcttcaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggtaagaggaagcctcccctgaaaaaaacacctttccccagttgtcccctgttcctgtagcatcctaatgtgtcaggcacgttagggacaggttcctctagccgtaacgtcaccgctctgaccactagagggcactctgtatacccgtcagctcctggagccattcattctatgctgggcagacaggctgtgagaggacatgggggacggtggaaaggatccaaagacgaagtctgtgtttatccttgttggttttacacagggaatgatgaaacattgaaggggtttaataagcttttcctaaaacattttccccctaaacaggctggcactatgtcgaagctgcccaaatttgagattgaattaccagctgcgcctaagtcaactaaacccagcctttccgaaagagacatcgcaatggctaccatgtatgtccgtgtcagagagaattccatcctgtgattgctttcagtaatataaataatagaaggagtgtgttacaagcaccacgtgatgccctgacccctagaacacataaggaggactccccttgttctgggtattcagtgtataggtcctgtgaacatagaaaacctgcagtgtttttggcattcctttttgatttttatcagctttgtgatgctaaggaattcctttacctttctagcctgataaaacaagaacattgaaccaatttatttcttagtatctttgttttagaatttcttcttctttttttttttttttcgagacagagtcttgttctgtcccctaggctggagtgcagtggtgcagtgtcggctcactgcagcctccacctcccaggctcaaacgattcttctgcttcagcctcccaagtagctgggattacaagtgtgcgtcacctcgcccggctagtctttgtatttttggtagagacagggcttcaccatgttggccaggctggtctcgaactcctgacctcaagtgatccacctgccttggcttcccaaagtgctgggattacaggcatgagccactgtgcctggccaagtttattttttttaaaagctcagttaaataataattgttctaaataagaaaatagattaagattttatgtaacagacatggaactaaattacgtatatatagaggtatattttcttttactttttttttttgtttgtttttgtgatggagtcttgctctgttgccaggctggagtacagtggcacgatcttggctcactgcaacctccgcctcccaggttcaagcgattctcctgcctcagcctcccgagtagctgggactacaggtgcgtgccaccatgcccaactaatttttgtatttttagtagagacagggtttcaccatgttggccagggtggtctcggtctcttgacctcttgatctgccctcctcagcctcccaaagtgttgggattacaggcgtgagccaccacgcctggcagtacggaggtatattttcatttgaaaaagtggatatctcagtttttaagtttgtaatgaaaattttaaacacacaatagagactaataaaaaagaacccctgtatgcctgtatctgattcgacaatagtcaaaattttgcttctaagttacttctgattcttctgtggcctaaaacagtggcccaaactttcaaactttatggtagttagtataatgttctttcatttcttcttcctttttttttaaacgtactcttctgtggcattcctgtttatttttaaattttttttggagagtgtcgctctgttgcccaggctggagtgcagtgttacaatctcagctcaccacaacctccgccttctaggttcaagtgattttcctgccacagtctcccaagtagctgggactacaggcgcatgccaccacatctggataatttttgtattttctgaagagatggagtttcaccatgttgcccaggctggtcttgaactcctgggctcgggtgatcctcccgcctcatcctcccaaagtgctgggtttataggcatgagccgccgtgcccagccagcattcctgtttagacaatagataaagtgagagcagtcctggctgaagtggaggtggggacctgttccctcccaccttggtctcctccttgtccctgggcaggcccagcacagagtttaccactggactagaatatgcattcaggaactgttcacagcaacatttattagatggcacttaaatagaaaaggctgagcatggtggcacacacctgtaataccagtgactggggaggccaaggcagggggatcgccttgaggccaggagttcaagaccagcccgggcaacatagtgagaccctgtttctacaaaaaaatttaaaaattagccaggcacggtggcacgtgcatgtagtcctagctactggggaggctgaggtgagggaagatcgccaaagcctaggaggtggaggttgcagtgagctgtggttgcaccactgcattccagcctgggtgacagagggagaccctgtctctgaaaaatgaaaaaaaaaaatagtgattatattttcctgttattaaggaatatacattcattatacaaaacttggaaaacagagaagaaaatgaacttagcatatcactcaagtataactattacatgtgtttctttccaatcattttagactctatgcttaggtttggggttttcttttaaaatattatgatcaagctgtgtttagtgtgtgttctcttttccacttaactttataataggctttgagtaactgcatgtttctttgtaaacacttgttggcagcaaaatactccattaagtgaatatcttataatttacttaaccgtgatgccatttagaacaaaggaattttgaatggccagatgtgatttatgtctgtttgttccctaattagatacgggcagctgtatgttctcttcttgaggcatcattctcggacctccaacagcacaggagcggaggtggtcctctatcatctaccacggtagatttcatgctttgttttccctctctctctgattttaaaatgtgaactgcagcttgttgatctgttttttgctttctatcctacagagaaggtgcctgtaaaaagatgcacatattgaagttaaataggacgggaaagtttgccctgaacgtggtggacaacctggtagtcgtgcatcatcaggatacagaggtacaagctgtctgcgtttctaccaaagttaaggttgcttaaaagccttgtgaaaattggtggctgggcacggtggatcacgcctgtaatcccagcactttgggaggccaaggcggacagattgcttgagcccaggagttcgagaccagcctgagcagcatggcaaaaccccacctatataaaaaatacaaaaattagccgggcgtggtagtgcacgcctatagtcccagctacttgtggggctaaggctggaggatggcttgagcccaggaggtcggggcttcagtgagtggagatcgcgccactgcactccagcctgggtgatggagcaagatcctgtctccgaaaaaaaaaaaaaattggcaaaatgtctgaataagactagaaagtgcatttttatgctaagagttttggtcttccagatggaaatgggtttggtagtcttaagtagtttagaaaaaagtgattgtgtcagttgattaaagataattcaaaactatttcagaaactaacgcttgagatttgaccttggaagaaggtgggaatccgctccattccacgagtacttgaactctctgttgcaattgtgagcatggatgacagtgctgggggataatggttttgaggccgtgtggaccaggacaactagaatgggtcctgtgggctgggcctctgatataaagaagctgcttccctcctctaccctcccagagggtggtgacgctaactctgtgacacgtgaggatgtttccagttgaaatgacagagatctgcttaggtcactttgagtgagctcatcaaaggaagcatgtcataaatgcaggaaatacttgtgagaggagataaaaatattaaaagagagttgtgatgttaatgacaaattccttctcaagtaagagctagcctgtagggaggaaatgcaaacacaggcttttaaactgatttaaacagcaagatgggatggaatgaaagcaactgggcaaaccatgattgattttggcctcagtcttgtctttttcccccccagacatcggtaatattcgatatcaagttacggggagagtttgacggctccgttaccttccaccaccccgtgcttcctgctcgatcgatccagccctatcagatccccatcacaggtaacacgggttctgtagaggagtctgtgctgccctttcaccatgtggctgtgttctcaccatgatctttgggagtcacgttaaaagtggagtgaggaataaacagagattcccagatctgtctgattttgccaggggccatttgttccagttttgttgttgttttgagacagtctcactgagtcacccaggctggtaggtagtgtcgtgatcttggctcactacaatctccacctcctgggttcaagtgattatcctgcctcagcctcccaagtagtggggattacaggtgtgtgccaccgtgcccagctaatttttatatttttttaaatttatttttttgacagagcctcactttgttgcccaggctggagtgcagtggcatgatctcggctcactgcaacctccacctgtctgtcacaaggttcaagcttgtgaggtattcaagcaattgaaccaagtattcaatcgcttaaatacttgtgagaggagataaggttcaagtgattctcctgcctcagcctcccaagtagctgggattacaggcgtgcaccaccacgcccagctaatttttttgtatttttagtagagatggggtttcaccatgttggccaggctggtcttgaacttctggcctcaagtgatctgcccaccttggcctctcaaagtggtgggattacaggcatgagccaccacgcctggcccaaatttttatatttttggtagagatgggatttcaccatgttggccagactggtcttgaactcctgacctcaggtgatccgcctgcctcgctctcccaaagtgctaggattacaagtgtgagccaccatgcccagcctgttctagttttttaaaaaatgcaactactactgatcctataagctaaaattatgttgtgaaaaaagcattttctaagatagatgaatctcccttgggaggaaatagaataatttatcttccctgagctttagaatggatagttttgattagccgttgatggtgaaatatgttttaatattgaatacacccgtaacgttttctgtttgccttagctctgtaacgctgaaattaactttggctgtaggtttgttactgtaacctgggatcacttttctctttctcacattccgtgtgacagtgatgatgaatattgcattctttgggactgacagtcacagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctggtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttggaggaaggagctggttcttaacagacgttcaattaggtcttttggctttctgtgttctttcaagcttcttccttttcctttgtaaataatgttagtattgaaagaatagattttgccaagtgattgtcttgtgtctgctgcccacttggcatgaaggtaactgctggtgaattgggggaaaaaaactaaacatttagaacaagcctgtccaacccacggtctgtgggccacatgtggcccaggacagctttgaatgcagcccaacacaaattcttaaactttcttaaaacattatgagatttttttaatgatattttttaagctcatcagctattgttagtgttagtgtattttatgtgtggcccaagaccattcttcttcttcctcttaaggcccagggaagccaaaacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctgtgcactcggcgcagaccttgacacttaggtccaaagcgcgagtgctcttcgccaaagcttgtctgcctgggctctttcctacctttgggtggtctgttcacaatgaccctttctctgaccagctgattgaaacctgccttctgattgtacctgggtaattggaacagaaccaggagtcatggttagcttgtagggctgcctgcatggctcatgagcagtataactggttgttaacggtccctgtcatgtgaggttttgggggtctgcttcccagacgagctcactgtgcttggacctactctatgcaatggataatcgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgttagctccttcccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagtcctcctccgggcagctgtgaataacactccgagagccaccccgcaggcagcttccctgactgtccaggggcctcgcgtttagcgtggactcagtacatggtgggcaggggcgagtgctagcggaaactgggtttgctttttgttttcatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatacgttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcgaccttcccaccggtgtccgtgcccttttctgttctgcatgagcccgggaggtgtgctcctctttctggccttgctgaggaagcctcctcagtctgttaattgtctcttcctgggtaatttctttattagagaaatcttttttttttttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttccatgttggtcaggctggtctcaaactcccaacctcaggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcagtggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctacaaaaaaaaaaaaaaaaaaaaaaaaaaaattagctgagtttggtggtatacacctgtggccccagctactccagaggctgccgagggaggattccttgagcccgggaggacgaggctgcagcgagccgtttgtgtcagtgtacctccagcctgggcgacagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtattgtatttcttagagtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgagcagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtgggggatagtggaggagtagtaaattcagggtccctgcatcccacgagctggcggctgcatctcacttcataccttcactgtttttgtttttcccatctgtgtttgatcttgcctgtagatccttggtctactgttatagatgagaaaaatcagtctctgctttgcaatattttgtatatttttctgttatgccagagtgaggacttagaaaattaaattagaaatatttatatttgccacacctttcttcccttttgggaaagaatcctgttgagatagtgacgattcagtgttagcacttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggctgagtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgccgaagatcatagtttgtggtttttttctttcaggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatgtgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcactttttacttttgtcctcagcattacctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgatcattctcattttttttttgagacagagtctcgctccgttgcccaggctggagtgcagtggtgtgatctcggttcactgcaacctccgctgggttcaagcgattcttctgcctcagcctcctgagtagttgggactacaggtgcgtgccaccacacccggctgatttttgtatttttagtagagatggggttttactatattgtccaggctggtctcaaactcctgacctcatgatccgcctgcctcagcctcccaaagtgctgggattacaggtttgagccaccgcacctggccctgg

SEQ ID NO: 16096 - DNA, 54270 bp, Human
  misc_feature (1)...(54270): n = A,T,C or G
ttgtcaatttttgcttttgttgcaattgcttttgacgtctttgtcgtgaaatctttgcccattcatatgtcctgaatggtattgcctaggttgtcttccaagggttttatagttttagtttgtaaatttaagtctataatctatcttgagtcgatttttgtatatggtgtaaggaaggggtccagtttcagtcttctgcatatggctagccagttctcccagcaccgtttattaaatagggaatcctttccccattgcttgtttctgtcaggttctacagactattaacatggatcccagatgttcatgttcagtcagaattcaatcgtcctttttttatgattccaatgacagtaaccatctcgattcagccaacaggaaagacagatttttgttcataaggaaggaaagaaatattacagcccctgagctctaactgtgccttgccctactctgtcttaagatccaggattcctcactcaattctagacacaaataacaggctggaaaagaaatcgctgcagctcaggcaaggcataaatgtgcagatgttgtctgctgctgaagaattttgtcagacaatcagtgtggaccgtgacattggtggaagaaatgaaaaccccactagggaaagttatgttcacactctggttcccctaaccctgccgttccaagaggtgcttttatttttagatcccctgcaagacagtttcttgtctggtggtttttatagaaacaaagctccaatgagtattacctccatccccacccccatacccaggatttatgaaagtcctctttgggcaaagcacgtatcaaagatttaagggatgggtgaaacaagtcctttaccatgtccaggctgctttgcacttgagaccgtaaacccccacaagctccctggcccctggccttcattgatgctcggtcctatagaagcactggtcacagttggaagcagtttgctgactcaacatacaagagtgaccggcatttttggtatttagagcttgacctcaaaagaacacagtatggtgtgtttcaattttgttaataaaggactttgaagatgttgaatattatgtgagtactgaaattttcttttctgctcaaacactttctgggtggatgtatgctatttgaatttttatggttaattaattactatcggaaagcatcagtcaatttttcttgttatctttgagtatgtaatgactttctggcaaatttcagcatggatataaacatcaagtataaatgtgaaatgcagttcctataagtcacagcaccgggattgaattttaaagtccggaatatacgaaagtgtgtcagtgagggatcttcagttctctaggaaagggctcaaaggaaggttacagtttataacaacatcccagcacctgtaatcgctacagcactcaactacaggtgggaaaagggaggaagcaagacatgaacttggacagtcccttcgtctctggaaccttccagcaggtcatgaaagctcagagcagaacgccgtgcccttcctgacagccctctgcctaatccctgccatcatgctgcattttcctctagggcaaaaataaagcagtcattttcatgctttgcaaaatagttcaagctttttggatttccttgcatttttgtagatgattggatttggggatgcatttgaaaagccattcccagaacagcagcaaaatggaaacagccatttggatgttataccaccttcccttccaaaatggccacacgaataaccagtgcccgactaccaaggggcaccaacttcacccccaattttatttctgtatatgagttgctttaacctttaggatgactttgacctcgatgcctgctctttgagttccaggtcatggttgacagatgtgtaggctgcgtgcctcctccctctttagggtgcatgacagcttggtggtgttttcctgtttgctcacttggctttccttccctctgcttcccgggggcctcgcgggctggcagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggtaagcgctgcctggctcaggcctctcctctgcccacttctgtctctatgaggatagcaagtccgggcattgtcactgtcacactgctgcaggtctcctccctcctgcagaccccaagccaggtgctgggaaggaggaggctatgggcttcgggctccacattttccccctcctcacagtctcctaatttcacaggttcctttgaagtacagaaacatcaactttcattgcccccagattctctcttgacttccagaaatttccaagtatgctataaacatcactgacaggaaataacctatggctcaggtctcccttggggtcagccagggcagtcgctggacagagccactcaccgcctgggaagtgtgaccacccataaatcacagggaaaggggttttatgggttggacatggtcagattcttacctttttgcggtttgtcacggatcagaagaagaagggctataaatattaataaaaccttcttaactgtgttttctttgtgaaaatagaaaaagaaaaattagcatcaccctacaaaaaatgatgaaaccttttatagctgtgatgagtatctatgtggaagatttaggtgcctcctataaaaacattagaaggtaccaataaaaaccattgctgtttctactttaaagtaggaaggggaaaattaaatagtaattcagagcatgaagattcttgggagagggctgagagaaacttccccaggctgcagagctctaagggtagactctaatttctaaacaaggagtaaaatagagtttcttcttgagtgcgtaaacatttgacatgactaatgattgtcaggtttaattttttacttacagccctctgtaccatttgggggggccatattcctaaataggctctgaaatggaactaaacccacttctacaaaccatctcagtgggaggggagcaccttaatgggcccgatcagcatccccgtgtccagcttttatagcggtgccttggatgttatcacacctgaaagcagtggttccatctcaggttcacagagtggctcttcagttccttcaggtttttcccctccctacttctttcaggaggctaaagctttttgcaggagcactgtgaaatcagggacattttgtttccccacactcctcattttctcctcagcacctttctgccctggctcaggactctccattcatcctgaaccaagccatctctccacgctctccttcccatgaggttcagtctctgcctctccatctgtccatctgtatctatccatctatttatccatctatcaatctctgtatgaggggaaggctcttagcaacattaacctatgaaagccttatggtaacataaccctggcttttcccagaaactaaattattattccttcagcataatttcatttactcattcattgattcatttactcattcagaattcattcaacaaatatttactgagcatcagtcacacagtacttggccctggaatacacaattatatgacaaaaaatgtccctatcttcatagagctgacattctaatggggataattcaaaatgaaaaaaatacaggagttaaataaagtagaagagttaagcaggcttctttaaagcctgctttatgctatactttgtggagaaattctggaatatttagttataagaaataactgcgtcccagggacagtgcaaggacagggcaggcagtgaggatatccaaaaactgtttgtgtctgtgaagatcatccatccaggctcctccttgtggctttgcaggttaaattcatgaatgttcaggcttattttcatcctgaaatgtaggtcctagagctcctgtgttggctggaacctcatttaagaccagtacagttggccgggcgcagtggctcatgcctgtaatcccagcactttgggaggctgaacaggtggatcatgaggtcaggagttcaagaccagcctgaccaacatggtaaaaccatgtgtctactaaaaatacaaaaattagctgggtgtggtggtgggcgcctgtaatcccggctcctcaggagcctgaggcaggagaatcgcttgaaccctggaggcggaggttgcagtgagccaagatcacaccactgtactccagcctgggtgacagagcgagactccgtctcaaagaaaaagaaagaaagaaaaaaagagcagtacagttataaagtgctttaagcaaatgctttctaaatgtcactgagataattacaaagacttgaactcctgggtgatgaaaggaggctcttgtcatttcttccagcagctatcagaggcccctcgctaaggagaggggcaagagcctcctaaaggagtcagtcctaaaagtttaagtcacctgatgctatgtgtggttttggattcctggcttccctacacagaggactgcagaagcagcaggtgatgtgttagccacgctgcacgttcgttctttctgcaggaaagaaatgtatttgttggaataaaagtaaagttcttttaacacttttcctaaggataatacagacacacacaccctttagaaagaaaatgagtttgcagactgcaaatggcaaaggcaggaagtaacatcaccctgtgtgtcctccacagctgtgctgcctggtctggcggagctggcccaggtcaccttacagagagctgtaagactccttttcctgaaccccacatgacagtcaggctcttcatagccatgcacctcacattccgctgctcagaccagtttgtgctgctttgaagcagaacgcctctgttcctcactcccctgctgtaacatcctgctatgggcgtaggaggcgccctgtattctccccaccatgtcccagcactcagaaaacccactgggctcagctgggttgcgtaggagatgttctttctggctgtgtgtgttgagagccaatttgtttcacgtaaatcactgtagtatggtaatgccatgttcccgcgtagcatggaggggccctctctgtggcatgatgtgggcttcattggtctcagacaactttttctcaccggagtctaatctgctttccaggcactgtacagcctcttataccagagctttgcaggagaagttgcttttgcactcagctaacatgttgaccccacacacggaactcactcggcctttgttgtacaatatatattacgtggaggaaaaaaataaaataaaaaagcctggatacctaatgttaaagagatctgggacaaaataggttgattccacctctttacctatcgaatcatcacccaacccttactattgctcgggtgtactgtgttttccattgtggcatttcccagattgatctgactctggaaaccctccttcatgggatagatgagctaaaagcacattttggaaaatgctgccctagatcgttcttaaaaatcaacagaaatgtgattcaagttgctcgctgactcaacaagcttctcatttattaggtgcctacgaggtccatggcagcgggtacttgaaggatttagatgaagcagggaccagagtgcatgatggagagctggtgcgtgagtcagagggaagatcaattagggaggagagtcatggctgaaaatataaagcagtgagccagcaaacaaaccagaaccttgggcagaaaccccggatggacggctcaggaggcggactgtggccagccgcatgccagtggcctggcgtctgcagcctgaggttcccctcctcactgccactaaactctgtatccttgcagcttccttggccacaattgcctcatttccagaatggcagataatcatgctctgcctaacctgtgaggttgtcggggggaaaatgatgatgataaaggaataaatggtacaatttgagtgacacctcattgtgagttgttcttattaggaggagagatgtggcaatctgcctccctgacctagtatagatgctgcaagggatactaaagaaacagagacctggcccttgcctgaaagaagcatttggcttttttgaagacacaagacatatatacacatgaaacaaatacgaacatcaaaagacaacgcaattgagtataacagagggcaacaagtactgtttggagtgttcttggtgttttctccaaaattcagatctaattctgtcattttaagttgaagactgacatttctcaaaggaatgcggtccccctttcacgaggctatgccaaacagtgggagacacagtgatgcagccgtggagacaattggtctttaaacctagatgagtacaaagttagtctccgtagagcccggtagctgtgcagctctgggtatgtcccttagcctctctgagcctcatctacaagttagggatgataacctttcttatctgtaaagattaaatgagataatacacatgaagtgggagttaaactgtaggtattctgacaatgaaagatgattacgagataatggacgcccttaaacgccccccttagaaatttggattttgtttgagaggcaataggaggttattgtagatccttgagggaaaaaaaagtatgatttagtgatgtgttgaaagtgggtacttcaaactgatttcctcagctgtgaagtgcagaaaaaatgaccctaaagcataccaggcagtgggcctgtactaaatgtattaaattctgcccttctgttaatgctcctgctaggaagtttcagtgtgaattttcctgtgtgcagctgtgttttggctacaaacagacttctctcacatatgagatgtgggctatagaaggctccggatggtagcagtgagggagaactagtgtgaaacgcagtggcggggccagtgtgaggggtgtgttctgccgtgtgtgtgtgtgccctcttccaatatgtgcaccctttctgcaagaggccccttcagcatccattcctgtttactgtgtcccatttgtctagggaagctgaggcacaggcgaaggcactgacttgatgagagaaatgggggttgagggagacaaaattagaagccattgatttttgccaccaaattagttttcaggcactctcagctaatctcaggggaggtgagggatcccccttggccgagaagctgttccgtgtcccactgtcctgctttctctgaccatgggagggcatctgccaccgccacatgcactgggcatgttccataggtttcccgtgttccctttctctggagaagccaaataaagcgaggtcatgatttacgcagaactcagaggtacaaaaaccatctgtctttctactcatttgcatatttctctggtgccccggttccgttggtggccatgaaaacaagcaaagaaaaatgtcacgtcaaagaccagaatctgtgtcggggccagggggtccccccttccccacctgcactccaggatgggcttccgcatcctcacagcccagggaaggggccttcatcctcattctggccttcactgaaattttcttgcttctccaagtcaccagacaccctgtgccagtctgccccaaagggcagttggtcccatctggtttggggcaaccagcaagatgtccatggtccctgtcatatctctggttgcctgatccccacgctctgtggccaattcctcttggccccaacccgttctggcccatcagaggcttcccatttccctgagttgtgcccggactcagccaaggcccctgcttctatgatacagccctcttattccccttctgaaatcctcagtgcctggggtgaggccaagagccctgagttctgctcttaatacaggcctcactgttgaaaaacaaaccttgatacttcaaaggaaccttttcaaattttattatttaaatgtatttattatttttattaaaattttattaaactttattatttttatttattgtgttaaaccattttttctctggcaacagacccaatttgctctagacttgaactgatcaagcttgaagtatggagctaagcagtgtcttcttactctagcctggtatctggtctcccctgaaacaatggatgccacgaattcgaaaggtggaaggccatagggaagaaaaaacacatcaccttagccaaaatactttccccatttcacttagagtcacaaattgaaaatactctggctaaaattctattcttctcaatacacctgttttctcttaattatcataatgctggataaattgactttttagacatcagcatttactccctgtgaaattattggattggtccttaatttttttttgcttctgagacatagattcttagagacacaactgaaaagtacagacctcttctagaaacaaaatgcatctacacatttcccatccatttcagggcattccctagccatccccccaccctcaaccacagagccaacctgtggggccacagttcaaaaccaatgactttcatgagttgctctaagttagcaaacctgcttgcaggaaagtgttccatctcacctccatgtttgaaatatttctagcaaagtgtgatggaagcaggttgaggatagactgacccagtcaggctgccaaagatgcacaaatacctctgaaatagttctatatgcaaaacaagccatcttcccaaggtcattgctcctactaccaaattactacagcctacctgccttcaacacataaatcatgtgttaattgtttgggattgtaggttccacttagtcccccttcagatctccccaaagttttaagtctcaccaaaaaaacaagtgatttatgctcagggcctctaaacaattctctgagttttggggaatttcaagtttacatatgtacatataattatataaaaaaatttatactaacactcaaaagtactaggaaatgggttctaatgagacacaatgctttccttatttttccaaagaggaagtgctgcaaggacatttagtgccacgggccggtaaggacagcatcatccaggcatcctgagtgccacatggggctgccacacacgcttaatgcttccattttccttttgcttccagcccattcgttttctgctcatatacttagagaagtaagtcaagataaaaacagccaggccccttttaagtgagcctgtaatgaaagatgttttgtttgtcaccggttttctgctttcaggctgaaccggcatcctctaacaagtggcagctggataaatggctaaacaaagttaatccccacaagcctcctattctgatccaaaatgaaagccacgggtcagagagcagtcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgccgcggagaacgcgcgcgcctgcccggaggtccgcggcaagaagccaccaggcgcaccgagaggacctcaccggggacggcgccaactgcaccggcccgaggagcgcggcgcggacgcgctggggacgagcgtggtggtccccccggagcccaccaaaaccaggccctgtggcaacaacagagcgagccaccgcaaggactgcgctcctccgtgacctgcgagaagccgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaaggtaggcctggggctgactggggtgcgggggcgtggaggggaaggggctatctcttaacttgtgggtacttggatagagcacccataggctgctgtttgggacggtaggctgccgcaggagttttgtgtgtccttacctaacacacacttctagggtactttctatatccagacactgttgtaagcacttaacatctaacttagtccttagaactgctcagtgagggaagtaccattattatccctttttttgggggtggggggagggagtctcactctgtcgcccaagcaggagtacgatggcacaatctcggttcactgcaacctctgcctcccaggttcaggcgattctcctacctcagcctcccgagtatctgggattacaggtgtccaccaccatgcccagctaatttttttgtatttttagtaaagacagggtttcaccatgttggccgggctggtctcgaactcctgacctcaagtgatctgcctgcctcagcctcccaaagtgctgggattacaggcatgagccaccacgcccagcctattatccctattttatagttataggtaattaagccttgtcccactgcatgtcaaaataggaaatatttatcaagcgtgtgcacacgcagctggatgtagggcctgtgagaaagctaaacacatgagaaccctcactctttgctggcaggaatggggtgacattgatggtgggatcactcattggcccaagaggccagtggcctcatgaagttcaaggttgtggcaggtgaaaatgaatacggcagaccctgatgcagcatcagaaccagcagctgttgcttccgttagcattgatcaaggagggcttcatggtggaggggccctgaaaacagggctctgtagaggagggatatttgaatacgtccagggtcaggaatggaagcggtgagtccagggagtgagaagggcagcaaaagcaaggacagggagagctggggggcatctctggcagcagagcctgaacgtgtagcccatttcgaaggtttttgtgcaggggaataccttaatcatccattaaagccaattttgagggtttttaacccctcctgttactgtatcttcataagtaatttttatcacagtgaaaaatacaatgggtgacagaccaagattgcaatatgcatggatggctccaaatttaggacaaagttttcagtaacaacagctcacaggtatataggtccccatgacagatgctgctctaggcactttatacatgttaaatcatttcatccttataactttatgaggcaaatattgtcatacccattttacggagagggaacagaggctcagagagcctaaagcaacttgcccaaggttacataggtcctaaggggctgagccaggaattaacccaggctgtctggcttcagagcgtcacaataagaaatcagtctgaggtctgtatattttccagttttctgaagacagtctagtctatcaatagaaaagttagactggacacatacgtttcacagctatttcgaatccctgattgagaaggggactaaggagtacagcttgttaccttgtcctggccacgatgaatatatttcttgctttgtaagtgcgcatggagaaggcactcagtctcctttttatgacaatcatctttgtaacctaagggcacctatgaccagagaaattcattctaaagtaccagaccgggtacggtggctcaagcctctaatcctagcactttgggaggctgagatgggcggattgcctgagctcaggagttcaagaccagcctggacaacatggtaaaatcccatctctactaaaatacaaaaaattagccagacatgatggtgcacacctgtagtcccagctactcaggcagctgagacaggagaatcacttgaacctgggaggcggaggttgcagtgagccaagatcatgccactgcactccagcctaggcaacagagcaagacgccatctcaaagaaataaataaataaaataaaaaataaagtaccaaaggatgtttttcttcacataatattaataacattaagtaatttatccctataaagtagaatttgaagcccttgcaagaaagttcatgaaaagaaatatgttcaaggggcagctttttgcttttccttggtatggatgcaaagaaaaaaaaatttttttttttttttttgagacagagtttcgctcttgttgcccaggctggagtgcaatgatgctccaccatcttggctcaccacaacctccgcctcctgggttcaagtgattctcctgcctcagcctcccgagtagcttggattacaggcatgtgccaccatgcctggctaatttggtatttttagtacagacggggtttcaccattgttggtcaggctggtctcgaactcccaacctcaggtgatccgcctgcctcggcctcctaaagtgctgggattacaggcatgagccactgcacgtggccagcaaagataattttataaagaggccccaacatagtttccacccagcactggccattattagccggcagtgggcgcccttagttggtccccattgccctgagagtgctcacatataatggaaagtgtgtggattttcacaccaaagtgtcctgacttcaaatcctgtctttaccgtttccctcctgcaggtccagcttttcatgggccccatgcatgggaccatagtggtgtgcatcacccagggccccttggaattgaatgcttgtggctgccatcttaaaatttttcctgtaatctttgaatttgtgatgctgcaaattgatggtacatgtgcaggggcatatggagctttgactcactgtgttcccacctcctgcctgtttctgcagggcaggttctgcctgcgcttctgcctcctggcaccctgggccctaggcagcctcccacttcctgtcttagtccagggactattgctgcccttgccccaagaaggggcctaggtgcaggcagaggaagaatcttgcccatccctcatccaggtagtaagacattccaaagagggtcttgaaatcccctgggggttgcccacttgctgtgggttgttggggaaatgcctgacaactcgggcaccacaggtagggcctctgattggcagaaggggaacgcccacactggtgggctgcacacatataccttgtccaagggcagacagagcccttgagaggctacacttgcctccccaagtatccccatgcccaaagaagtacagtgtgtatagcaaatactgtagacacctccatgacagagactgtgaaagaatggagaatgttttctatttgagggctttataacatcactcttttcctgctttttgaacaaagggcccagcgttttcattttgcgctagacccagaaggttatttatggtccttggcctcctcagtgaccttaatcaggtgaccttactttctctgaacatcagtttctccatctagaaaatgctgacatctgggccggccgtggtggcttactcctataatcacagcactttgggaggccaaggtgggcagatcacgagatcaagagatcgagaccatcctggccaacatggtgaaaccctgtatctactaaaaatacaaaaatagctgggcgtggtggcgcgtgcctgtaatcccagctactcaggaggctgaggcaggagaatcgcttgaaccctggaggcagaggctgcactgagctgagatcatgccattgcactccagcctggcaatagagtgagactctgtctcaaaaaaaaaaaaaaaaaaaaaaaaaatgttgacatctttgcaggggtgttgtcagattcacacaatatgttccaacaatgcaactcagtaatacttggcagctcattttcttccctacctgctattcctcctgtttttctctacacaccctgtcttccttactacttgctggtgctcagtctttgttgagtgtaggaatcaatcaatcagttaatcatctgggaatgagtgtggctattacctctgggatggatggctaactgaatacgctgatggaaatatacacatgaaatatgcagagatagacattggtaatatatagacagattggaaatacataaagccatccaggcatgcagagtttactagagagatgtgcagaaagacgtacataaaattccgtaatattctgtgtttaaatagttgtattacttatggccatttttattttaacttaagaagcttcatttacagtaagcctgacacctggctgtactcataaaatctaaagaatcattaaacacagacacaagagaagtgaaagaacattcttatagtgctctttacttggtattctgggcattagtaccccagtactgggtgctggagatgggaccccatagacctggctgtcaaatttgtggagtctcgccctgctggagccctggagctaaggactaagaactcggagctttggtttgggccctccatgggggtactattacagtgtgggcatctgggagcccctgtggcagaggctgtgtggcaaaatcccagccagagcgagaaagtcagagtctttctctctttggtgttggcacttgtctcctggaaaacaatgcagacagccctgaggataccatactaggttcctgttatctcatggaaaatggtactttctgaatatatttgtgttgcaccttaacacatatctaaagttaaacacaggctggcctgatagctgacacctgtaatcccagcactttgggaggccaaggtgggaggatcgcttgagcccaggagtttgagatcagcctgagcaacatggcaaagccccgtctctacaaaaaatacaaaaaattagccaggcatggtggcacacacttgcattcccagctacttggaaggctgaggcgggaggatcacctgagcctgggaggtcgaggctgcagtgagccatgatcgcaccactgcactccagcctgggtgacagagcaagactgtctctaaataaacaaataaaattaaacccaatcatggcaacaaggatccaatcaaagtactgttttagaaaaaggtactttatggattctaagatgtcatgggatagtaattgaaaactagaattaaggcaccaagagataatagcttctgcttgcagttcacaaaaggcaataatttttttttttttttttgagacggagtctcactctgtcaccaggctggagtgcagtggcgtgatctcagctcacttaaatctctgcctcccaggttcaagcgattctcctgcctcagcctcccaagtagctgggactacaggcgtgcaccaccacacctggctaattttttgtattttagtagagatggggtttcaccatgttggccaggatggtgttgatctcctgacctcgtgattcgcctgcctcggcctcccaaagtgctgggattacaggcatgagccaccgcacctggccaaagcaagaatttttaaaacagaaaagtccaggcttgccactgcccttatggcatgaatcccagagaacacacacttgctgtactttattctgataccaagaaatgccaaggtgagtgccgctggagctgcagtgggaactcagaccagttggagggctaaatcctaagccggttgatggcagagcagctttcagaattcaaaatgttgaatcatggcgtcgtgcctctcctctccatcagctgtcaattgtaaaactgacagatttcatccttgcttgttgaggagctaatggggaagctatggcaggggcacagctgctcaggctgtgcttcggggaagccaggtgagtggggctcccaggaggccttgctctgtggaagtcggtgcctgggaactcataatacctcttgaaatccagtgctgattgactttagtttattcccatacagtgtgacaacgaagacgactacagggagatcaagaagtcccagggagagaaagacagctcttcaagactggccacctccaccagtaatactttgtctgcaaaccactgcaacatgaacatcaacaggtacgtgcattccctccaaagtggaagtgagctggagagatctctgggtctgaaagtcacctgctatgttggaggagggtcaggctttttgaggactactctggtcaaggtctgcagacttgcttccctcctttaacccaaatcttattattatggctacacatgtgccacacattatagctccagatactcacgcaaggttcttctccataaccaaagaccagatactagttacacacagctctgcactccccaagacatgcccttcccccaaaaaaacttaataactgaatttctaatcaatattttaatggtaaccgctaaactcctaagaacactaagcttattacacagacgaagaaatacacacttcaagctgaatctccatgtgtagcacctaaagcaattaattggatatagactaaaattgtggccttagaagggtccgtgctcccaaggttaaatggccacccacacactcctctcaagaggttccagatggacgcatccagcactgactcccctctgtgatgaatggcttacaagcaaagcaagatcccaggtatttattagaaacaagtagcttatcatcagtcgtagaagctctttccattttgaaataccacagcacggaaaccacttttcctctctaagacactcctcaccctccctgaccgtatacatagaattttgaagagagatgaatgtctcggcacaacacataaaaatgtaaactgaaaggttaggaaaagatgtagagcagtgctaaaacttggcgagggaactggagggtgagggtgcacacacacaggcacactgcagcgccggaatcaccttgaaaggcgagggctcctgtgggtctgagcaggagggagggctgcccctgcatgctgcccactcctcggtcctctttgcagggtggatgccagcccaaaatattgggaaaggggaaatggggaaaatgtagtccccaaatatttttaaatgtgtgatatcctttagtgcttgttaatgcactaaataacctttctagctgatctggtggcttccagaatttctaagcagtgaggaatataaaccgtatgtatgcacaactgcaatatgatatgaaaatagctgtgatttggccgggtgcggtggctcacgcctgtaatcccagcactttgggaggctgaggcgggcggatcacaaggtcaggagttcaagaccagcctggccaatatggtgaaaccccgtatctactaaaaatataaaaaaattagctgggtgtggtggcacactcctgtagtcccagctacttgggaggctgaggccagagaatcgctcaaacccgggaggcagaggttgcagggagccgagattgtgccatggcactccagcctgggcgacagagaggttccatctcaaaaaagaaaagaaaaagaaaaaaagaaaatagctgtgatttataccggtgacacggtctcaagtgttgtactactgctcctgctaaaccatgactctggtttcatacctttactcatagttgaaggaaatgttctgttacagtgagaggttagtgaaaatgaagaggtcacttctctattcaagttattggaccccaggttaaaaaactcttgctctagagacttagcctggaagagcctcttagttctgatggttttgttgctgttaagtggtgacacaatgcatataaaatgcttagagtacattctgagaaaggtggtctgtgtacctctggaattgtgattactactatcaagttttaccagtgctgtacagcagtccaagagaaggggattgccaatttcaaagaagagctccaaagaaagtttctttggccaacttgaatatatatataaacttgcagtgatgaaaaacaggcaatcatgatatccatgataatatttaatgtcacagttttgttttccatgcactgtaaaaatcataaagtatgtcaaataatagagactgaggaaaaggtctttcttcactcacatttcgagaaacaattataatcaggctgttcgcattatcttcagcatcagcatcttagccatcactagatgagcaacttttgattctcccaaagcacttttgcgtgacacagcctctatgttgttagacacaccgtgcttttggaacagtgcttttcaccagaaatgctatccccacatgtatccatttgcataacattcagaaccttggttttgtcatttgttctagaggtctgtgtttgtaatttctccactgtgaccaccagctaaggaaattgcttttcgaagtgactttagtggcttctttgcggtgataaccaacacgtgcaattaagagatcccaaccccaagaataatgagtaaatctttgttagatggctttaccattttttaactgactctaccaggtgacctctggaagtatcctaaattagtgatgactgagtttatttcaaactaatctgtcttccccaaacaatacttttaagtaatagaggcctaacaatataatatacattgcaaactcagatataagtgaatccctcttcactgatggttgattttggagaatgttacattcaagcacagacagtagttttgaaggtaaaataaggagttaggaatcagaaactgtaacttctactcaccatttttatttattattttatttatttatgtatttattttggagacggagtcttattctgtcgcccatgctggagtgcagtggcgcaatctcgcctcactgcaacgtccacctctcccaagcgattctcctgcctcagcctcctgagctgagtagctgggattacaggcatgcgccaccacacccggctaatttttgtatttttagcagagagggggtttcaccgtgttggccaggctggtctcgaactcccgacctcaagtgatacgcccaccttggcctcccaaagtgctgggattacaggcgtgagccaccacacccggcctcctactcaccgtttttatattctaggtttaatctgatcaatccctggttaagtcataaactcagatattaagaattggcttcacatattgcaggttgttctctggttttattatttttctatattatatttagtacaagctcagatgagatagcaaaagtctttttagaaatgtggaatatggactgggcacggtagctcacgcctgtaatcccagcactttgggaggccgaggcaggtggatcacctgagattagaagttcaagaccagcctggctgacatggtgaaaccccgtctctactaaaaatacaaaaagtagctggatgtggtggcaggcacctgtaatcccagctactcgggagtcctcgggaggctgaggcaggaaaatcacttgaacccaggaggcagaggctgcagtgagccaagattgtgccattgcactccagcctgggtgacaagagcgaaactccatctcaaaaaaataaaaaataaaaagaagtgtagaatttggctgggcacgatggctcatgtctgtaatcccagcactttgggaggccgaggcaccttgaatccaggagttcgagaccagcttgggcaacatggtgaaaccctatctctacaaaaaatatgaaaaattagcccggtgtggtgatgcatacctgtagtccctgctactcaggaggctgaagtgggaggattgcctgagcccaggaggttagggctacagtgagccaagatcctgccactgctctccagcctgggcagcagagccagatcccgtctcaaaaaaagacagaaatgtagaattcatttattgttgttgattgactttcccactgcttgctccttatgcttgttaggaaaacagtaagttgtttgttgggtattttgagatccttggataaaggacttggaaaatgaaggtgttattagtcttagtcgtgtactttggtgctggctccagaattactactcatcctgatgggaagagaaaagaaagagtgagtgagatttgcttattgtttgttatgatcctaatgccattaacttgtttcctggtataataattcccaataagcttctcctaccaacaggtcccagttgggtggtttgggtcatatgaaaacatttacctttccctgtgctgactctgtaacattccattaccgtaatttcctttttcagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacggtttgttgatgctcttcctttcccaattaaaaccaaaatgaaattgagcacccccaagctctgtctctaacctagcacagtctgaacacatgcttgaggtcccttgagaattcctgaatgcctcccgcttctaggaagacccaacagaggacagcccccttcactgtcccaacagagagcggggaagaagaaccctgagggagagttctaaccctcggttgcttaggcaagattttatttttccttctgaaaagaaaagacctcaaagtaataccatcccgggacaaagtaaattaggagtttgaaccaaccaatctttctgttgggaaaaatttcttatcccagggcagagttaaatctgggattgaaaccccacactgaaagctacagggcccccactctgcccttattggccagtgtcgcagctgcagtgggggacccccaccaccaccccttttccagtgatctcgggtgattccagcacgccccaggggaagagcaggggacttgggttcacaatctgacctcacctcttagctgcagtgtgatcttgggccagttgcttaatctctctgctcctgtttctttacctgcaaaatggtagtgataagacttaaaagagacaatatcatgaaaagaccccgaccgggcgtggtggctcatgcctgtaatcccagcactttgggaggctgcggcgggcggatcgcctgaggtcaggagttcaagaccagcctggccaacatggtgaaaccccatctatactgaaaatacaaaaattagcctagcgtggtggcaggcgcctgtagtcccagctattcaggaggctgaggtagtagaattgcttgaacctgggaggtggaggttgcagtgagctgagatctcggcactgcactccagcctgggcgacacagcaagactctgtctcaaaaaaaaaaaaaaaaaaactccaacacctagggacgcctaagcaactaacactacatgttagttcctcttcactgccatgccagcctctaacagccagtggtcctggaccactcatcctttcaggaacattagttacttccaaaccctcccctgtcataatcactgtgcctatcacaaccagctgggtggccaagcgtggtggcacatgcctgtaatctcagctactcaggaggctgaagcaggagaatcgcttgaacctgggaggtggaggttacagtgagccgagattgcaccactgcactgcagcctgggtgacagagcgagactctgtctcaaaaaaaaaaaaaagaacaggattctgcaaagaaagatgagaaagatgagggagggagcagtgtgtaacactttatcccatgaattaaagattattacaagttgctggaagttcccacgagagcctaaatcttacagcatcctcaggaaatgaaccttttttgtgcaccctcacttgggagcagtggtctttaattctagactgaaagaattggggaagacctatattagaaaaacatggaacaaaaagccaccaactcaagtttttttatttccctctatatccttatatcatgagcaactatgatacgcagagaactataaaccaattgtagattttatttagttatttttcaccgaagaggtgctcattcggtaagtacttattacgtgctgggcactgtgctgagcaccagagatgcaataacaatccagcggatcccatttgtgcccccatgaagcttacagttctagggagagagccttatacaggggatcacacacatgcatgattcaccaccaatggtttcagtactaaaaagggaactcacaaagaactaggagctcttataacaaagcagcttgaattagtcctaggagtggcaaactttctgcaaagcaggttttttgggttttttttgagacggagtctcgctctgtcacccagactggaatgcagtggcgcgacctcggctcactgcaagctccacctcctaggttcacgccattcttctgcctcagcctcccgagtagctgggactacaggcgccggccaccacgcccagggctaattttttgtatttttttagtagagacgggttttcaccatgttagccaggatggtctcgatctcctgacctcgtgatctgcccgcctcagcctcccaaagtgctgggattacaggcatgagccaccgcgcccggcctctgcgaagcaggttttcacattttggactgagtaattacttgtggtggggctgtcctgtgcaacgtaggatgtttggcagcatccctggcctccacccagtagatgctatgagcacccactcgcagtggtgacaactaaaaatgtctccgggcattgtcaacttgccccagttgagaactgctgctgtaaagagtcagataaataatttaagggtttatgggctgcacagtctccatcccagctactcaactctgctgttgtagcaggaaagcagacagtagataaatacataggcaggattggtttacagtaaaactttattttaaaaaaagggccagatttgactccctggccatagatggctgacccctgatgcgagatctctaaaaggcaagtcaccatatactaagagacaaagagcattacaggcagaggaagcagcaagtgcagaggtcccgagaaagaactgcacacgctcatgaatctggggaacagaggccacaggcaaagaatggctgaggggccacttggctgggatcgctccttttaccaagagcaagcagaggccactggaggagtttaagaacaattttaaaatgttgacatctgagcttcctggtcttctatgacagtagactctaacccttacagtgctacacgtaaaagcagtccctatttaaagaagcatttgtatacactcaatttaattacttcagagaaaccatttgcatttcctaaccactgacattgttttatgatccatgtgtttggcacacaataggtgccatgtaaatgtctgtatcccaagtaatgtgatttttaaaacttttccacagactagtgtgttccatatatatatatatacacacacacatatgtatacatatatatttgagatgcagttttgttcttgtccaggctggagtgcaatggtgcagtcttggctcactgcaacctccacctcccaggttcaaacgattctcctgcctcagcctcctgagtagctgggattacaggcacctaccaccacgcctggctaaattttgtatttttagtagagacagggttttgccatgttggccaggctggtcttgaactcctgacctcaggtaatctacctgccttggcctcccaaagtgctgggattacaggtgtgagccaccatgcctggcctagaatttatttatttatttttttttttttttgagacggagtttcactcttgttgcccaggctggagtgcaatggcatggtctcggctcaccgcaacctctgcctccaggtttcaagcgattctcctgcctcagcctcccgagtagctgggattgcaggcatgtatcaccacgtctagctaattttgtatttttagtagagacggagtttcaccatgttggtcagtctggcctcgaactcctgacctcaggtgatctccctgcctcagcctcccaaagtgctgggattacaggtgtgagacaccgtgcccagtcgatttattttttaagtaattcctagtgattcctgttgactccttctggtcttcacagacagccaacaagaaccagcaaacctgtgagatgagtgactggttgactgttgagatgagtgaatggttctgaaagcgtggttccaggatcatgggtgattacagcatccgcatcaccgggaaccagatggaaaggcagattctaggtccccaccccagccctgctgaatcccagactctcagggtggggcctggcaatctgtgttttcaccagccccctggaggatgctgatgaagactgaactggccagcctccagtctagcggactgggaaaagtgggcatctaaaccctaacccctggcctccaccacagtcactgagtgtgggcaacttgctgaacctcaccaagcctgtttctggatctgtgagagtaggcgtcatgacttcccttttgatagtgtcataagaatgacagttgagaacacaggtagaagccctcagcaaatacctagaatgcatgtatttctttattgagacaaaatcaccatcaattctaatacagcacacaaagatgttctgtagagccaaagatattctacgtatgtatgtatgtgatgggctgctcgcttcaccaggtggccaatttctcaaagatgtgtgttgtttgttgtttagaaagcagctcacaacaattctgaaaacattcccctccacaagtcacggccgcagacgaagccgtggtctccaggctccaacggccacagggactgcaagaggcagaaacttgtcttcgatgatatgtaagttcagacgcttttaaatgtggtgaggggcaagacagaacagaagctgctcaggtggaaggggcatgggcaccttggtgtggccaccttcagctacagtgcggcctttttttcccctgggacttggtcatttaaatgtccctcttgaatggaattggagccttaattttgagtgcacgcctgagtcctggtggggtttttgggtagacggaataatcagtgctaatggggttggatccaggacatcaaaaaacaaaggcaaatagcattaatgagtcttacacttctaagcacttgtacttgggctgttggcggttttatgctactagaaagagaagcattgttgtttttgtaaattataataggcaatgaataatagtgttttactcctgaaagcttttttcctccaactgctatattctttatcatagtataaatgattcttatataggaagaaaaatgccatcatccttcacccaattctagcactttcagtttcacacaagtataacttccattcccagcatcattttaaaaggaggaaaaacaagaggagaagatgaataaaaacaacatcctggaatgctctcgagaggctgaaaatgacaaatgagaaatgataaaatgatgctgaaaattatttcggctcgtagggaaaatgtatgtgtcaaggacaagcctggaaggcagaagaatcctcttttcagctttagcagtcctacgggcgtcaaatacatggctgggtgaacaaggaaaaattcagctctggggtggagcagcagcagaaataggcacttctgccctctgagggcttccagtccagctgaggagcagactacaaaccactaaccccactggacactggaaaataaaatggctctacatgtccaagagtcccagtgacaaatgccacagctcgctcagcggggccctcctaggatccattaaatgccgtctcctaaggggtgtcacatggagcacagaaagcaccatgcaggggtggctactccagcctcatcgtccgccccgctcctccatccctaactgccacccggagtctcggcatgatctatttattcacctctgtacaattccctgggaaatttaaaatactaagttttagtcttcaagtattgcatgaactcctgtaagctaattagggcacagggttttgggggtgaaagccaaatccacatttgttgtttgttttgttaaatgaacacattccaaggtaactgggtttaggaaggcttgagggcagcccaggagggcatgtgtgtttcttctcttcctgtggtggcagctgcgtcccaccccacacacactcctggccctcaccaccccgcttcctctcactgtcttcatcgcctttgccaagcagccagggaggtaggtggtgattaaccccccagggagggcatggagtgggagtacagtcaggtggccaactacatttataattagggttcagtgatataaattgttcatgtgaacttcagccatttgtaaaaagaagagattaaaattgtatataaggataacatagaaatttgcatttggaagtcataacccaacaacatgatcaaacagaaggagcattagaccctgaggtactcacaccaccgcatacttgcagtgggtggttttgagagcatggtatatacacacaaaatacaaacacatatgtcatattaaaatgcaaggaattttccagtgtatgaaccagaaagctaggtcagaaacagcaacaactaaatgattgtactttgatctacaggtacttggactttttttttttttttttttttgagacagggtcttgccctgtcacgcaggctagagtgcagtggtatgagcatggctcagtgcagcctcaaactcctgggcttacgctatcttcttgcctcagcctcctgagtagctgggtctacagatgcatgctaccacacccagttaaatttttttttttttttttgtagaaaaagcgtctcacggctgggcgcagtggctcacacctgtaatcccagcactttgggagactggggcaggtgaatcactaggtcaggagttcaagaccagcctggccaagatggtgaaatcttgtctctactaaaaatacaacaattagccaggtgtggtggcaggcacctgtaatctcagctactccggaggctgaggcagagaattgcttgaacctgggaggtggaggctgcagtaagctgagatcgtgctaccactcttcagcctgggcaacagcgagactgtgtctcaaaaaaaaaaaaaatcatgtctcactatgttgtccaggctggtctcgaactcctggcctcaaacaaccctcccaccccagcctcccaaagtgcaggattataggcgtgagccaccgtggctggcagcccttggactttttataagaggaaatgtttcttaatctgctatggctgaaactaatataatcttgtcactattggtgtcaacaaagaggctgttatcatttgttcttcccattagcaatgtgtataattttcctggctgacagctacaatgaaactgtttctccttttatggatatagatataatagaataaaaaaacactgttacatatccatcatatggagagatagatgtcgcattccaattgccatatgtcccaactgatttgaaatccataacagtaaaataaacatgcaactcaaacagccactcaaccatcgaactaagaaagttgtggaaagattcttcaagcttgaaaagcaaaaataggccaggcgcggtggctcatgcctgtaatcccagcacttgggggagccgaggtgggtggatcacttgaggtcaggagcttgagacgagcctggccaacacagtgaaaccccatctctactaaaaatacaaaaaaaaaaaaaaaaaattagccaggcacctgtaatcccagctactcaggaggctgaggcaggagaatcacttgaacccaggaagcggaggttgcagtgagccgagatcatgccattgcactccaatctgggcaacaagagtgaaactccatcttaaagaaaaaaaagcaaaaataggcatcgtctcttcctttaagcagtaaaaataagcaaccttcaagagatcactgggctagaatgtcacctaaaattgtgcaaaacgtctcccaggttccttttggtacatatggagcacttactaagtgccaagtacaggcacaagagctgaagtataatgattaattaattctcagttcttcaggggagagagaggcacatgatgacctctccaggaaggtttcctaggattactaaatttaattctcggcctccttcctgcccacctccattctgtgccagcttccccaccagcagcctcagtgacagaggaagacctcagccctgtcacctcccttgacttctcttcaccgagggtgaagagtgaacttcagccatttgtaaaaacaagcagtgaaatgaccaaagagaggccaccagtggaagaaaagactagataattaacactggagtgatttcgagttgatggaaatccagttacagtgatccaaaaagtaacagatgccacactgtcatttaatttttaaagccgcatcatgcagcttttttaaaaaagtaaactcatctctttgtattataaatacttgttaatggttgaataaacatgggattcagacaacagctgaagccagtaggctctcaataacaagtgttgaatgaacccagctgaattataaattacattcccagggaagagtgcctgcaattttttttttctatgactataaggaatctacatgcaggtgaatgtaaattaatgggtttccaagcccgttttcctaggttacttaccaaaaaatcagccgggcgtgttagcatgtgcctgtaatccctataatgcctgtaaacaggcaccagttagttcctttgggatacagacagaactgagaagaataacatttatttttaaaaatgtaatcaggtcagcctgtcctttgtatgttgtgggctcatattggtggcagtgtgacctcacctcctcccctgacattaagcaaacgcacaacattcactacttgacagccacagtattaaggtgacactagtgtggttatcaaacttttgtttaaaaaacggatctgtaagaatttgtgtcaatgaatgacaacacttgattcaacttgaggcctagaaactgatcttattagtgcaaagccatgagctgtaagttacttggtatcataattagtgacaggggaattcttggctggggaaaattgagagagaacaactgtgtcatgaaggcctccgtacagaagtcctgaacagggctaagtggtggtgagatgcttggctggaaaaccacctcctccatcctgcccaccgttctgctgtgctaggaagccagagaaccccaggtgccagggctgcctgccgctccctggaggaagtgctggctgctgcctgtatgtcacatggaaaagtcagtcacaatcagcacattcagccaaaccaccaaacgtcccttctgtccccatggtgcccgtaacaggagcccggctacctgaacctcccgacagtgaggaaagactgactatagacgccaggcgctgaaggccatggcatgtgaaatgtggccgggaggaaggaagagggacttgacatttgtaatgtacttgcacagcagtctcagagctaaaggattttaattttatagaggatgggaatactcgcatattgtaaaaggttgaatccctagcagcatgatttagtcaaaggacaccaattaagatccttgagtaggcgaaattgcagctgggaaggcgctcccccaccaggggcttgcagtgggcatgttctcttgagggtctcctctcctagtcctttcaaagcagggaccctacctttttgttttcctgattaatcattaagcctttattggtcttcatatggaatttctcccattatgaaatccctgtctcaaggccaggagcttcttttgttctaaccaaaacagagtgagagagtaagagtgagtgagagagagagagaaagaaatgaagtaggatttgcaaaggggtgcgggggacagggtgcggagacaaggacattcagatctcctggattgaaatctcagctgtccaatcatctttagggttttgtaagattattttaaatgtcacactcagagaaaaacaaccatcagattgataatttcccatttcaacagaaagttacttttgattcaacacccgccccacttagcctgagcgtcctgcagagcaaaccctgccttctgtggccggctgagagggaagcagtcctgtggcctgaagaaacagtgaatgaccgcttgtgcctgggagaagcccggttccagggactctgagccccagccgacatcaaagttgtggaaataaaagctgtgtttgaatccttgctacccaaatgcaatctacctggatctgtggggaagtgcctataaaggcagtgccagcatcctggagtggctgactctgaagtgccctcatccatagtcttcactgactctgtgtattaaaaataattacttaatttcttatgcattctcctcaaagcttgggacatattaacacctctggggcttatcagatgacaagctgacatatcggatagcagatgatgaattcatttggtatgcagttgcctatttgtctgatttggatttcaacttccctaagaaaatcatccaatttctgccgcgccgaggaacttgttgttcaaacacattgagctctcatccctgccagttttcacaaaacaggctggctctactgagggcggcatttcacagaggtaggaattacagaaaggagtctgccaggctctccgtgggagaccattcaactctatcccggccacaaaggagaacaaaaagcaaggttgctttaatattcccatgccagaagaaatatgggggtagctcaaaccctgatgctgctgagaaccaagaccgtgtgtttctaggtgggggggggggggtggtgggagggggaagagaagaaaagaaaacattctatttggatcaagtgctcagaatgcttttgttggagagagctctcataatgaagatgcatgcagctaagctctggctttcagatcactcaagccccgtttctgaagagcccatgattcacagttagttccatttatggtgtttaattaaacttttattaggtttgctcatgtgtcatcataaaataccatcactgtgggaaacaatgggaagaattttattacacaaatgaaaaatgaaaactctaggttttccatgttaaaaaaaaaatagaagattagatggaaaatctatttgaacactcagataagatctcattttagtacctttgctgtattatattctataactgtcacaatggtgacaagcaattttacttttcctactgacttgtgtattgctgtcagaagggatgcctttgtgattcgtggcaaggctggacactgggtgacatcccattggtcctgctggctttataatgatctgctctggaagtacagcactagaaatcactcgaaaggagaaaatgggccaatcatcaggcaatcttcagtgactcattatagtgagccctccattctatgcaaagatgagagttctaacaaatgtgttcgttaagtggcctccagatggtacctatgctattagcatctcaggttactgctctgattatagctgctctgatacggtcagaaaattaggtgtgttacttacccacatgtgctatggtgagagtctgtgactcagcctccatatcaggatttaaaaatatgcccctatgctgcagatgaaaacaatattgattaaggagcttatattaggaattgtgagccactgccatccataagggtaacttagaaggctggtggaaactaagataccatagcttattaccaagataatcctttaatgaaatgcatttgaagtagtgaactgttagtgacaaaacagggcaagaaaaaaaaaatgacctaacttatatactagagtatagaacagataatgatgtggagaatttcaggttgccatggagacactctctggctcattggatgcgatgctgcaccccatcggaaggcaccactcttttctaagctcaaaatgaattcagtgccattcattcaagggagacctgcttaccttctaccgtgtgccaaaaactacagggtgggaaagatcaaagaagtctacagcatggtccttactaaaaacgtaccagcaatcaagttgcacacatgcccagtacagctcagaagataatgaaataccaagtgtagtaaacaagaagtgctgtgtgagctcaggaaggacagaggggaacatggaccaaggttactcggaacgccttacggcgggggaaattgagggccaggcaacattcggctcctagaaggcactcagtgaatgaacagagaggagagtgttccaggtgggggaagtgatgagcagagctcctcggaccaggatgccatgttatcaagacaatgaggagccacctctgactttggtcaagggccttcgtgagtaagcaatatgattaagtgggttgggcaagattattggggatctgaactgagattttatctcgtagaccctggagattgattttaggtctgtgagcaggatggtgatgtgatggaagccatgtaatcccagcactttgggaggccgaggcaggtggatcacttgacctcaggagttcaagaccagcctttgcaacatggcaaaaccccgtctccactaaaaatacaaaaagttagccaggcatagtggcacacacctgtagtcccagctacctgggaggctgtggtgggagggtcgcttaaccccaggtggttgatgctgcagtatgggtgattgtaccactgccctccagcctaggcgacagagtgagaacctttctcaaaaaacaacaacaaaaataacatcaattgccagagttggaaccaaagaccagacaatatatggacattcttacaatatgtgtcaatatgtggacaaagaaggaaaactcaccaaggcaacaacaaagccattcatatggagaaagcatgggcacccaggagatgcaagagagaaaacggagtggcaggagcagggccttcctaggaaggagacctcaggcctcaccctcagtgaaagacccaccacaatgaatggacggctccagccctcagaggggggcatggggatggggtgaggaaacattttgaccccaaaactatgctgtgattctggtttgtttgattaaaatgcaatgtcattgtcacacattgcttttctaagcgttttgacctctttggatacatgaatgttctgactacctaatattacaataaggtaaaagacccattaggatctgaaataaggcagttcaaaataagcatgtaatcattggctaaacagtccatgattaatatcactacttccgtcgaatctcccgttcagagagtcctggcttatatttgatattcatgaataggtcaagtttattgattatataaagtttatgctgccggtgcctaaaaatgtcatttttttaatctatcgggctaaacacttaaagatactgtctaatgagtaccttagcgtaactgggcctcattacacacactcaaatcagtctctggatgagttaccttcatctcccggcagagtcaccgctggccagggttattgctttaataatccacatgtctgctgttaatgtttaccagctagctaatcagaactctagagaatacatggcatgtttgcattgttacaaggtagacatcattttacaattaacttcattacaactggaatgtaatcatccaacattacctctttttatttttcactgtgaggctttaagataattcaatatatacataaaactctaggtactagatatgcatataaatgacacttattttcataaggatacataaatatactcacccatatatagccatacaattattatgaggtatatttacaatctttacattaaaaggggattgttttatgtaaatattacctaaaataagatttctcgctttttttttaaccatacaataaaaaaatatattcacaaattaggccctagggggccatgttaaatccactgtaaatagagactactggcgtatgttgagtgtgtttcgaattgctaacttaagagaaaatgtattgtggtatttgacatacaggcagtagtttggaaaggcaaaaaacacacttaattccgcattaagcagagtttttaaattgtgccttaagtttgagtgaaaggaaggaatattttaaaaagacgttgcacttaagccataatgacgtttaatatcattctctccttgtaggcctcgcagtgccgattattttatgcaagaagctaaacgaatgaagcataaagcagatgcaatggtgagacccttttctttccagatacgttcttccaaattatgtgtgtactgcagcttcatcactgggacaatatagctggggtaattataaaatctattacaaggatggccgggtctgttcaatggagaaatgtttatataatcaaatgttcatagcccaataaagtatgacttcaaccaataatgcctgactgggaaaaagccctagacaaatgaatatttcaatttagtcctaaggtttgaatagtaactagagccagtggaggcagtgggcggtagtatttttttttcctttaaaaagtaaaatctagatttgcatttttctcttgttagcctgacaaacccttggcttggtcccaggatcaaatctcttttcaaaaacacttgtgttcttcacatgtatctgccgaaatgaatgctttctctgaaactgtacaacacagaaactattatctgcacgtaagactctaaagtcaccatgatttgatgttttcaaagaataacttttcttgcttggatgatctcctgttttggaaagcttgaagctctcaggcaagagatggaaaactttgttttcttttctaaaagagatcatgtggttgttccatcttaaatgaatgaagtccaaagggacatcttcccacctagtaattccagttttagtctcctccagtgttcataactgagattgaggcaggtgctggaaatgaagaaggcatttccagtgaccttcagaatactgaagatgtttaaacagtaacagtacccctcttccaatgctaccagtgtcacctattaaacacttatttacgtgaagaccactgcctatgtacactggggtacaggaggaataacccctacgtatcagaaaatagaggagggcagcggaaggtacagctcttgtccacacaatctgagtctgatggacagttctggtcatctggagaagccaatgaatggccactcttggagaagagcatcagatttttaaggagaaagagattttctgcctgaatccagcatctaaagtttacagcattattcattcattgtcctcttgcccaaccctatctttcctgttgacgatttcccaagaggagacactctgctccagccaggctggtcccctactgacctctaagcacaccttgctcctgccagccagcgggcctttgcacctgcagagattcactctcacacactctcatgggcacactcacaccctcagcatcctccccaaatctagccaaaccctaccattccttcccggcgtcatattcagtctcctccctgtggccttcccagcctctctgcggccccatcactagctcactttcctccatctcatttgcactggatgcctcattttgtattttgttgggtaatcacagactgccttgcactttgaactgtcttgtaggtgtacattttctctctccaagtctattatatgttcctggaaagagctttcgcttgtggagtgcacataccacagaattgggtgctttaggaaatattaatactaaatgaaatgacttcatctgaaagtgttatcaagaaatgttgcattataggccaggcacggtggctcacacctgtaatcccagcactttgggaggctaaggcaggtggatcatttgaggtcaggagttcgagaccagcctggccaacatggtgaaaccctgtttctactaaaaatacaaaaaaaaaaaaaaaaatgagccaggtgtggtggtgcacacctgtaatcccagctacttgggaggctgagacagaagactcgcttgaacccgggaggcagagattgcaatgagccaagatcatgccactgcactccagcctgggtgacagagtgagaccctgtctccaaaaaaaaaaaaaagaaaaaagaaatgttgcattatagcctacactacctttataagcagtttaaaattttgatttgctaaggagaggaagttttgctctgcatttctggttttgaagctatcattactaatgaagttttttttgtatttttagtggcaagacttggaatagtatttgagtattatgtcattctgttttaattgatgaatgaatcatttgaaaactggggagattctgcaatccagagttagaatatgtaattacctacaaagagtagtaaggtatggaaccaggaacttgatgcataagtttagactgatgagatcttaagaatataaagctgatttgtggctgcccttgctgatgtggggaaagaataacacaaatttcgacagctacagataatcccgtagaaatgtgttttgttttgcctttagagacagcgtcttgctgtgttatccaggttggagcacagtggggcgatcatagctcactggaacctcaaacttccaggctcgagtgatcctcctgcctcaccttcccaaaacactgggattacaggcatgagccgccaggcccaaccaaaaatcatttttattaataattttcaactttttgtcctattttagcaaagctgaaatagctccttgaggtttatctcctctcctttcccctactcactctcactcttaagtgaggttctaaatattaacaacaacaaaaaaaaaaaacaattgaggccaggtgtggtggcctatgcctgcctgtaattccagctacgtgggaggctgaggcaggagaatcgcttgaacataggaggcagaggttgcagggagactccatctcaaaaataaaaaaattaaaaaaaattgagaagaggaaggcatggagatataagtgccacaaataatgtaaaagataataaccaaggcctagaaccatccaagttggggatgtaccaaaagaagtatgaaaactcttatatgggaccagacctaccaactttgatgcatatttagcatagcatggaggaacaaggaatgaagtcgccaaaccattaggggttagaaagagggaaacagaaatcagagcagccatgcagttctgagctctgttgattgacagctgtcacatgggtttgatacaattctgtatataactgttcgctcacttactccaagccagtagcagtttgagaaaataagtaggaaaagaagtattctatttctttcttctctcagcttcataggattttagaagtcagagttgggtttctcaaataaggtgtataaactacatgacaatgccatttaaaaaaaactattgtttaggaagacactgtattaactctgttgatcaggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtaagcaccgtgttttcttgctggatgaggggaggagtgaggaatgtgtggaagcactatggttacagagaaaagaatgtcagcctgcaccatcccccaccaggaaccagtgttcatccccccaaaataagagggtaaggtcgtgcaaggcgtcttggcacaccctgccccctctgtcctccgtgagcaaggggggcagctgctgtagcccccaattgctgagggaggaggctgagtctgagtgggctgtgacatgcctgctcctctcagctaggaagtggcagattttgagcctatttcagccctaggctgctttaaaaaaaaaaaaaaatctggttcaggttagtatcatctaaatcttagctccatcagtaaatacttctggagtatttaatggaagaacattcaggaggattttatggaaggagaagccatcttatactgtctggtctaaaaactggacatgggcaccatccccaaacctgggtgaagacctgtgagcagacgtgtcaaggcattcgatggcaaacacttatcctccatgatggagacctggaaaggcacctccatcacatctctgtaaccaacagttaagggaatttcatccattagccctactgagaaccttcatagtatggtttatgtttttagccagtttaactgcttgacataatgtctaatatccataatgagaaataattcttcctaaaactaacttttaaaagtttttctgattctggggttctgtgcaatcaaagcttagacattttccaccatgtccaaacattctgcatggaagatttctaatcatcttaggatgtgatctttttggtctacattggcccaaagatgctacttggtgttttacacaccactttccctcagtaaatagtttccagcctttgaaactgtcatgccgacatcagagaacacatcacctccataaagcatttttcaagaatgttttaaagtcaacactgcccatttttcttaataaagtatttctactaaatcaatatattggtgaatcctttatactgtctttttatatggcacattactttcagtagtgatgaaatgaaagcagcaaagtaaaaagactggtaaaagttactctaacggatcctagatccatacattccttcctcagaacaaggcccagcctgagatgttcataggcaggcagggaggaaagtgggagaaactggacagggacaaagctggaagatgccctagagtgtgagtaccttgagcacagggagttttttgggttttgtctgatttgctaactggggaatcctcagcccttcgaatattttctggcacatagtatgtgcttaataaacaattaaggaatcaatgaataagcaagccatagggcctgctgtgaactggagtatcatgacctgcttaaaggcattcacacttgaaaatcaaacaagcaagcccaaacaaacaaaaaaccatgccagccagatataccatcaaagagagggtgctggggtaccacacccactgtgcccactgatggaagtaatctttcacaggtagagaacactgtccaccttctagatacttcagaatcgatagaatcacgcaaaatacagagaaaacaaagacaaaaagacaaatttggctctttttctttctttctttttttttttttttttttttttgagactaaatttcactcttactgcccaggctggagtgcaatggcacaatctcagctcaccacaacctctgcctcccgagttcaagtgattctcctgcctcagcctccccagtagctcggattacaggcatgcaccaccacatccagctaattttgtatttttagtagagatggggtttctccatgttggtcaggatggtcttgaactcctgacctcaggtgctctgcctgcttcggcctcccaaagtgctgagattacaagcgtgagccaccgcacctggctagcttttttttcaacctannnnnnnnnnnnnnnnnnnnnnnnnnnnnnnnnnnnnnnnnnnnnnnnnnnnnnnnnnnnnnnnnnnngaggcaggcagagcatgaggtcaggagattgagaccatcctggctaatacgatgaaaccccgtctctactaaaaatacaaaaaattagccgggcgtggtggccggcacctgtagtcctagctactcaggaggctgaggcaggagaatggcgtgaacctggaaggcggagctcgcagtgagccaagatcgcgccactgcactccagcctgggcgacagagcgagactctgtctcaagaaagaaaaaaaaaaaagaaaacagcattaattacatccgcacattgcccaccctgcctgaccctcctctcccctactgagacactgaagggcctggagcgctggcaaggggttctcaccaccaagatgacctagcccaggatgtacactttgtccctacgggcagaattcccttcaccagggaactccagatggccaagcaggcgtgggtcagtggagcactgccaccacacgagctcagcctggtgaccctctcctcccacccttccactctccgcaggcagtaccatcagggatgagctgaagccccggtggcaccagatcaaccacacagactaaaatagtatcagaaaggctctgaaaattaaattatcattggaaccacagcccccaaagtaggctagggccttcctgctagacctaaacagggtggctgggtttaaaataggactcaagagtctcctaacctaatggtcaaaatgtccaggataccataggaactcactcatcataccaagaactaggacagtcaccactggcatgaaaaaagatgatcagaagacctcaatgcaaagatgaatcagttgctgcaattatctgacaaggatttttaaagcagccatcgtaaaaatgcttcaataatcacagttatcactcaacaaacaaaaccagaaaatcttttcaaagaaatggaagttattttaaaaagaactaaatggaaattgtgaaactgtagaatttgataatataaaccccaaaaatggactcagtagtagagtggagatgacaggagagagtcaatgaacttgaggacaaaaaatataatttacccaatctgagcagtaaagaagaaatagactgaaaaaattaaatgaacacagcctcaagcacaataagaaaaaatccaacatttgtgtcatggaagtctcagaggagaggaatagagagtaggactgagagagtatttgaagaaataatggctgaaacttgccaaatttgtcaaaagacataaacctacagatttaagaagcagagaaaaacctaaataagataaacccaaagaaatgcatgcaaaaacacaccatgattacatttccaaaaactaaaggccaaatatcctgaaagcagccagggagaaacgataattatctgcaggggagaatcaattcgaatgacagcaggcttctctgaaaccatgcaggctgggagggagtggcgtgacagtttccaagggttcaaagaaggaactgtgaagccatgaattctagagtcagtgaaactattcttcaagaatgaagggaaataaagatagcctcagatttaggaaaagtacaagtatgtgtctctaaaagacccacccttaaagactggctaaaagaagtttctcaaacagaaataaaatgacaaaagaaggaatatgggagcattgggaaagaaggaagaacagacacatagatatatatacaataaactactccttatgagtttataaaccaggtttgaggattgaaacaaaaattataccagcagtccaggcacagtggctcacatctgtaattacagcactttaggaggccaagctgggaggatagcttgaggccaggagtttgaaaccagcccagacaacatagtaagaccccactgctacaaaacaaaacaataaaaaattataccaccatctgatactcaagacaatgctatttttaagtggggaaggtaaaggtatctaaattgaagtaagacttccatactatcccaaagtgataaaatgttgataccaataaattacatgtatattgtaaaatccagagcaaccgctgtaaaaattatgcaaagagataacactgaaaaatgctacaagtctgcatgttgaggagatagtgcgatgataacagtatgtttcttgagcaatttacaagccagccaactatcccaagagctttacaaacgctatcttagttaattcttaacacaatgttatgtgattggcagtattagtcttattttatagataaggaaatggaggcttaaagatgttaatacatttgtctaagcacttacaacttataagtcgctgagctgagatttgaacctaggacaatctgatcattacacatactgcctcagctctctcaaagagtctgcatatgtaatttggtatgttgttgggagaaagcaatggccacagtccccttggttcagaaaaataaatggaattaagtgcagtccataaaagccactagtttctcgtagtatctgtctgtagaagcaaacagagattaaaaatgtactcaggacacttatgtagctgtcaaagtaaaagttacataacaaagaaagaggggtaaatctaagcattcctctgcatacccaggatggaaattcttctggaggtaagcacagaaggatagaacttcacctccatctgtcagacactcagccataaatcaaaatgtggaaaaatggacatgttagcatatacatgaatagttcttgaactggtatcactcccgacaatctgtagcatttgaacttgtactgttaaagagcagaaagtagctgttctagtcatcacagtaatgtaatacttgggaaaatggagcagcaccagctagcttttaagaaagaattatcagcaagtactatgaaaagctaaggatcaggcagggagaactaccatcatagaagttctgttaataaaaaagctagttttactatttctttgctttttatgttttttattctattcctcctccccgctttttctaaggtatgctatgagactaaaaacccactcaggccccaatgccacaccagaagacaaacaactggctgcattatggtgagtgcccatctccgcttagaatagcagccccagcctcgcatgccatcattggcaaaccaggtgctgaaaggcatagtgtttgcccaatgtcttctaacatacaaagccccagagcagttctaatgaccagggaaagtccagaccattttttgctgccgtactatacatgatctgaattcacagtgattgaaaatcgacaggcctaccaaagtgctgggattacaggcatgagccactgtgcccggcctaatttttgtatttttagtagagatggggtttcaccatgttggtcaggctggtcttgaactcctgacctcaagtgatctgcctgcctcagcctcccagagtgctgggattacaggcgtgagccatcgcacccggcgcagccgcttactttgaaaatgatgccacagaaaaaagggaacgatcgggtaacctatagttcctttacctgtcagccctttcttactcatcagtaggtggaaggcagagaatgttgatagaatacatgtctaccaagcagtgaaataaagacagttgaattaaaaaataataataacagcaacagacacaaaaaaggtctcaaattgttacctgtcctggatttggttggtaggaggagatggtgccattgcacccagaatgttggtattctggatgtcagcatcagatccgagttagcaaataactgagtgaagagctccaaggaagagaggataagtctcagaaacgccttttgtgcccctttcaaactttaagtcccatattggaataatacactaaatgacaataatatgattatataagatagaatactgatatataaataagtatacaaaatattataggaaataataaaatgatggcacctattcccagcatagtgtttttgttgtttataatgatggcacctattcccagcatagtgtttttgttgtttataaagtacattcatgtttgtgactttagtggagctgcttatagttcagtaacatcaggtggcagcgtcgtcctttccgcagagcggggctcgcccgcgaagcagtgaaggctgcgtactagagctacctcgcgcctctcgtggagagacagcgccctctcgtggtggaagaaggaagcggccggcccctgtgacccaacagagtgattcacctaatgctgtaaaattatctagtgataaatgtatttatggaataccttcttggaattttgaattctatttttggacaaaagatgttccctcacagacattatatgcacgtatagaaagatttcctatgtagaaacaaggtattgttattgagtaccttagaacaacaacaaaaatgtttaagtcttgtttgcgcacgacgcactcagccgcttctgggcctgtttctcttttcgcctgcagttaccgatgcctggccctcctgtactggcggatgtttcgactcaaaagggaccacgctgtaaagtattcaaaagcactaatcgactatttcaaggtactgtctagtgaatgagcagaattgttccttaatttcacttgtctccctgtcaaatttgtgaagcacctggtagactccattgctttggggttaatgcaggtcacctctggtccccaaggtaaccccatttatgccacacttgtggctttcaggcctcagaatggacctttgagagcccatctaatgtatctccctgccttcttgtccaagtatttttatttttttatttttatttttttatgtatttttggagacagagtttcactctttgttgcccaggctgcagtgcaatggtgcgatctcggctcactgcaacctccgcctcctgggttcaagcaattctcctgcctcagcctcccaagtagctcagattacaggcgcacaccaccacgcctggctaattttgtatttttagtagagatggggtttcaccatgttggtcatgctggtctcgaactcctgacctcaggtgatctccccgcctccacctcccagagtgctaggaatacaggtgtgagccaccacgcccagccttgtccaggtatttttatggcttcaagagaaagaagatccagttactcgttccactgtcctaggaaattcatctttatagctaacataaattcctcatgctcacttagagcttcttttccttagaagtaaccccttagagccattccctcttagccagtctctagtagcttatttaatttttaatggcgttatttaaaatggtaagagatggcttgttagaactcagaagcagtagatagcagtgtgtagctatagggataaaattgcaaaccatgccaccttttacttatctcagggaatgaaattattttcactgggagaataaatttttaaaagccttcgctgatgtactgttgtgaggtcgaccttacattaataattaatttgagatttctggtcctcttctctgtttatctatagaaactagaaattatgccgtctctatctccaacagccctttgtcagatacacaaccatcatttgagatctgttcatgcccaacctcctctagaggtgatctctaatggccaggctgtgctgggggttcctggggtatgttcagcacactgccttccaattgtgcatgtagagtaaccaggtgctaggccatggacatcactttctcagcccattgaccgtcctgtgtcttcaggacaagaaccagcactgagccttccctttccttcaggtgcctaaagtcaacatcaatagtgttcaaaaatccagaacgtaagatctactactaaagagaattattacagtcaaggaaaatgcttgaataaagaaggaagctgaattctgtaagccgccaggggctacaacaaacttttaagggatacaagttcttaatattctctgcagcccactaatacatacagaatgggtagaaaacacgccaggcgtggtggcaggcatctgtaatcctagctactagggaggctgaggcacgagaatcgtttgaacccgggaggcagaggttgcagtgagcagagatggcgccactgcactccagcctgggcgacagagtgagactttgtctcaaaaaaaaaaaaaaaaaaggaaaacacaaccagaaaatcagagttgctcctcaaggaattaatgtcatttacccttcatcaaaagctatttttaaaatttttttaattaatcaacaacaaattgcgtgtacttatgtataatgtgatgttttgatatatttatacattgtggaatgattaaaccaagctaattaacatatccatcacctcacatacttaccgtttttgtgatgggaacatttaaaatcgattcttttagagattttcaagtatactatatatcattattaattgtagtcaccatcccatacaatagatctccagaacttattcctgataactgaaacttggatacaaagtttcaaggactttttttttttttctgtcccgttctgttgcccaggctagagtgcagtggtacagtcggagctcactgcagctgtgaattcctgggctcaagcagtcctcccacctcagcctcccaagtcgctgagaccacagatacacaccaccacacccagctcattttttcattttttgtagacagagggtctccttgtgttgtccagacccttctcgaactcctgtcctccagcgagcctactgccttggcctcccaaagtgctaggattaccaatgtgagccatacacccagcctcaagggctatttaaatgctactttgagttcagaaaccatgaaatctttaggtacccaagacaatttggctatatgtgttttatcagtacagagctatctctaaaaaaaaagaactttgttcctaccggtatttcttgggcatggggcttagtggtagaggaagagaactcaagacttctttttttgttgtttttttttgagacggagtctcgctccgtcacccaggctggagtgcagtggcacaatcttggctcaccctaacctccacctcccaggttcaagcgattctgtctcagcctcccaagtagttgggattacaggcgtgtgccaccacacccggccaattttttgtatctttagtagagatggggtttcaccatgtcatccaggctggtctcagactcctgacttcaggtgatccacccacctcagcctcccatagtgctgggattacaggcgtgagtcactgccttcttcctccattcagtagcctttactggactgtttctgcaacccccaagcctttctccccttctgccattagtgttcttatatccagaacatgcattctatagatcacgttctcagaaccacaggatgaagtggaaacaaagtgatcagtccagtagcaccagcttgagaaaggtgtcagtaacattgtgtcaagaaagggaggataagctcccctgttcaggaaggtttcctaattctcctcatgaaaataattgtatttcctgacacaggtaaaagtggcatggtttgcggtgttgtccttacatttacatcttgccattgtagcacctcagagttctgacaggccatttcttgccattttaataacacccgcactaaaaccagaaaaatcagtcaccactccataaagttctttctaaccaaaagaaacatgttgtctctggagaaccaggctgaggctgttttcttgtctctggaaggggaaaactcccatcagcatcacaaagaccgctttctcccttaacagtcctatgaaggcatgattgggttctcagaggggaaatctaactgtgcattgagcaacttccctaactagaggcaaaacttttaaatatctgatgcaagcacctggcttgtgcaacagaacttcctaaaccagaatattcagataaaccagaatgtttgaacatcctgtctgttctggaaatatattttaatcaattctattaggaatatgcaacagcaacttactttaagaagaaatacttttaaacttcctaagttaaaacaatacaatctgatgtcatgtattttcaggcactaagtaaatgtatgtcgactgtttctgcaaacatgtcctacttttaaatataaagtattgtatataaggggagatatgagggtgttcctgctcttttttccttttaagaaaaattaatttacaatgaaaaagtaaggctgcttcaagatttaacagaccgttgggattatgacttaatgtggtacctaaaatttgtacataaaaacccaggctgtgggtgaagcccttcacttacctcactgagggctgatgcaggcaccttgtccatgcaaaataacttctaaatcagaatattcagataaactagaacttttgagtatcctgtctgctagggaaatacatttaaatatattctcttaggaatgttcaagagcaactccctttaagagaaatactgttaaacttccgaagtccaggcagctgtcccgactcccttccagaaagggaacagagaactgtgatggagacttcccaggtccagtttctctgaaggtgcctttttcctgcagtgtctgcctttgcttctctctgcagtcacctgaaaacacgttcatgtcacctgtttcacctcacgcagatggcactcactgtcagtgtttttattttcttgcagaactcatctaaagccgcccaagccccatctccgtggggggccagtggaaagtaagttcgcttttccaaagtcaatgccgtaagccagacaatgcatggtgctgggccactgcgctttgctttctgttccccaaggggctgccctgcctcgcttgctcccgacctcgccactctggtttttctacctctccccttccaggagcactggaaccccatcccccatgtctcccaacccctctcccgccagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgaggtgagcgcacaccccacggggaaccaggggcttccgcctcccgggttcaagcgattcttctgcctcggcctcctgagtagctgggatactcacacagttgtatatcctttcttcatttgacattatatcaggcattttctcatgtcactaactagttcaaaaacaccctttatggtggttctataataatatcctagtacattgattatacagtcacaaagtatcctgatttctcaaaccattcccctgttgttagacatttaagttccttccaatttttttccactgtgacaaataatgttggtgtaaatatccctacataagtcattgttcatatttctggttattttctttttctttttctttttctttttttttttttttttttttttggtttgagacagaatcttgctctgttgccaggctgaagtgcaatgggcactatctcggctcactgcaacctccgtctcctgggttcaagcgattcttctgcctcagcctcccgagtagctgggactacaggcatgtgccaccgctcccagctaatttttttgtatttttagtagaggcggggtttcaccatgttggccaggatgatctcgatctcttgacctcgtgatctgcctgcctcagcctcccaaagtactgggattacaggcgtgagccaccacacccggccatatttctgattattttcttaggagggagttgtggaataaaatttgggggtcaacagatacagattctcttaagatatatattgttatatatatcaacatatgctgttaactcttctcctgaaagattatactaatttactattggccctacagcagcaggtaagagtgcaaatctgagttcactccatgaaatgcaaactatgttcccatgatagcatgggagcatgatagctccaaagagcaagatgttcaggatgagataaggaatgtatggcagagtgcatgagattgtaaataaaaccacatagtacataacatgcagcccagagaaagtccaatgagaatgccatgggggtcagaagccaccaggaggagcttgctagaggagctggcatggaaccatggaacagggctttgaaaagcacttagatttttgggaggctgaggtgagtggatcgcctgaggtcaggagtttgaaaccaggctggccaacatggagaaaccccgtctctactgaaaatacaaacattagccgggtgtggtggtgctcgcctgtaatcccagctactcagggggctgaggcaggagaatcgcttgaacctggaaggcgggcagtggttgcagacagccaagatcgcaccattgcactccagcctgggcgacagagcgagactccatctcaaggaaaaaataaagaaaagaaaagcgcttagcagttgagtgactgaaataggtggggtgggtgtcaccagtggacaaaacagaaaggacaaatgtatagaaatacacgtgtccagtttgggagactgtgagcaggccaagctccagatggcactgccagctgcctgctagatgtctcctaccagagggctcagtgccaagtgtccagtgcagacttggcattgttcccctacccctacctgctcctcctcctctgttctacccctggatccctgccctggccaacctcctagccacctccccatccctgccccagcaagtcttcattcagcatgtatgtgaggacctttgagacacttctcccagatgcttactcccaagaaatgtatgcagtgaccagccatgacagtagagtagccatatgaatgtgttttcctctatcagccactaaactgtgattttgagacagcagagcccacacaattcatcctgctatcatcccctacccacccctgcacctagcagagtgccttggtacatcatagatatttgtttgtttttgaggcggagtcttgctctgtggcccaggctggagtgcagtggcacaatctcagctcactgcaacctcctcctcccgggttcaagcgattctcccacctcagcctccggagtagctgggattacaggtgtgcgccaccacacctggctaatgtttgtttgtatctttagtagagacagggttttgccatgttgtcctgactggtcgcgatctcctgacctcaagcgttctacccgcctcagcctcctaaagtgccggaattccaggtgtgagccaccgtgcttggccacatcataaacatttggtgaaagggcaaacctagggaatgttcaaaagctagaaggtgacttcagtccagatgtctcgtgacccatctctgatttgcccccaggaacctggagcctcaccccttggactcactccaggggctcagcgcataccagaattgagtacagggtgagggacgacagagccacgttcacgttcaggagtgggaagcattactggactaggagaatgcagctggaggatatggattttctttgctatttggctaagcaaatactattcatttgagttagaaatggcagatatcatgtatttatttatttggatataggatgagttccccatccttggattttattttgttcaaaggaatgctaaagttacatgatggaacggagaatccttgatttatatagagaccatgaatggaatttttccttacatcagttgctcaggatagcacacctagcatgtgtggcattcttaacaactctttctgtccccctagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactttctattccattccagtgctaaaccgtgacttcttagaaaattcaaccaaaatctcatgggttagttaaccaggtgcaatacagcacaccaaaagcttgactgccagtgaagatggacctgctcttatactgttgattactttcagtattaatatactattccccaattattttttgattggtatgtattaatgggtaattgaataatgaaaataagccaggtatttttgtgccggaagtttactagattgcatgttaccaaataccctgctcttcctctaattcccttcccccatctgactctattatcaactaaatgcattccaggcaaacagatggacactcacagcccttcccagccccacctccaagtagtatgcaaatggcactgagatttagcaaaaacgcggcgtctttgaaagttaacagacactaaggtagcagtgcctgtgtgttggagctcagttaggagttgaagttttctgcacctgtgataacaagcccaccagccacatgcatttcttcttcctgccactgtgactcggtggctgtagagccacatggcatttgtcagccaatctgtttcaagtcttttctttccaccaatagctttcttacagattttcttggctaaatgaggccattacctagattgtcccttcagtaggagcctgaatccttcgcttaccaggctgagagctatttgccatgataatgctgattctctcactcctcatgcagaatgtgcacctgcagccctttgatgcgttttgatttgggggcgatttttcaggctttgattagcaggctgcttgcaatgcagaagatcacagttcctttctggggcagcagcaaccagagcctcttcctgtgtcctgtgtgtctggtatgtttacaccttgctctgagtttttctcttgttttctttttttaattaagtttacattttagtttctttgacatcttgtttacagtttttgtctgatgttttttcttttgtagtgtcttatgccctagatttagtcatcttgttaaatatatttggatatgaaatcttgacgaaaagaaaataactcctgaaaaagagggtctatcttgccacacgttaaaaacaaaaataatgtccttgtggcctcttacttgataaagttgcaccaggacggtctgagaaaggcaggcggtgtaatatgtggtgcaatccattttttcaaggtgatgacggcacaaaatacttagactagatgctgatccataaacattcactgatattcttacaggttggtttgcagtgttaacatttttgttagcctgatctgtaggtgggaagtaagatcatcataattccttagctctgagcactgattcaaaattgtataaatgactgaacaacttagatgatttgaaattaattgaaaataagaagggcttgtggaatttgcatttggctttggccttcaagcatttggaaatattaagagaatttccattttacatgtctccaactggggtgcttcttacaaccctttcactttttttttgagacgagtttcgctctgttgcccaggctggagtgcagtggcacgatctcggctcactgcatcctctgcctcctgggttcaagtgattgtcccgcctcagcctcccaagtagctgggattacaggtgtgcactaccatgcccagctaatttttgtgtttttagtagagactgggtttcaccatgttggccaggctcgtctcaaactcctgacctcaggtgatctacccgc

SEQ ID NO: 16097 - DNA, 93971 bp, Human
  misc_feature (1)...(93971): n = A,T,C or G
gagaggcacacttatctgggatgcagtctggggagtcctggcgaggcagcttccacctgctggaggaggggccggggcggagctaagatgcggaggagggtgacgcactagctctccagttcgcccgttcctggcctgacccccaccaaggcccataccgcagtaggctcctcgggctgcccctcggtgagtacagttttgatgtcggctcggccgcctgccgccaacccgagatttggtattgccagttgtgggagggcgtcctgctaaaatccttgaggtggaggctggggtcagacgaaggatgcgtaggggattagaatgtttggctatcagtaaggggaagggagtactgagggaggagattgtgtagttcatcaaatcagagcggcgtttgctgggatgacatcctgcattcagagtggacaagggaaagatggagatggagagcctcgtgtctgcctccagccttttccatcagaattgcagattttgctgttaaacagctactctcagctctttggagagcaaggttttatatctagtggctagaaaaggccttttctttgcagaaaaagaaattggagggtataaaaatttttgtttcagtaaaggaaatgcacgattttgcctcctcccacctctccatcccccatcctcagtagaagaatgattagaaggagggtttgcgccggtcctggtggctcacgcctgtaatcctagcgctttgggaggctgaggggagggggtggatcacctgaggtcaggagttcgagaccagcctgaccaatatggtgaaaccctgcctctattaaaaatacaaaaattagccgggtttggttgtgggcgcctgtaattccagctactcgggaggctgaggcaggagaatcacttgaacctgggaggtggaggttgcagtgagtcgagatggcgccactgcactccagcctgggcaacaagagtgaaactccgtctcaaaaaaaaaaaaaaaaaaaaaaaaaaagggtttgcaaggccgctgcctgaagcatgcatccaaacacgttaagcagctgtggggtaagctgcaaggataatgttcacttgttttgcagacatacccatagaaaccaacattttggacaggttgaccctcccacccccaggctagttaactccctctcaccaccactgcctccccatattctaacctccagaactgttaaggcaatgttagcaacataataatagcaatataggggctcattctgtgcctggcattgtcctaaacactcttaacatgtatttgcacacaccctcacaacaaccctaaaaggtaaatgctttaattatctccgttttgcagaggaggaaactgagggacttgcctacgatcactcagcatgtggctgagcaaacaaacctcaaactaccccagcagattgcagggctggatctaaggaacattttccttcctttcaggatcgcaaacgtattggatgtttgctaaactgaaatgtttccctgccaccactcccaaccttcctgagcttcttgatttgtgtcttcctgactccctcctgttagacttttattcccagagactgggaaaacccaagatgccactatctctttctcaaaatgtaagcaagtttggtttatttgttttagtaagagagggagagagtgatgaagttaggagtaatgcagaactttcagggagctacaaggaggataaaaattatgagtgagaaccgccattccagcctagctttctcaagaatgcaaacagagggaattggatacctgcaactgttttgtttaatacctttctgcaatgatgctctgcctagcatggaaacttaagacaaaagcaacctcctaaggattctttgttacaacccctttctgggtggtcctcgaaccacaacctggagtggttgcatcattataattgtattatcacaattgccgattgtagcctatcagtatacatttggtcttttatctgcaggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtatttactgtgttctgatggtttgaagtttccgttagcattttaaataatatatttgcacacttctcacaacaaccttataagtagatgcctttattatcctatttttttcagaggaggaagctaatttttaagagactctactttctcatggttttccctttcttcttctacacagtgtctacatacttacatatacacacccacatgagactataagtcctgtgagagcagggaccttatctatctaattcatagctgtagccctagcacctagcacaatgtctggtacataataggtgctcaattaatgtttgttgaatgaatgaaggagcatctagtgttatcactaaagaaagattagaacccagacatgatgttttctcctcactgctgatcttcaggaaattgtgtcatcagatagctgccttttgagtcaatgccagccagtacttgtaaaagagcttcaaaatgtagaacctacaggatctgacttgattcctaggaatgactccagtatacccaagaggagacaaaagaggtactgacattaagagtttacgtgaaagcttttgaaaatatttaaaaatataacaattttattaaataataaattaagaataattaaatcgttttaaggtggcaagaccattttccccctgaagttttccaagtttctggcaatgtggtcataatacttgtattagaaagcagtacttcatttgtttgttgtttaatgatttgtttataaagagaatctagcttctatgagctggtgatgcagcgttagacagattccttatttccatgctttgctttttatcctctgattctaatgatctccttctccactaaggcagaatcctaaagaagtagcatggttaatttcagttaaatgcaagggagcatttccttatagttcaaggatttgcccatggagtgggtccgaaggaaaatgagaattatctctaaaagcataccaaccaaatgctgtttgttccctacagattgattatgcactattttgccagagtctgtgattttctaaaaatgctatctgccctagggttctgtgaatgccatgaatattgttgatagatgattcttatttctgttttgttacccatagttttaagccattgagtaaaactaattcggtgagattgtagtctgtttaggttgacatttgatttcaggagtggattaacacaaatgtgttgaatcggcaagcatgcaaacctagcacatggcttgaattagaacaaatccgacagagcttcctgtcatcccttttagggagaatctcagtccttctcagcatctgtcaccgttacttcaagcacacctatatatttcaggccagctcttttgagacaaacaataaatatctacctttttaaggcaggaagtgcttggttattcacctaagctgttgtcatgggagctctctgagtttccactaatacctgaggcctgatcagctgtgctggaaaagaaacagccactcccggggcatcaaaagcctctttatccagagactccattccctccagtatccaactatttagtacccactatataccaggcactaggcaggagactggtgcagctctgccctaaagattcacagtctgagtggagagggaagtggggacacacatcaaaagttatgacagtgcatcccagcaggtgttttgatagatgtacacacaagctgccgccgtggaagcaaacaggagtaatttagtctgcttaggagtggatggggtggctataaggaaatgctgctttgaagaagcaacatttgacctgggttttgaagtttgagtaagagttcatcagggaaccataagtgtaaaggcatggaggtacaactattatgtacccacaaaaactaaaaaaataaaaggcatggagacatgaaagatcatggattaggacaattcagaattaaaaactctgtttcccttattacccttggaataatgtgcttaacatagcaatttttttttcttctttttgagacagagtctcactctgtcacccaggctggagtgcagtggtgcaatcttggctcactgcaagctctgcctcccgggttcacaccattctcctgcctcagcctcctgagtagctgtttacaggcgcccgccaccacgcccggctaattttttgtatttttagtagagatggggtttcaccgtgttagccaggatggtctccatctgacctcatgatccgcctgcctcggcctcccagagtgctgggatcacaggcgtgagccaccacacccggcctaacatagcaatcttaagtctcccctatcagtatctgtggaagggatgaatactgacttgaattttagttttctattactgtataacaaattaccacaaatttagcagtttcacacagcattcatttattatttgagttttccactgctcaggagtttggtgcggattagtgttcaggtgctgaccagaggtgtcgtcttggctgcagcttgcgtcctcttccaagctcgttaaggctgttggcagaattccatttgaattatattgtaggactgagttccctttctcttgctggctgtcagccaaccaaagcccctctcagctcttagaggccgcctcaggttgtaagccacatgccttctcatagctggaaggagaatatctctttagtcttctaattataatgtaatatgatcctgggagtgactatcccatgacctttttcagataacaagggactgatatctcattatattcccagcaggtgggaatcttgggagtcttcctagaattgtatactatagctaggatgaaaactaacaaagaaaatagtccaaagatacttggggcaaaaacaacaaaataaaaagcctgggtttttcccagtctgggaccttggcattgaatttgttgggtggtctgatcatttattcatgtgagttagttattgtttcacctcatccatttatttgcattatctttgctcacactccctgatgctaattccctctgacagacacatggagtatcttccatacccttccaacattgattttaggattttattgtgaagaaccaagttgggaaagtttatttttaattgttacagaaagaatatacataatatattatcatattttatagtaatactgtattctggtgtgaatttcaaatacacttaacatggtgcttatgagcacaaaccattgtcagagacacccgaatttgaatgccagcttcatcatttattactaatatgaccttgggcaagttacttaactcctataaccttctgtttagcttaggggtaggatttaaattcacttacttgtaagcaggtaatgttccagtccacagaagcaaaaataaagttttagcatggataactgtgctacgatgaaataatttctaaacaaatcatcatcatcatcactttagataattactggatgttaagttccttgcaggcagagttgttcactgcccaacacatggtacatagaagacaaatatctatcttgtctacttaaataaattaattgtatgatcaatggatcttaacaaatgtgtatatttgctctcaaatatagaattataaattggccttttagtataggaatatagtatcagtataaattaatgttaggtcagtgaggtatcatatatcccattaaaaaaaacatatcttctttgattccatatcccttctagttactgttccaattttctgctgcctttcacagcaacctttcacagctgcctttcacagcctttcctcacatgccaattgtacttcttcacctctcattctctcctggtccattgtagcccactgttctcaccgctcattcattaaacctactagtatttattgagtgccaggcactgttttaggtactgaggaaataaacgtgaacagcaaagtagcagggcgaggaaatgtagtccttaaataaacaaataagtattgggctttccttttttcctttttttctttacccatttgttagtttcgtttacaggtttctctggcggcctttaaaagttaagttctccagggctcagtgctgggtccacttctcttatttccctcaattctctatctacttgatctcattcattctcttgactctcaatccatttcttggctggtgactccggtgtttgtatttcagcccacatttctttcttgcatatccataggcttacactaattgctaaattgccaggtttcgatcctgatttctcaaaccaccaccttccccagcctgtttatatcagtcttttctgtctaaatgagtagtgcccctgcttagccatatatgcaaactaaatacctacagtaacccttgattttctccatcacacttcatgcctcaattttaagtaatttatttcatttttatctctaaaatccatgtgcaatttcctgtctgcttctctctagctctactccaaacaccctggtccaagataccatcatgtctggcatggagttttgaaatcgcctcctaactcatcttcctgcttctattcttgatcccttttcgattgttcttcacaggaagaacaggagttaaacttttttcaggagttaaacttgaaaagtttaaaccatattagtgtcatctccgtagttacaattccattggtggcttcccatcgtaccctgaataaaaataacccttcttgccatgacctacgaggatccacagctccagtcaatcgtactccctactttgttccacgcattctggccctgagtcacaccggcctcttcccacctcaaggctatcaacacattggatgggatcaacaatgggaggctatcaacctcccattccttgtgtagcgagtttcaaagtcacccactcagagagggctgcctgactgccctgtctgagtagcacccccctacattctctgttgcagtctcctttttttttttaaaaaaaaaacagagtctcactctgtcccccaggctggagtgcaatggtgcgatctcggctcactgcaagctccgcctcccgggttctcgccattctcctgcctcagcctccccagtagctgggactacaggcgcccgccaccacgcccggctaattttttgtgtttttagtagagacggggtttcaccgtgttagcctcctgacctcgtgatcctcccgccttggcctcccaaagtgctgggattacaggcgtgagccgccatgtccagcctttttttttaaagctccatagcattttttgtcatttataatcattgtttgttttcttgcttattgtttatctctccactggaatgtaagctccatgaggctatatctgcttattaactgcattatattccaggcacatagtaagcattcagtaaatatttgaggaattaatgtataatatcagggggaaataaatatacctaatggcaataagtatgtaaatactgttttacatctggatctgtcaagactttctgccttttagttcaaggaaaatattccatttctattctgtttttaaaaatctctgcctagaggttcttgccatgagcttagtgataatgtggtgagcaaaaatgtctgttatctagaattgactatgactgtgatcaccatggtgcaaggtttgtgccctttgtacagcgcctaccaaggagctagaaggactttttgcagtcctgggactaaaccagcagagggccaactagactagaagtttattttggaagattcctgaaccctggtagccagcctcctggtcgttaatagctttaagtggtcgctggggtagaagcatttgccaaaacatccagagaggattgggggttatgtttaacttctccgtgggcgccttaaaaacagcttggtaaggagcatctttcaaatgtgtaaattcttagtccaaagcaaataaaaacacaaagacaaacagggacctacttggcattacatgaaaaaaaagagtgtgtatgtttatggcagagaactcgggttaacccgtagccgtactattttctagctatgtgtaatcctggcaactttctaagcctagttctctcaaataaaatcggcccaaataaaatgggcttgtctggttcgagttggtgtttgaaaaataaaaataaaataaaatggggtttccagcccactcttacatgcaatcagtgggtgccattagtaactgaattgcaggccttcctcctctcactttgtggattatcaacaacatgttttcagtctttaatggcttaccccaatcttatttatttatttattttttgagacggagtcttgctctttcgcccaggctggagtgcagtggcgggatctcagctcactgcaagctctgccctcccaggttcatgccattctcctgcctcagcctcgcgagtagctgggactacaggtgcccgccaccacacctggctaatttttttttcgtatttttagtagagacggggtttcaccatgttagccaggatggtctcgatctcctgacctcgtgatccgcccatctcggcctcccaaagtgctgggattacaggcgtgagccaccacgcccggcgccccagtcttatttttgattactcatcagttagcaatacagttcagatatgcttcagtgcaccatatatttcagcagtaaccatcttctcccaagcccacggttgctcactggtctccaagacatagctaaatggctactgttgtattatccccagaaacaaataaagccaccaactgtccaggggactgattcggagaaccatgtgctgtgagatgggagctcttgggagttagaactggttgtgccagctgacactgatgatggccttggatggccttggatgaatccaaccagaaaatgtgctttcgttttcagaacattaacagctcaggtaaaagataggctgctcagtgccagctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattaagatagaaatgtataaacattagcatttgatggctctgagtaattttaaatccatattgccaaacattaaaatacccacgttctgccgggcgcgatggctcacgcctgtaatcccagcactttgggaggccgaggcgggcggatcacctgaggtcagaagttcgagaccagcctggctaacatggtgaaaccccgtttctactaaaaatacaaaaaattagctgggcatggtggcacgtgcctgtaatcccagctactcgggaggctgaggcaggagaatcgcttgaaccctaaaggcagagattgcagtgagccaagatcgcccattgcactccagcgtgggcaacaagagcgaaactctgtctcagaaaaataaaataaaataaaatacgttcttttttataacactgactgttggacttcaaatttttcacttagaaatagagacccaaggttattttcttaataaatatcaagtggagaaagagtcctgtggatgataggctacttgaagaggcagatcctaggagcctctactctgccaagctttggccttggtaaaggagctgcagtgcctccgctttgccacagggtggcaacagttgcttcccatttgaggatggcggggtgaagcaaaccttgaactgtaggggacactccgtttctggctagtctctctctgcagttggagaaagcagtgcagctgactcttatgtgtcttgactaaaatctgtttctaggttatcctcaccctggaggaaccaatgagaacattgggcttgtaggccatctatgaatggactgggaccccccaatgggcccatgcctttggggttgcattttgtccaccttgaacttcaatccttaaagtctctggatgattttcagtttttctctgttgagcaattgcatggatagtaatgagaaattcaaaagaaacggggaggttctttttgggaggggaaaaggataggaaagatgaacacgatgacatgtttgtgtatgtttacagtgtcctgggtatccagaaggcacttagatgtatatggcacaggagagaagtctgggagaaggaagggtttcagagtcatccccgtgttagtggtggctgatactgtaggggtggatggggtcaccctgggtgggtattgagaacaacagggcacctaagacaaaggccaggtagatgaagaagaatccacaaaggaaactgggataaatcggccagaaaggagaagaaccagcaaagatagagtgtaatgaaaacaaggaaatagtgttctgagaaggggcagtggttaccactgtcaggatcagcagagaggtcacatgaaatagtaaaaaccactgggtgtcaagtgttcactgggggtagcaacacagaagttactgctttgtgggggctttgggcagagccggctctggggagtagtgggggcccaccatacctgcagggcattgaggggataaacaaggaagaaatgcaacgtataaatgtgttcccagaatgtcaggtaaaggggagatgagtaatagctgtggaaggattgggggaagggtgaatgatttagagctgaggacggtttctgttaaggttgttttaggatgtgagaaattgaacttgctgaagtgctaattgctaagaaccagcagagagggagagttgaagatgtgggatggggagcagcaactgaggaggtgggagaggatgaggactggagcacaggtgttggcctgtgtcttaggtctttccttcctccattggggaaaaaggaaagtggcaaaggtgtgctgggatacagagctttggaggttttggcctcaggtgtttgcaagcactgtactaattctagccaccttctcaattaaaataagaatacaagaatgaaatgcagtctcccaaatctcttttctttgccagcttatacatttatacacctcactgatatgtcttttgatgttttaaaattttggacagcactatttttaacttttacaactataactattagttatttactagttatagtataaacttttaatatttactttttataactcctagatgtcttgtagatcaaaagatctaaagtgtcatctttgtctattttatatcttgtttaatagtaataaatgttttagtgaagcataaacctagaacaaaaatagaaaataatcttaatagggtgttggggaattttatgtgaacacttcatgtgtctttggaacagtacaatgtaaaaaattagcacagccttattgcatgcacaaaatgtgaaataatgtgaatcttccccaaataacaatttgtcaagaatcacaatttcaaagtagtaggcttagtaattctaaacagtgatcggtagaatctgtcatcatcctcaattaggattgttcttgaattttgtgaattttcaatcacgagtgagatctttagtccattccttaaataacatgtgactatcttagaatgtcaaagagggacacagaaaactagataacaactcctgaaattaagtttgctgtatggcaactactaattgctctgccagttgtctgactgtagaataatccttgtgaaatattcacttctatatgggttggagcctgggtaagtctgagccccagtgtattttcatggaagtcactagaaccagatgtaaatcctgggttctctagagaaacagacaaacagaaccaatagaatgtatagagagacagacagttattttaaagagttggctcatataaacgtgggggctggcaagttgaaaatttgtaagacagactggagacttgggcaagagttgataattttgagtctgaagacagtccagaggccgaattatttccttttcagaggacctcagtcttttctcttaacgtcttcagtgattagatgaagtccacccgtattatagagagtaatctgcttttcttaaagttcactgatttaaatattactcactttaataccttcacagaaaaatctagtgttggcttatgatcacacaactgggtactataacttaggcagtctgacacatgaaattaatagggtgttggggaataaaattaacacagctgtcatcaagcctccatttcctaaggaaaattattataatccacataaatatggtattttgcttttgaatctctctaacagagtctgggtctcaaattgtcttcatgcacagtgtcatgcttaccctcacaatcacttactggaggcaggcaaggagggtgagtattccttgccaccttttacagatgtggaaaaagaaactcagagatgagacttatctagggatacagcttgtcttctggtctgttcaggctgctataacaaaaattccacagactaggtggcttaaataacaaaggtttatttcacagttctggaggctgggaagtcaaaaccaaggtgctggcagattccgtgcctggggagagactgcttcctgattcataggtggctgtctttcattgtattcacatggcagaagagatgagagagctctctggggcttcttttattaccatcacattggggattaggcttcaacatgtaaattttaagaggaacacaaacattccatccatagcccagctagtatttgtgggatcagagcctgagctggaccccggtgttttcctcttctgtctgtccagcacatcacactgcttctttggctagttgatctagttaattataggtactgtacagatgcagaaagggttaaaccttgaccacaaggtttatccttaaggatgatcctcactcctgggctcattgttgatacttctttgtatttgcttctttagcctcattgtgaattggcattgatgatgaggaagagcttgccttcctcactagactgagatttgcaaatgcgcacacagtatctgcctcgctttttgtgtctgtagtgcctagacaaggccaggcaaataacacccactaaatatttgttgaaacaaccttgccatatttgctcccttgaaatagccattgacctctgagacaccagcaagtgggactcgtgttattccagtcaagattatccagccttcgcaacatgtaaatatatctggagcattttgacggtaataacctaaaagtcaccggcatttctcacacttggtcacttaggactgcaatttcctggaaagtgctttaaatatttctggagattgccgggcatggtagctcatgcctgtaatcccagcactttgggaggccgaggcgggcggatcacagggtcaggagatcgagaccatcctggctaacacggtgaaaccccgtctctactaacaatacaaaaaattagctggacgtggtggcgggcacctgtagtcccagctactcaggaggctgaggcaggagaatggcatgaacccaggaggcggagcttgcagtgagccgagatcgtgccactgcactccagcctgggcaacagagcgagactctgtctgaacaaaaaaaaaaaaaattctggagatcatagagcaaacaccatatatgatcctaagcaaaatgaattggtccacttccgtgggacagttacccattttccccttttcctccccttgtccccttaagttcggcaccaccatgcccttcagctatgattgtctcccattacagctggtgggtgcccccaagctatgcagcctcagggtgttctgttgtagtgggtgctgacttgggagggcaacgggaaatcccctcagtgtatgctatggtctgaatgtttgtgtctcccccagattcatatgttgatgcctaatccccactgcaatagtattaaaagatagggtctttgggggtgattagaccttgagggcttcacccttacaaatgggatccatgcccttatgaaagaggccagaggaagctcatttgccctttccaccgtgggagaacacaggagacggagccactgtgaggaacaggccctcaccagacacagaatctacaggcactttaatcttggacttcccagccccacaactgtgagcaataaatttcagctgtttgcatatcacttggtctaaagtattttttacagcagcctgaatggaccaagacagtgtgccttgatatccctaaatactagagattttttagggaaacatagctttattttttttgcccctctgccccacaactttctgtaggattcacatgggggtgttggacatggagacaaagctaagcactgggaaccataggttctaaaaatcccaacctttccattgaccactaaggcattatttattgtctggtgccttgcagttggcaagccgactcctctttccttcagtctgagctttctcctggaggtttctaagttcctcatgcaaataggcttctggcagatgtcctctcagacatatctgttcaaaactcagagtgttcaagctgggaccttgtttcacgtcatctggaaaaagagggaggcaacaggaagtgtgctgagtcgccagggaagccacaatcaacaatttcccacaggtaattgacaaagtggatcaggcacatgtaggaagtggaattgtggtaactaaattttatatattttatggcttgcagaaatacttttctatattctgtctcatttgatacagcctttaaaaaggttaaaaacgtttatcattgcccacaatcacaccgcttaagctttacgagttaaatgtcctgttggcaggacagctgtgttaggtttaaatgtatctccccatccagctgtcttctatcctggtagactagtacaatcctgtgatatttagctgagaaactataatgtgctgggagtcgtggtaaaccacatgtggatttgggtggatggtgtttcagagatgtgccgcttctggaagcaaatgttctgacaaactgccttcttggaaccaattggtgcaaataccttgggcaccacagttcgtaaagagaactgtcgaaggcggctggaagggtttagcagaccacaatttcgcaccgcaaatataactgagcatgcacttttgaccatggtgtgctgtgtgatgttagtagaggaaggggcactggcggtggaggctgggggggacttggtttgtacagcatagcaggaagagcactgaggcaggatgcccaggggttctagtcctagctcagaccagctgcatggcactgaacaagtcccttcagttccgcaaagtttagcttcccaatctaaaaatagagataaactgtccagtccatctcacaggtttgacagggcagtcaaattaaataatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttcaatcttaatttccttcacgtggcctcagaaaaactgccccccagtagttgcatgttaaactttgccagaatcagtttcccacctggccttaagtgctctgctctgtattggtgttgaccttaggcgtgagaaacatgtgactgtaatgaggatggatgctttctaaaagctcataaatagcaactttttcatactgaaatttgctctgttccattcttgcccttgtgactttacagatgttgtattctgccatgaaataggttatagaagcaggtttaaagtgaaggagactatgattcagctgccaaaccaaaagtgaaacctgtccatgtggatatagcagatgtcagtggaagaaaggtgtgcagaattgaaaagcttgctctccgtggtttgagaacacactgtcctcttgtgggcgtctctggcagcccatgatcggtacacttccttgaaccaaatagcctatcaaaatattatctaatacatttctacttttatttactcaatgagtaattactgagtgcctactacatgccaggaactgtggccctgatatgtttcaaaacccataaacatgcatctaacttatttatgtaggatctccatcaggcactatcttcttttaacctttccagtgaaggttaaactctgaccagaggaattgagcgtgtttacagaaaatcaggaatggaacagaattagactgcttttccccttacttcccactcccttacagcatgttccattggtacttgagtctagaggcatccagaggtgtaagaataaccaaacacaacaaagattaggagtaacgaagtgttttcatgcagtgccgcaccccagtgaggtgggctggctaaaaggatgtgatacaaactgatatccagggaatggcaaagaggagtagctgggcctgtccatcatctcttatcatgactcacagcccttgtttaaggaatttgaagtctaggtggatgaaagggacatcaaacttaaaatgcatagctgcaacctactagatagaagctgagaaccctatatgtggatcaggcagtcactactggagttcaggaggggaataaggcattggcccctagagaagacatcacagatcaaacttgagctagacttccttgaggacgggtaggatgtagatgataaagattcagcttcaggcagtaagaagtgaaaagaaacatactttttaaccagtatgtgttgagtggagggtggttatggggaagggagggtggcagggaaggctggatgcatttaaggctgtcgccaagtttttctgcttaaagagcatctgggcacagtggcacatggtctatattactcagggccctaagctcacctgagaagctccagcctcccttctgcaccttgcccacagaatgttctgtaacacttctctgtccttgcagataaataggctgccccaaatctagcgataccctcgatggtggcaggggtagtagcagtggcattggatgggacggtgggttggatatttccctttgtattggtcaaatacatgcacagatggcaccaacaccacggggatctctggagatgaaggtaggtatttcttcagtcactcagcacttaacaactgtcagagagggccgggcgtggtggcttatgcccgtaatcccagcactttgggaggccgaggcgggtggatcccgaggtcaggagattgagaccatcctggctaacacggtgaaaccctgtctctactaaaaatacaaaaaattagctgggcatggtggcgggcacctgtagtcccagctactcgggaggctgaggcaggagaatggcgagaacctgggaggcggagctggcagtgagccgagatggcgccactgcactccagcctgggcgacagagcgagactctgtctcaaaaaaaaacaaacaaaaaaaaccaaaaaaactgtcagagagataataggagaaatgtgcccctgcactcgcactgcacagcatgtgccggatcatctgtgaaatggatctttccctctgggagctccatcttttccaggtgattgttcacttggacatatttgattataagctcccagagtgtcagacacggacttctcatggcaagttagacgatcccaggtgcccagtgggtggcagtgcagtgagtggcaggaggaaaactttcctgctggcttttggtctgaccaagacagagtgatacttatccagggcctaaaataaccatagcaataggccttgccagaagggatctgtggcaggctcctggcactactggtcagttcccccagtggcctgttcaagtttttctttgcatgagacagaggttatggctgaggaaacagccaggccaggaggctagcctgccctgcagaagcccaggggaccttcctgatgccatctttctggtatgacagctcagcaggcctgtgtcaacaagccctgcacggtttggacaagatgtgagtgactaacgttttcctctggagcagcaggaatggatgggcctgctgggaagaatccctttgctgtgagctacctaagacgcctggctcctgaattgaaccagcaggtcccttctctgtatcttgcttgctttcctttaaaaaaaaaaaaatcctcagcagatgatgggaggaattatttgctgagtttgtccagactctgaatagcccttggtcactgaagtgtgcaaaaacatggcaacaatgcaggtgctatggtctgaaaatgtttgcaaaggaaggagaggaaagagcagttattctgacagtaaatgatacataatactaatattggaaggattattttttccctgtgtggtcagtgaatagaatttttggcagtcgtctatcatttaactaggtctgtatagagcacactggagcctggtaaggacctctggctttttttacagtcagagttttggtgcctaggggtctgggctgtggacaggcgagatgtacctgcaggcagggagtggtcagcttgctctcagcttgccagatccgtgactctgacgagagagttatcagtacctacagagcttcctcctgcagcctgcctacccacccaggccatcttctgacactgcctcaatgtgtccatgctccaggcaggtcagatcacctccctcattcggtttggacatcaaggagactgtgtgaatgaccatcagcctctctccagtctacccaaaggtatcaggtatccagcactattctgatggagaagcagtaagagtgagcctaccttagatctattaatagagctcattcagccaaggaaaaggatccaactaacccagatgactacatgagcctaggtcattcacatgtagctttggtgagtaatgagagatgcacgcatgatacccctgctcctgtcctttggtgccctgcacccctctcaggtgctctccagagtcagcccttctgactgcagggcagaccccaaaaggagatcagcttttcacctcgattacccctagtacttaagacatttgccttcatgagtttttggtaatcaatattgtacagccagtaatttaattttttcatggtatcaatctgatattaaagctctagaatctgggaagagcacagcaaagcttacctgactgactccactattatatttggaatggataattgagatataatttaaagggtagaatatattctttctataactgcaaaagtttgctataactcacaaaaggaaatacaaaattgagtaatagtgttggaggagaaggaagcaaatatttattttgtatctactatgtgccaaacactttatgtattgtattttgccctcagaaatcatatgcagatgattctattttacaagggaaagttgaggtttagagcaggtgagcaacatgccaagatggaacagaaggggcatagaacctggattcaagtcagagcagggtttacaccctcggtaccatttagatgtgggtcagataattctctgtggtggaggctgcatccctggcctctacccactagatgccagtggcatttcccccatttgtgacaacagaaaatgtctccaggccaggtgcggtggctcatgcctgtaatcccagcactttgggaggccgaggcgggcggatcacctgaggttgggagttcagagaccagcctgaccaacagggagaaaccctgtctctactaaaaatacaaaataagccggttgtggtggtgcatgcctgtaatcccagctactagggaggctgaggcaggagaatcacttgaacccgggaggcagaggttgcggtgagccgagattgcaccattacactccagcctgggcaacgagcgaaactctgtctcaacaaaaaaaaagagaagaaagaaaacatctccagacattgtcaaatgtcctctgagggtcaaaatcagacccgctgtggagacccatggctctagaggctttgttttttctgccatcacacactcggagggaaatttgggggtaactttaaggatgctatatggataacttatgtttcagtattttttcttatgaagataataaaagctgtcgtggatcatttcgaaaataaaataaagattgtttagaatcgtaccacctagagatacccactttcagcatttggctatgttttcttccagtctgttttctgtgcacacataggtagtttttaaaatcatacagtaaatcttttatctctttttatacttaatattatatcaagaacctatccctatattaaaatcagtgtaattatttttagtagctgcattatatcctattatatgtttatgcctcaatttactcaagcatttttgcaaatggccatttagagtttttccagtttatcccatcataaacacagcttcaatgaacatatttgtgcataaacgtttgtgtacagtcttgataaattctctggggtatatatttctatgaaaagaagaataattgggtcaagctctgtacctattgtttaggctgcatttcctacatactgtcaggttgctttctgtaagtgttggacttatatggctgtgctttctctctcacttgtttgtgggtgtcttgtctcacttgttaactataagtattaactttttaaagtattttaatttgataggcaaaaatggcatttcattgttttatttgtgtttatttgatgaccaatgaaacagaacatctcttcctattatatagctttttgcttttcttagtctctgaaatatttgttaatacgatgcattgcttctttattagatctaatttttgtctatccactttaagatttgtttctttccattttcacatgtagacttaaaactacagttctttaagctatttagcagcagtagaggaagacttgaggcaagttggaggagagatgaaggggagtgcttttgtataaattggagatcacctcaactatagaattaactgagccctgaagttggaagaagagggaagaatggcgagagaggaggtagtgcagaggtgtgcggtcaggatttcctgtaatggccaccaggtggtgccatctgcccgggacgatttgatgtctctggtgcaggagagcggagagctggggagagtattaataaggtggtcacaagcgaggtgattggagtgccattcatacatgtgggacattagttgggcctctgtaattaacctgtcaatgatcatgagttggtgcacgtgtgtttgtgtgtagagcggggaagagaagattagggctgttaaaaaaaaagaatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatactatacaattcaacaatttaaagtatacaatgtaatggtttttggtatattcacatagtagtatcaattttagattttttattgccccaaaagaaactccattccccttagccattccccccatctctgcctccttactccttccctcagtctcctttccccagaccctggaaaccactactctactttctatgtctgtgaatttgcctcttctggacatttcatataaatggaatcagaataggtggtcttttgtggctgtcactgcttgtcctagccaatgctataccagcttgactttgtggcaggaggcatcagggtatccagatagacttactgttttaaaagaaacagcatttccaggctggctaggacagagaaaactacctagaacaatacttttcctacctggtggatcatcagaattacctgggaagcttaaaatgaaagattcctggcccctaatctctccaggaattcaaatatggtagttccagggagtctgagctgcttgggatttttttcagtgccaccagtgattctaatgattgtctagctgtaagcagtgggactcaagttttgaacagaggcatgagaagaaaatggcatttccctgcagatgggctgtaccagctgcagcttcaagtccagtgcctcttgtgggaaaggagccactcccttgtcattcgccacatctacactgcaacgctggtttatgtcagactatcatctttgactcggcatgacaacagtgcatatttgaaggccatcaaaccaatgatattagccttgtttacggtttagctggaaaatatctcccatgtggtatagtaagaagagcactgaatttgaattctgaagctcaccagagtgttccactgactagtctcagggctactgtgagcacccagtgagagtggccatgagaggtgacacactgcacaagtcagggcactggaatcatgggacaagatgggaccttagagaatgtcttgtctgcctgcctcatttcatagtagagaaaatgaggccctgagaggtaaagttcttcactgaaggtcatacgccagctattagtagtgtagccagcaccagggtgtcctagcctttgcctccttctgtttctcactgtgccctccttccctacattgctctcttttgggatctgaggaatcatattcaatcacctttcattttcagaaatgaggaaacccaggcctcgtttgtccatggctacaaaactaattgatttatatttgctttggatgactaggagttaaaataatgacaggtgaaaaatccaagatggcgtttgtataccgcttttaagagcaatccacagcagattcaagttttgtgaggcctgaaactcatgcaatttgaaaacttttttcaagaaaaataacacacaattgcaaatgaaaagttaggttccaggccttggaagcagtctgcgcccatgaggggccctcattcacttcactataaatccacctccaggagcagtaataaagagatccctactcatgtttgtgctgctaggttcttctgtttgtataaatagcatgtgtcctgctaagtcacctccactcttataaaatggaggccattctgccaacacatgtgtattgaacatctctttatctgtaaggaatacagaagggaaccaagaaaggaaactaagctaccatctctaactcaggagatgaggcacaaaggcagaatggaggaattccctccctgctgtggtctgggccagggtgcctatgggagcccagcctctaggaggtctccagttttaatctcagataatcttcctcttgtagtcattcttctccctctgcctatcaaatgcagatgttgagatgagtaaaccctttggggtttttggatgaaaaacttttcaagatttacatgacatttttggggttgtgcctacccaaaaaagtcttatatctcacatcactgccttagaaatgaattaaaggtgcatttatccatcagggccacattcccctaaaatgcacctaatagcactgaaacaattagaataacacagggatcctgaataatccatgcctcttgtcaagaaatttttttctatttttatttttgtaaaacagcttccttatccagttgtgtttagtttatttaaacgatcacatcagcattaggttctggtttggggtttttttttttatttgtttgtttaagtctcgtttctgacactttctgaaagatgcaacatggagataggccaggagggaaactagttttagggtgttctcattacattcattttatgtcattttttattattaggtttacattattgaattcctgtggagaagaggagtcagagctgtgaataagtcataagtccctataggtaaaatcaagtactatttgtctctgatcaaaattgccctttccattgataggagaaatgactgggcctccttgtcatccagagttcattttgtttttcgtggcagtttcactgtctttgggaattgagctttttgaaatgttaaagcacgagaagcatgaacaccttggcagggtttgcagtatctccttctagtgcaggatggagggctccagagctggcaatttgaggaatggctggtggcttctgatgtcacctgccactcatgtgtccctccctgttttgaatcatggatctcaaacatcctcaaaagctcttccctggtaatttcaaaactctgaacaaatcaatcctaagaaaaaataaacaaacatgcagaagagcagaaggatatttaggatatggttctaattaaaatttttaagttttcctttttcaaaatcctgtatgagctattaaatagggaaaaacaaacttctgagtaggaaagaaataaaggccattacccttagagattttgaatcttacaataaacaaataggtcttcttttccccgaatgtttcttcttatcaacacaagggagttgagtgatggctacagctctaaaatactgaacatggctgcctactgaattcagcatacatacgtagggatatgttacataagatgcacatacatactttatttctattagcctgtgaaacagtgaacatgcctgctcttataaagcttctagtaaaggaactacaaaagaaacacatctactgggcattctcacactggctgaggtaggttggaaccatctggattcttgcctgtggcatagttaacctcgtgactatccagttttccaattatccaggcccatttacctctgctcccactcagcgagccctttggctatttctctgttcattggcacctaaagtcaaggagaaagaaacgaacatttattaagtgctatgtttgtaccagttaatcttctcaatgaagtattattatcacccctgttttacagagaaggaaactaatattcaaagaggtaagataacttgttcaggaccacatatgtttttaagtatagagctcatgcattataaagtgaccaccctagctaacatttattaagcacaatatttgccagaattcttgcaaaaagccttacaaggactattttattttatcctcataccaacggcttaaggatggtattacttaagtattcttgttttacagatgaggtcatacagctaaggtgatgaggccaatattcaaactcaagcatctggattgcaggctgcacttttgatcgccatgtctagcctcctctatacacctgctctgaccgatttggtattcaccacgcccaagaggctactgaacacctgaaatatggctggctggagttgtgatgtactctaagtataaactacacaccctatttggaagacagtatgcaaaaaagaatataaaaagtctctttggcaattctttatatcaattacatgttgaaatgataatttggatatattgggattaaaaattattaaatttaatttcactatttctttttactttttgaagtgagaagactagacaatttaaaattacaaatgtagttcatattctatttctatagaacagcactgctatatactattttaaaataatatataaaggggactagaactgactcaggccaacattatttttcatcaatagttctagttaaaaatttggttggaagtgggtggatgggaaggttgaagcccatttttaaagataagtttggtgtttttatgaatttgagttatgtgtgctttcttcacccgttttaccatgtgtgggtaagagacttgccatttttaagaatcagaagaattctgtgaggtgtatttccagtgtctgtgtgtagtgctgcagctgtctgagcgtattgccggaggcacctcctttggactttaaggcacgaattgctcatcactgtccacacagctttgtggccgcctttgagtctatctcttttaacataacattgagttctggctccaggtctggcacaaagttgataataactagtgaatactgttttgtttggtttgttgtagttttattctttttttttttttttgagacagagtctcactgtgtcgcccaggctggagtgcagtggcacagtctcggctcactgcagcctccgcctcctgggtgcaagtgattctcctgcctcagcctttcgagtaactgggactacaggcacacaccagcatgcctggataacttttttgtatttttattacagatggggtttcaccatgttggccaggctggtctcaaactcctgacctcaagtgatccacccgcttcggcctcccaaacttctgggattataggcatgagccaccggacccactttattcttaatacctattgccaggcagaggttacatggatataaaagagagaaattgggaatatttgtatgagatgggaaaccacaggccaggaaagcattaccaaagggttgtagaggatttagtctgggcccctccccaacgtacacaccacgtgccttctcctctcgaggctagaattaaccctcaccccaccaccagctgccaaaaaatagtagtagctgctgggaactcagaaacagaaaagaattttctatgagattactgtctaaaacaaatgtttattctagccatttataaagaacacttatggatttacagcagcttaggatagtgaaaaagaagtagaggaatggtaattaattcaggtacgaatttgtaaggccaagtgagaatcacgttccttgtcgtggcccaaaaggccttgtcagactcagatggagtctcctcattttagtctacagacatatgggtggaagtgacatgatggaataattacattcccaagccgtgtacccaaaatctgtgctaggaccactcccctggccagtgcggaaccaggtcagctggtggaaggggctctgaatgggcacagcgctgccaggccctgccactcccacctcatcccatccagaatgggtccaacacagttcctgctaacccttatccacacctcctcaaccatagtccccagtgacctgcttcctctgtgaagcccaggctgactggaaggtgaccctcaacagaaaccatcagagagctttgggtctggggcggagggtcacctccactctcacggtggtgtcttggtgttaatgtcatctgttggctcagccattcattgcttctctcttccctaagctcctgcagatctcctttactcgtttcttaagtgtaggaagctatctccttggatgctgggtcactaattataaacttcctatgcatttacctggctctggtttggcccctaatgtctttatttctgcctgcaggattgtcattgccattgccccttttccttacctgggaacccgacatactctgcttatcccttgagctggcacaccagggggcctggaattcctgttggtgaagtcactactttaagagaattatcccagaaatcctctaagttgcaaatcctacaggagcagagtactacatgttaattagcactcattatcatgttagtagagaagcttacccaaaggaatgatacataggacctgctatgtcattgagaacagagaggtggggctcaggttctggacaaatgatgtcataagtaagtgtagtttcagaaaggaagatgaagtgggagctttagataattggaggcggtaggcctgtatatggaaccagatgctagagagcccaagtccatatttttactttttcacagttttgtgtccatatcctcaccgaatcccaaccaccaccaccacagttctatatcccgttattttttcaataataactgatacctcaacttaagctccactctgaccctcagctaagccatataatttcagcaagaattataaaataaagtttttaaaggacaaacatgagccttaaccttagtataaagacatgcttagccttcatacaaattgccaagttgagacttcatttcagacggcaaataaaagttacatgaaggagctaaaagtgctattgcaaattacctatttgaaacggctttttcaaaacctgctaaattcacacctctcctaaaaatgcttcacttccagattattttattttggggttttgtgtgtatgtgttagagggggtggggtttgtggtgactacagaaaaattagttaaattcataggataaaatttgaacttttgcaaatgagtaaacagccaaaacaaacaccgcttcagaaaaaaaaaaaaatacacgttttctccttttgaaaagcaagcaatgcttaagcaaaataccttaaaagttaactaaaaagcttttctaaaataaacaactctgcttgtgatcctaaattgggaccacatgtagatgtgaaagctacaaatgcagtgcactcagaatttgcgtctctgccttcactgtttgcgtgcctctgagtagatgatgataatgttggctttggtccccaaggagcctgagttttttagatcctagtatgagggggaaaagcagaagaagaaagagaaggaatgaaaacaaatgcctttcaagacaaaatatccgaatgggtttcattttgcttatctgccaacaggctcaacccaatttagatctctcctacaaggacaggatagtgccagccagggtgtctgcccttgccggctatgtggggcagtccctgtgagggaccaggctcgaattcagagcagaaggatcactctagcaaactgccagggccagccctctgccctgaggcaagtcaatgaattagccaattcagcacagatagaatcattcctttgttttcctcaattaccaaatgctgtgtgctttgggggtcacttgtcatgtgagtttagagaatgtggatattgcaacataaaccctcaccattctaaacagcttaaactaaattctgttactggggaggagagctgaggtgataatatccatctctaagtataaactattgtgtgttcattttcccattatgggagacaaatttctcttctccgctagtgctcatgatctcttccaccaggcacaaacatcagatgtgtgtttatgtggacatattttgtcccctattattggagagcaagctccttgagagaagggattatgctgcctggatttgtaactttgttaggcaaagcatgactttatttagttttgaattgatgaggaggcactgatgttagtaaaaagctcaaatgtcctgagccctgttgctcaatacctcaaacacaggaccatgatcaccacaatgaaaaatatgcaggatcattaatttcggctctgttaattgtgctgttaggaaatgttgactagataggaaaagcagctaacgttcatggagtgcttattacataccaggtactgaggtaagcattttacatacagtatccgatttgtatcctcccacaagcatgttatccccgggttaaaaggggaggaattggggtccagtgagattgggaggttatgagaatcccacagtgtgtggcagaatgtggacttgaactcagggccctaacaacaggaagctataaaagcctctttgtataaaaagtgctctctttctgtgggtcctcagtaaatgaaaatatttgcttttcataaataggtttgaatgttgggaccctcatttctcaccaggagtcaaggccaaaaggtcttataaataagagtgaattttgagaaaggatgtgtgaaaatgactctgttcttttcttttatctcacttcagttacttgggatggaggaagcagaaactgggagtcagacatctaaaatatgaagttccaccctcatgttggccatttctttcagcctcctttccccattcctaggggccaatctgtttctccctctcctgctctttctctttgcctctgtcttcttctttcctgtggagacaatagcgtgtggtggaactgcctgagtgcttactgagaaggagaaaccaagcgcagattgtacagaagctgacgaatgagtcctctgattgtggacaagtgatggcgctttttgtaaaattgtgtatgtgtttacctcaagtagtgaaaaaaaaaaaagaaaaaacaacttttggggcaagttggaccttaggaaggagatttctgggtctcggggtttctcttagcccccagtgcctggtgcctgcggccggtgtcgcctcagggagtcccaggctgttctgtggcctccagaaggagccaccccgccccttcctcgccccactccgctttgccttcccttagcctggggagccttgccgcctctccaccttctctcctggtctcctcgggcgctctcgcgctggcaccttcagctctgtcagagtctgaggggaaaccaaaggaggccaggcggtgtctggaatgccccatccgactgcttcaggctcccagaccgctgacaaaaggaaaactggtccgtcgctttctgaatgatgtatcgagaccgcagtgtatttttagcatctgctgtttgtggtaacataagtgaaaactgctggacccgttcccttcagctgaatggctggtattcaggggcctgtgcccgctccctgccagacgctcctcacagaactccctttttacgaggtgggcgactggctccctggcaccaggctgccccaccacaattctttattgcccagcgccagtgcccaattgcatgaatccccagggctgcaggcagcgtgaggggtgcgaatgggacgatgctggctgcgggcttgtcagggtgttcccaagttgtgtggcagagtctggagggcaggggttgtccggatgttccaaacctccagcgtgaggtgggcactcaggtgcgaaggaaccatggtggcgaggcccacaggtggcgtcccatcccagagccattttgccggggcctggctctgcagtagtcactgacaccggagatcccctgagtgacctggaaactatgagagaccccaggtaccccgacaggtcattctactaactgtggctgtggagctccagctcatctttggaagacggaaacgcactggaaagggtatgaatggacgcagaaggcctcgtgggggctctctcagtgccactgtagagtgaacacagggctggaatccaaaatagcaccaacttgctgagtggctttaggcaagaaacctttccccaggtctcactttctcacttagaatgatgaatagtgattcttgtcctactgacctcactaggacgtttttaataaggatgaaagcactttgaaactgttgaaaccataacatcacaaaaaaaaaaaaaaaaaaaagagagagagtgacgaagtaacgcaggtcccatttatgttcttaatttctgaccaaccttaacttccatcaaaactgcttccactagccccagccaggagagccgttgcatcgtggtgggacatcatcaggctctccaacggacatcgcttatactatgagaactcacgttcaagggaggtgtttacctctaattcccacagaactagcgtaagtaaaaaatggggcagcaggatcctttccttgcaaagtgtgagcaagtgcctctgtagagtaaaactttaagtaaaaggactacaacggcagtgacagctcctttatctgaaactgcagacttttaagaaggttcttagcagccacaccgatgtcacaaattccataaagcaagatcacctaggcactctctcggagctaattttatctcattttatatataattttaataagcctggctctctcattttctagccccttattactgaaaatgtggctcatgggccagcagcatctgcactatctgggagcttgtgaggaatgcagaatctcaggccccacccttcaccttgaatcagaatccacatttggataagatccccgtgtgtgtgtgtgtgtgtgtgtgtgtgtgtgtgtgtgtgtgtgtgttgtgcgggggagggtaaaattagaagagacttgcagggcctaggcgcactctcaatttattgtatttcattatggaaaggatttgggatgactagaattaataacttagaaggagtgaggtgacaaagaacattaaaaactattgcatctgggaccatttaatataggtttgtttgtttgtttgttttgagacggagtctcactttgccgcccaggctggagtgcagtggcatgatctcggttcactgcaacctctactccccaagttcaagtgattctcctgcctcagcctcctgagtagttgggattacaggcgcctgcctgtaattgtatttttagtagaaatggggtttcaccatcttggccaggctggtcttgaactcctaaccttgtgatccacccgcctctgcctcccaaagtgctggcattataggtgtgagccaccgcacccggcccatttaatatagttttatatccgaatgccctttaatactctgagaatacactgttacaacactgtatagtcattgatattcccagtaatagtcccaaattatcaagaacaggcaaagtcatattctcctgctgtttaaagtatttacctaatgttcatagtggaaaattctcctttaaaatggttaaataaatcttgatcttaaaccgatgcttcagtgatctgaatactacatgaaacagcacgttctctctaaagagataagtgagatggtactataatcggaaacctctgttaattcggattttgttttttatgcacattttagagagtcaaattatatcaagataaaatatgataacagagatttactctaaaattaaacaatgaaaaaaaccctaccagtgcaacaaaaaggccatggctgttcagagccaagtaaaactttgggggtcagaaggtatttaattttcatatttctgtttactaggtactaacaactgatcttcaaaatcatagagacaggaaaatggatttgaaacccaagggagtttttaagtaaccagaaaagttagtgccctcttctggacaagcgatcattggagttgttagaggttgtccttgggagtgctgttgggggctttgttaacaccgaacaagaccatgagtggcaaaacttggagctgaggttgatcaggtctccaaggccagggagagactcaaaccaaccaggtcaacttcccagctgaattgccaacctcaaagggatacgtacagaagggagaattggaggcacatagcagagggtgagaatgcagagaagagcaggatgcggtcaaaagattggcagatttttatggagggttccagcacaggccaagaaagagatttaagggttctgactcaaataagaccaactgtccttctttctcattcccttgacaattacatctgagtgcaactttattgccatggcaatacaaagaaagtctaccaatgatttgatatctagagcttagaaataaacagctgcatggtaccaattttattatataaagcaaagtttatataaacgcaactgggcttaaaactcatttggcaagaattaaatattttccatttattctagagacatttttagagtgccatggctgtggtggaaacataaataaagcatcatcacaggacaggattaattaattgcctgaaataatttcaaagctgtaagtgaaagatcctatctttattaatggtattcttttctcaaatcagattttgaaacctcacaagcttttgactcatctctctcctgtgcactgctagaaatcttatttaactcatgttgcagccaccctaattccaatccttgtcacttcactcctgagtttcagcaacactcttagagaagaacttcttaatttctctccaacctagctttgtacaatggtctgttctctataccaccatctattgtctatactacaatacattatgttgggaatatatcttattatgtactactggcttattgtgttagtcatgggtaaccaactagaatgaagaacgaactagagaacaggaactatgtctttcacatttatgtcgtctatagcacctaacgtaattattgctacacagtatgttgctacagggagtcttccgtggcctagatctgggctagatacttctcctctacacaactgtgacacactgccgtatcctggttacattatcagtgcattacaactggctgtattacgtttgtttctttttgtttctctatgaactatgagagcagagcctacatttatctggttcatcactgaccctctagtacctagcccaggttttgattatatattatgtgctcaatgcatatttttagattatttgttgttggttagtgcagtaagatagttaaggaggctgggatgaatagaccaaatggcatccatagcatcatattattttgtttgacttggcttcaggtacaatagatcaatataacctaaatattataatgaaccagataactgcatttggccctttgcaactgtataatattaaaattattatattttctatacctgtttaattgtctataaaattctagctcctggagtgcaaaggacagcattttttacttctgcatatctccctcagttcctacctcagtgagtgtttcttgatctgacatcattaaatgcagtttaaaaagagtctgtgttctaatctgtctgcttagtgctaaacatctgttgcttcctaacaagtgctgcattcattttaatggcactggtgcacagaggtaaacggagctttggcaggccttccataagagaaactgtttgcttccttcattaattactaatggagcattaagacacgcattctgccttgagccaagttggataattcctggcacttaatgctagggtgctttcaaaagttgagacatgtactgacacaccagagagcctgccctatagcaagcacagtggtgtctatagtgccaacattatataaagcttcaaatatatcaataccaagtgtactgatatgtctaacctttgcatctattgggttaatgtggaatcataggtatccctacactagctctgaaggtagctatcacaaatgagctggatgaatcatcagaaagatacagaaaggttaaaaataaaaggataatcaaagatttacccattaaacacaaatcaacagagtgagagtggcaagctaatagaactataaatcaacatctgatttatcaatttatatttagcagccaattgccaacacaattaaaatgaaacatttatacccttggatatgctaactagtacagcatcaaaatgataaaaacagtaagaaataagagaatgacagtcacttattgttagtagtagattttaacatatagccatcagattacgatagactagagataaaatatgaatatggatataaaaagaatataattataaatgttgataaattggctatatttagatgtttatgggttatataaaataccttatattacatattcacatggaaattttacaaaaataatatggtagtttacaaaagaaatagcattttttttaaatgcagatattttacagtttctctcattacaaagcagtgacctagatctgggctagatacttctcatcattctcattacaaagcaatgaaatataatataaatgtaaacaaaacaagcgaacaaccactcgatgttgcctgaatgcgggggctagaggaatcagcagaggtaagattgtccttttaaggttaaactttaatcaacacagcacacaaagccagagtgatgcaatgtcacttcagagagaaaatatgatccccaggacactgagatctagtcatgattctactgaatatattaacatttccaatgggggaaaaaagtgtgaatccaacgaagagctggctcagccaaaacaaacaaaggcaagtgctagtgttcatccagggacaagggagcctcattcaactagacttaactaatccagcctgtggcaggatcctccttcatgagaagatggaagcatggtgttgtttttgcctggttttgctcaaatgtcatgcacaccaaggcaccttttgattgtaaaccagcctttcctgtattggtctgcgtacaccatgattgtcccttaggggagctgtgagtgtggggctcctctgtcctcatggagttggtaagtatgaaatccttctaagaaatgatctgctgtggtcctggaaaaggaagcttcatgagccttatagaatgttaaggctacaaggaaagaaagtccagaaattaacatgcattggtatgttaacttggtaacttagtaaaacaagttatggagtagaagttgttcttattcactgctgtgttttggtgctcagagtaggttttcgtatgtatgagacacttaagtatttggtagagacatgaaacaagtaggaaaggacagaattatttagcaaatgctggtgggataattgattaactgtttgacatacactaaaataaataacatggattaaagagttaacttacaaatagaaaattaaaagaatgatccaaatgtcagtagtacttctgaaggggcaacgattttgtgcatttagaaggataagaagaaatcacaaggggaataaaaatgacaaatctgactacataaatattaaaaacgtatgttagcaaaatactataatagtaaccagaattcaaactcagacaacatgggaaaatattttcagaaaatgcgacagccaaaggccttgcatctttattatgtaaaatgttcatacaaattgataagaaaaacactgaaattccaagagcataaacaaacagctcacataaaagaaattaaaattagtaaatatatgggaagatatttgacccagctggtaatcaaagacattcaaaataaaacagtaattttaaaaaatttgaattagcaaagaaaatctaaaaattgattttcataaaacccaatgcttgtgagaatgttgcaaaagttgtatttcatattttgctgctgatggcttataaattggtacctcgtttttggaaaacagtttggcaatacaatatcaagagtcattaaaatgttttatagcctttgacctagtaatttgacttctgggaatctatcctgaggaaaattaatccaaaatatggaaaacattaaatgtctaaaatgaattgggaaacactaaatgtctcacaataggggattggttaatatgttgtagtacagccattggactaaaaactacatagccatttataattacaggaatagagaccatgcagccaaatggaaagatgcttgtgcttcaatattaaatagaaatgaatatatacttagtataaaaagatacgtagcaacaattggagtcagtacaccaaattttaagtggttgagctaaaatagcaggataacagtgaccttatcttttttcataatgtgctttcagcctgtatttctggatggcaattgccttcctttcttgacccaagtcctgcccaagctccacgcccagcttccagagccctacccatctgtgttgatgccacttagtttccagcttttccaagaagccctcccatcccatcagccaaatggaactctccctttcccatgctctttttttttttctttttttgagacagagttttgctctgtcactcaggctggagtgcagtggcatgatcttggctcactgcaacctccacttctcgggttcaagtgattctcctgcctcagcctcttgagtagctgggattacaggcacctgccaccatgcctggctagtttttgtatttttgttttttagtagagccggggtttcattatgttggccaggctggtcttgcacttagacctcaggtgattcgcctacctcggcttcgcaaagtgctgcaatgacaggcatgagccaccaggcctggcccctttcccatgctcttgtgatgctgtattaacatttcttttacaggataatatacagtttgccttgtatggaaataatatgtgtacagtatgtgtctgtttctgcaactaaatttctaaacccctagagggcaagaaccatttcatttatttttctctccccacagcagaaggcacagggcttttcctgtgtgatatgcctgaataaatattggttgaaattaattgaattgcactgcaatgaactacttctgattccctcgcaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacaggtaacagatatgcctttgggttcccatgaaaagttggggctttggaaggaaatcagaaattctaacatcagctacaaatattcccagaaattgttatttccattctgatgagcccatgtgtatttgtaagtagatgggaaggggaaatttattctagaatttttatatgagctctgtgttcagacacacccacataggattttcccttgccaaggctttactttctttctgtgtctccccttctttgggaattgatgcacttttctgcacttgctactctttttttttttttttttgagacaaagtctcgctgtgtcacccaggctggagtgcagtggtgtgatcttggtgcactgcacgctccgcctcccaggttcatgccattctcctgcctcagcctcccgagtagctgggactacaggcgcctgccaccactcctggctaatttttttttgtatttttagtagagacggggattcagcgtgttagccaggatggtctcaatctcctgacctcatgatccaccctcctcggcctcccaaagtgctgggattacagtcgtgagccactgcgcccggcctgcacttgctactcttttaatgaaaggggaaacacttttttttccttttccatgatacaacttctgctgagttttaatgtctttggaactagttagtttgtggattatccatgcctgtttgttctcctcgttgatcatgacagtcaacattctaacagtgtcatgcatcaacaccgagttagcatctatcctaaaatcctgtttatttgggggccaggaggtggcatgggagagaagaggttcaggaagaagctggttaaggaagaaggttgaaattttccatgttgttcatgcatcccacccactttcctacccactaatgccatagagaatggtgagtgggcttcacttacatccggctttgagcagctgaccttggtggttaagagtagtggctctagactctgactacctgagttcaaactccaggtcaacctgtgtgaccttaaacaagttaattaaccacttcgtacctcaatttccttatttgcaaaatggaggtcattgtgggaattaaataaaattatccatgtaaagcattttagcacagcacctagcacagagtaaggactctttaaatgtcatcctgattataattagctttgctgcccctagtaaataatgcacctcttaccttgggcttgtgttagcttctagcaccagagtagtcttttcctgcaagcctaataataataatagttggtatttatcaggttggtgcaaaagtaattgcactttttactattgctttcaataggaaaaactgcaatacttttgcaccaatctaatattatttctactttatattaagaaaacagaagcttagagagtagcttgcataaggttatccaggtaacaagtagctgaaccaagactcaaacccaagtctacctgattaaggactgtgtactcaaccaccaggacatactgccttgctctgaaaattgtgataacattgactactcaactttttttctttttctttttcttttttttttttttttgagatagggtcttactttgttgcccaggtgggagtgtagtggcacaattatagtaattctgtgcctcagccttccaagtagctgggacaacaggtgtgtgccaccatgcccagctaatttttaaattttttgtagaggtggggtctcattatgttgcccaggctaaactcaaacttcagagctcaaacgatcctcccaccttggccttccaaggtgctgggattatgggtgtgagctaccacaccgagacttttttttcttatgatacccataactagtctgacatcagcttttcttaaacacaatgcaggctgtctctgaaagagactgtcttagaaaatatgctcctcctttcatttaggatgaggcctctgttttccgtggggcacaaagcttccatcttgaggcagaacaaccaaagtagttggatgtgaccaagccaatgtgtggctgctgggccaggaaggcaggaaaacctgaatccctgcctggctctaatcatttcagccaccttctacttgtttgtagggttttggatgggtaggaagaaagactagttcagagtttagagagcgacagtctccattgttaagtccattggatgtggtacagtgcagtggttcttaaagtgtgattccaggaccaccagcagcagcagcacctgaaaacttgctaaaaatgcaacttctcagtccctaccctgattcaacctattgaatcagaagattctgggggtgggacccaggaatttgttgcaaccagtcctcctcatggttctagtgcacactgaacttagagaatattataggagaatggaaagaggtccagagtttgagccaagagatctgacctctagtgttgactgtagtatgccactttcactttcttgagccttaatgtcttcacctatggaaggaagacataggcaatgcctccaaagagcatacagtgtagttctagcttgtctgaaaacaaaaacaataaaaacacaaaatcatacagacctgtggaatcaagctctagtctgtgcacttaggagctctgagaggacagcaatcaagctggcctggtagaattggacaaaatcccaaatccagacactttcttgtcacaggttgtctgccatttcctttgctgttcttccatgaaactaacatattccctcattctttgttctgccacaatctgcattccaagaatgaaatcgcttgctaaatttagccattatttgtgaggaattgcttgaattatgacacaacacagcacagttgagcaatccaagaataaaaccttgatttctcctttcatgccatgctgtcctctgaatcatggcccactcaccctggatagagcagcagagctcaaagagtccatctcagcctcagagataggatgtgaattctagggcacatttttaagcccggagacaccttcggttcccagagcaggctttatctgcatctcagtcagggcccactcagaggtacaccagaaacaattatgaaaggttataaaggtgccatatgcagattgcctgaactctcttgaattggtatattttcctacatgttaattgctatatattgtgtaagttagataaatagctcactgaaaagtggagagccgcattagggatttgttcagaatgctgatgacttccacactagctgtatactgctaagagctgagagactgtgtactgaaagcttaagagcagtgtcaagaactagacaacctggctaattgtaaatggcccccctttcagcattgactttgatgtctcattatgtctttcaaatgagaccctccttcctccccctaaccctgcacaaaattcacaatccctcctctgtccccctttttattgctgttgtctaaaatatattagacatgggaaaaatgactcatttttagagcatcatgcctagtaataatagaatttacataaaagcagcatctgagagagatagccttctttctttggtttgaatggaaaacttgcttgatttcaaagggaagtcatagtataaactgtcagtcaaagggagataatgggaagggaactaaaacatattgcaaacctattatgtgccgggtgttctaaatgtaatcatctctattcctcacagcaatcccgtaggtaagtatttgattatttgcatctcacacatacatgaacaaacttggagagaccaagttaactttccaaaggaactaagcctatctatatcttaggagctgggatttgatccttgagctctgctcttgtctgactccaaagcttaagctgttatcacaataaaacacaacatcaagtgctgtgtggagattgttgttgttgtgtaatgtactttctccaagaagccaaagtagtttctaaactgcttgctcaggagaaaacagagtgggtcatgtgcaacagaagtatgttacctaaggaaacacttgctcttgtaacaaataaaaacattgtatggctcaacgcaatagaagtttatttttcacccgtgtgaagtcctgccagaggcgcgtgaggctgtagtgcggtggatggttcggcaccccagactgccatctttacacttgacccccacagttgccctggcaacatgtaacaagctgaccaggagatgggggtggggaatgaggagaagtggagcatggtatgagaggtttttatgcttttaggtgatgtatttcaattccaggcctgggaatggaatacattacttgtgcccacattctgttggcctccactcaggcaaatgactccacgtgattgcaaagcaaggctgggaaattagtctagctgggtgctaaggaggaaagggaagtgggtttggtgaacagccagtgagtctctgcacaggagtgggagtttgagatgagtaatcctatctaactggatcctagagggaaggtggctgctagtgttctaagttactactgatgtgaacagattctgacctttggctgcctagttgtttttgataaattaactcttagaataatgatgaatgtcttggccgttcctcaaaaacctttggctgtttgcagcagatgatggatgtctagaaaacacccctgacactgcagagttcagtcgagagttccagttgcaccagcatctctttgatccggaacatgactatccaggcttgggcaagtgggtaagtcctatctcaattgttagtagattttgcactttggtactctgaaggtgctgatggcagggatgagcaatatgggcagaaggagagaagaaaaattatttagaagctaatttttcagaaatctctggttgacagagcttcaagtcatgactactcaaaaccacacttatgtgtccaggcagcactataccaaatccaactaaagagacagcaacctaacattgaccgtagtctccagagtcttctactctggtctgcttcacagcctgtgtcatacacatcctaaatttcaccagtgtttcatgcatctctatagggttttatcaaaggatatgattttttttaattgacacagaaaatttgcaaatgtgatctctaaactaagggagatgatctctgcagaatcaagggaataaagatgccagagcttagaaacagatatatataattctgctttatagaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggatatgtctgtgtttctgtggttgggccagatgctgaagccatgggagaaaagtggggaaatacctaggagtgttccttcacatgtaacagtaggtggccagtacgtctgtggaatgaatgagtgagtgaatgagcaaatattccaactccctcagcccttctaaagtcctcatctcttcttagctcattattggcagatggccttgcttactgctttactgggaacactgaaatttcaaaactaaactccctcctttcctcctacattgttttagagaaatcttcattaatgaccacttttatttttttcagcgtcttgctttaacatgcattgtcagttccctctgtcttcaacgtacacacatttcctgtcttaaaacaacaaagcaacaacattcctaagttaattttgcttcttccaatttgcattattccatttccttctttttcataaacagttctgtttggaagaattggtttgtggagccactttcaagcctagtagtagagcttaaacatgttgaattaaatagaaaaacatctataggttctcgaataggagactgaaataataaaagccttctataaaagaagttattttgatggcatattaaaggatgaagtaaaaggagaagagactaaccctagacaggaagaaaatatggggagtcatttcagttatgatgactgtgaacaccgtgaagaagggtgagaatccaagacattttaaagggggaaaaactaactagaattggtatacggaataaatataacatgaagaagaaagaagagatatgtcaggttcatatgaaatggacaatatgaactttttctttgaatgcattttagaaagaaagaaaagagaagaatagagggaggaaggacataaaaaagagaagagagagtgagggaaagagtagattgcggaggagtactgggaagagatccacaagaggtgatcgaagcattgccaaacagaagcaaaagccaggttcgataaggcacaaagagaacacattgagcctgctgtgttccaggcactgtgctagatgctcagtatgcaggagtcatcaggacatggtgctggtcttcagagagcttatagtcccacggttgagatgaattgcatgaaaatgaaatgaacccaacttagcaccgctccacttcatgtttcgtctgtattctgagggccaggggcaattattagggaagatggaagacaagggtagaggaagatccagaactgaggactggtgtggctgattggggtagtagccacagaggaagtcaaaggcactaaggagggcagcactgaagtttcaggtgggaaagtcttcagcttcaccagtaggctaggaatgagagaaagaaagagggagactgagtcaaggtgtgagtgaaggcaaggagcccagttggtggcatgatgaggtgggagggatgaaaacatctcttttcagctctcttcatctcttcttgaaaatcttcacagatttctctcatcaaattccactcacttccagtgccccagtatgaggccaaccacggtccttcattctctgtgcttccttctcgaaacactgacttgagtttctctcagtgtttcctattctttgtccacattagagctaaagactagaatctaggatcaaatgtaaaaggaaaatattagagatcaatgaccaggaacaatgtttagataccttttatcatctgcaattatgtgtttacttaaacttaggtctccttgtttattttctcattactacctaccagtaaaacattgtttccttggttttcacatggaagtgggaattgagtatgtcttgcttttctaaactgggaaccacaaaccttcctcagtgcttatatggaatgacagtctcaagcttgtcttcagcccagccatcctttaagttaacagagtcatcatctttcatgatagaacagcacaaagaccctgcttccttatctgctaataacgcttccttgtttttgacagtagctggagctgagctgcatctttaacagtgattcacatattacacatttcagtgtctgtcttgtttcctgcatttctctcttcgttagtgcatcaagacacatttattaacgacacatcatatgccttccgggccccgtgttaggtaatgggaatacaaagatgaatgataatagtaattgtattacataatacataatactatataatacaatagtaaatagtaatatttattgaccacatactatatgccagactcctttctaaatactcagtaatcttattcaatctgcccatccttgtcattctcactttccagatgagaaaatgcaggcttggggagctgaggagcctgctcagcccacagagctgggatttgaaccccatcatctgactccagagtactttacaagctgaatacattccctatcttttcatggctcattgctcctaacctgtcctgtgtggtagtcctattgagtcctaccgagggctggctgccttccagacaatgtgtgtgactacaccagtggtgaccacaccaatggctggctcctgtacatgccagctacccactccccctttacacattaactgctgagtgttatttacttaagaaaaagttgtctcaaaaagcaaatatttttcctttccaaatgctttcacaccttttcatcagtagctgatcacagccagagcctgagccacggggatatgagggaccagacccctccctgacttgctttgtcattcctgaccttaacatgtttgatgagttgaatgctcttcaatgtggatttgactcaggtttccatgtgattagacctgcttagtattttatgtcctacttagtattttacatcagcaagcacatgatgtcagggaagtttgtctcatgactggcagtgttcactttgttaaggtgctgccctccaggtttctctggtgtaaaattcccttagaaattaataggccgggcacagtggctcacacctgtaatcccagcactttgggaggccgaggcaggcggatcatgaggtcaggagatcgagaccatcctggctaacacagtgaaaccccgtctctactaaaaatacaaaaaaattagccgggcgcggtggcgggtgcctgtagtcccagctacttgggaggctgaggcaggagaatggcgtgaacccgggaggcggagcttgcagcgagccgagatagtgccactgcagtccggcctgggcaaaagagcaagactccgtctcaaaaaaaaaaagaaaaaaaaaaagaaattaatagttactctgtgggaagaagttttggggctgtgtaaatattctgctcctcgttcaacttttaaccaacaaatataacatccattgatgatgcttaccagattcaataatgatgatagctgcaaaatgatgattttcttactccgctattctttctgcatttactagttgacattctattctaagcaagagtttcccctgctgttctatttatttatttatttataaatgtgtttatttatatagtataagtatggattcatggattccataatgcatattattatgtattctggtgttcaaactgtcctaaatttggccagtgcgagtctcctcaagctttcttttctttccttttgacaggacctcatcatttttttgagcacttctttattttctgacctaattagctattccatcttcacccatccttgcactttccttcctagccctggaattagacttttctccaggaagctccctggctgtatttaggagtgtaatttgaaaccaggatctggacagttgtccaaaatcttgatggcactatggaaagcccttttaatgaacttgaacctgctactcacatggaaaacaggctcaccactccccaaggaatcaacaaggaatgggcgtgaggagagatagctgatttcttttcattcaatttgtatgcttctcttacccataccatacctgccaatgccttcaagtccatacaataatagggctaattaagaatgtcccagacactttcatgcaggggtagggaagcattatcctgctaatcctaaccctagctcttaaggagacacagggaccatctttgagaggaagattagccaggccttttgcatttcttttttttttttttttttgagacggagtctcgctctgtcccccaggctggagtgcagtggcgcaatctcagctcactgcaagctctgcctcctgggttcatgccattctcctgcctcagcctcctgagtagctgggactacaggcgcccgccaccacgcccggctaattttttgtagttttagtagagacggggtttcaccgtgttagccgggatggtctcgatctcctgacctcgtgatcctcccacctcggcctcccaaagtgctggggcacatttctttttgaatgaagactcttatgggtaggatctgcccccaagatctcctaaagaattaaatgatgctggctttacctggctgatggcacagtggaactctgccagagctggctgacagtcccaccccatggtagtagctctcaggttcttccacactccatccagctcaggcagctgaaaacaatggtacacatgaagaagacatgtcctcaccccttcccggccttcccagctctaacaccagctcttcggatattctctgcctcaggagtttttacgttcacagaaaggcaaccacagactgtagagaatgagcctcacagcaatatcctcattcctcaaggaaatgatctgcaagtctgccttttctcccttccgatattaaattgatttattccccaagtgagcaggagatagaggctgtagccagtactggtgtttttggtagtagaggctccttcactctggcaccgcctccttgcatagttgaggttgggcaagagatatgcattgtaaattgcaggtggggtagattttaatgaacgtgaaaaatgatgaagctcattcttggcatttgtcattttcaattccaaatctatcactaaaaataagtctttataagtggacagctcagaggatacatgttgtataaacttgttccttaccagaactctgtggttgtctttgttttttttttttcttaatgtcagagtattttatttagaacaaaacgaatcacctcttttatacatcattttcctccagataaaaaaaatcaaataaataaaacaacacaagtaaagcccccccccaccgccaccaaatccccttctccctttctgccttcaggttaagtgttctgtcttttataatctcaatagaagggaaatctgttgagcatgtgtctgatattctagagctcattgaagcccactatgtgtttgaaatacagcaatgtgtggaaacacttacacaaactgtggtaacagagccctgccccccgacccaacataactttcctttctgccaagaagttttttggcagtttttaaaaggttcactctattaaaaatgttatagaccaaatggttttccaattgtcttgactgggggcactgacttaacgccacagacaaaatggttgcagaagtcagaatgtctcgtttatttacacaggggattgttgttaatagtcagacgctactctagagagcagtttataaaaagggagttagatacaaaaataaatgagataaaatcatttgttttaaacaaaggctgttcaaagtgaggagatgggtttccagcacccttcatgttttaaaatgtcgtatttccctgtttatgtgattgttgatgacactggtgtgcctcagggcattgcagaggactttattaaaagccgaaccaccaccagctttactcttgtggtctatctttctgacacgacattcctttcatctagttttgtttccaaaatatgcgtatgcaaatatctaggggacacaccaagtattgcttttaaaatagacattcaccaaatttgatccatacttctgcattttttgttttcttttctccccattctagaacaagaaactcctttacgagaagatgaagggaggagagagacgaaagcggagggtaacacgtgcctggctggattgttgcggggatgcttggagctttctgagtggggcagtgaacaggctgaaaccctcgcttgttgggaagtcacagaatcctcccttgtgtagtcctgagaaacactggtccatgtgacaagggccacacccagaaagtctgtccttggtttctgcgatggcttccccaggctttagcagatgatttttagtggaacgcgcagtctgtagcgattctagcaactccattccgttcaggaaatgtgtattgcttcccccatcagtgtgggacatatctggggggacatgagggtctgtctgccctcccagggtctgtaggccagtggggaaaaactgatcacacatctgcatcaattctataaaaacacaggacagaaacagggaagtgctgaactgcatgctccaggaaataactttgaaggaattcgggagcaaaagatgagatgaacaaacttaatttctcctatgtatctttttttcttggcctagccagactgatgtaaaatctactagatctgtaatatttgtttgctgtctgttgaatttactgcaggcttagtttttaaccatcccagggctgcccaaggtaggaacttggtctagatactccacatttagctacttcatatacagtgttgcctcacgtaaaactcaatgtcacatttgctttggctttccagggtattttatagcatcaagacttgataagtgatcaaggtccattctgctaatccactggtaccttactagtcagaagggcctggccacctacctccttctttatctgatcagatgaaagtgggagaaaaaacaaccccactgttacatggtaaaatgctatgagatagtgaccattttagttaaaacatacaaacctaagcacgtactcaaagccactgactatttattcagaagagcaagtgcctggatcctcacaaaatttgggaatctgggcagtggtaattgtggccattctgaagggttttgccaaatccggtcagagagagcttcaagaggtgtggattttctggcctcagcatcagtcctcaggcccccacaacagaaggttccaagcccctgtactgcctgacaaaacacagaagacatacagcaattttctacgcgagaagtagaaaatttttacctctggaaacaaatcttttttgaggagagttaacagagttattaggggtttttcttggtgattacagcttccaatagcagatggtgacagaaagggtccaaagggtataatgtggtcttgagggaacatcaagaaattctattctaggaactcaaaatacacataatttaccagtaacacggcttgaatatctccctacaacacaacaagaacatttccaaataagagcaatgactgacccaaaatcaataacttagcttgaaactttaattgtctctacttcctggcccaccattccttctgccctgactcagtgaatgaccatggtcacgatttaggtcatttttccgtgagactagtgattaccaaaactcagaatgctggctaagacacatgctataaaggattttactttagcctcaatttcctccacataggaaaggcttagaatttaggaaaagaagggtcactttgacccagagatatcaagttcttcctgttcttgggcatctacaaagacccattctcatgccataaaccatgggcctctctggattgataaggaagcacgttggccctgcccatcatgaggtctcagatgatgttcccatcttgattaaagacattaacactgccccaccaccacccccagtacatgaatcaatataaagaaactatacgctttcttttttgaacaatgaagtcttccttcagtgaagctcagcatctgctgtgagtttccagaggacattgtaagcaaagatccaatcccagtggttcttccagttgtgaaatgggaatcatgttctctgtgtgccctacccaatctcttgcccaagtgagagaagacaaatatagaagtgccttgagtttttcagagcacaattaaagccaaggctcagctaggcatggtggctcacgcctgtaatcccagcactttgggaggccgaggagggtggatcacctgaggtcagtagttcaagaccagcctggccaacatggtgaaaccccatctctactaaaagtacaaaaattagccgggcgtggtggtatgctcctgttatctcaggtactcgggaggctgaggcaggagaatcgtttgaacctgggaggtggagtttgcagtgagccgagatcataccactgcactccagcctgggtaatggagtgagactccatctcaaaacaaagcaaaacaaaacaaaaacaaacccaaagctcattattattattcctaagtgctggattcaatactcagttaaatatttatcaaaaaagttcacctgattcctctttttacctcctcattaatttttcccctcccctccaacctttgcatgttgtaggtctgggcaggacttctcccatgagagatagattctcctcaaagttgcaaccaagccccatatggctttgaacaactttttgtactcacccaaatccaattgaattcctcattgcttcacaaatgaaatgtcaatctacctttaaatgactgtgaacttttaaactcttaagctgtatcttgttaatatttgagctctactattgatcttatttaaacagtttatgaaccttttaatctcatatttgataaacttgaacctctcatatcctcctttaacatattagaatttttggaataaatattactaaacaaaattctgatatgatcccctggggtaggccaaaccactgtaattgataaaaggaatttttattattttaaatatttctaagatgaattctcagcaaggtgttgtcttgtggcatgtcacttttcaaatgtctgaggacattgctcactttgtaattctcacctactttgtgatgcatctttgtagagtgagtcggacctttcacgattcatgcgtttagcagtcagaatgtgaaagaacatttgtaaatgctaaactcaggtttcattccttctcttttgaagaatgtctgctcacctttcaagagtcatggcaggttatttcatgggcaagagagctccacctgtgaacagactccattcatacatggggattgagcatgcaacagggattgctgatcgtttgtaactacagcttctttctttcttttttttttttttcttttttgagatggagtctcgctctgtcgcccaggctggactgcagtggcgcaatctcggctcactgcaagctccgcctcccaggttcctgccattctcctgcctcaacctcccaagtagctgggactacaggggcccaccaccacgactggctaattttttgtatttttagtagagacggggtttcaccgtgttagccaggatggtctcgatctcctgaccttgtgatccgcccacctaggcctcccaaagtgctgggattacaggcgtgagccaccgcgcctggctacagcttctttcttatatttttgttccattattggaaggcaacttcaatgaacaaacatcttccaaaacttttgaatttttcttctgcttgctaaatactattttgtaaagtttcaattactagttcgaatccacacctcaataaatagatatgtattagagaaggaatggaaaaatatttactcattaagaataccaacacatgaaagtgatttcagagtatggagtcttgagtcaaaaacaaaggacccttcccggaagcttccttttttgcttcagtttttgaatttgactgaaggaaggtggaaatgatcactcgagcccctaatgaattctccttagtaaaatactggcgaggaagaatcaatcccagcaacaggatgatctgggaccagtcttcagatgttaattcccacttggccctactcttctcctttagaacgtttttcttgcaaaatataatttaatgcatttcagattccccttcctacctaaatagggccatagaataataattatctttcttatgggtcttggtatctaaattagtagcaaggacttatgagctggtttactgcacatctttgcaccaaaaataataatttttaaaaagaccacattgcatctgataaagagctctatagttgtgtgaaaaacacaattagagacatctatcagtcagaaaatgtttcataggccactgaggtattaattagtacactggagtaattgtttggtagttggtaggtgccactggttacattgttgttaacctaataggccagaaacaattcttttcttttcttttttcttttttttttgagacaaaatcttgctctgtcgcccaggctggagtgcagtggcatgacgtctgctcactgcaagctccgcctcccgggttcacgccattctcctgcctcagcctcccaagtagctgggactacaggcacccaccaccacgcccggctaattttttgtatttttagtacagacggggtttcaccgtgttagccaggatggtctcgatctcctgacctcgtgatctgcccacctcggcctcccaaagtgctgggattacagacgtgagccaccgcgcccggccccagaaacgattcttgttcatttcttttctgagatgtctgtatctgatgttcacatataacaccaaaccacatggtttttgtttgtttgtttttcagagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggcatatggagttttctttttaaagcattataaagaacaatttctttgtttaatagaacaacctgatctacatatatgatagtatatgatccaaacaataatgctgtgaacttaatgggtctggtattatccccattttacagatggtagaactgagatgcattcaacacactgagatacgttcaacacaccattgggaatcatcagcaaaatccagcatgaagagtctctacaggataagtagcctagatttttccaacaaataaatgataggagggaaaaatggtggggtactatcatagattttaaaaggcttaagagacatacgagccaaatataatgtgtgtgggtcttatttgcatcctgactcaaagaaaagcattgatcagacagtcagggaagtttgagtagtaactgaatattttggtatgattcaagtgttacacagtattatattatggctatttttttaaaagagcccttatatcttagggataaatattgaattatttacagatgatatgatgtcttggatttctttaaaataatccagtggtagtgatgaggtggagggccaggagggaatggggatatagataatcaagactggccatacactgataactgttgaagctgggtcaagggtacttgggagttcattgtacttcttatatctttttttttgttgcttttttttttgtttttgagacagagtcttgatgtatcacccaggctggagtgcactggtgtgatctcagctcaccgcaacctccacctcctgggttcaagcgattctcctgcctcaacctccggaatagctgggattacaggtatccaccaccacaccctctaattttcgtatttttagtagcgacttggtgtcatcatgttggccaggctgctctcaaaactcctgacctcaagtgatccgcccaccccggcctcccaaagtgctgggattacaggcatgagccctcgcatctggcttgcacttcttatttctatgtttgtatgtatttgaaaaattcaacaatagaaccacagttaatggttaaaaagtaagagtagatcatggtaagaactggcctggagtccaggtgtggtgcctcatgcctgtaatcccagcactttgggaggccaaggcaggcggatcacctgaggtcgagagttcgagaccagcctgaccaacatggagaaaccctgtctctgctaaaaatacaaaattagctgggtgtggtggcgcatgcctgtaatcccagctacttcgaaggctgaggaaggagaattgcttgaacccaggaggcagaggttgcagtgagctgagatggcaccactgcactgcagcctaagtgacaagagtgagactccgtctcaaaaaaaaaaaaacaacaaaaaactggcctggaaatagcaatgttggacaaggtagaataaggctacataaggctgtggacaatgtgaggaagccaaaaaggaaggtgaatgaagagttgtcccaaggtgctagggaagtagcagagggatccacgggagagaaaatctggctggggctagtggtgatgaactagatagtgaagtcagagtggctggaaggagaagggattttcctggaaaaaaaaataggaaacttagaggcaggagacaaggagaacctccattagacagactcagaaaggccctttctttctgaatggagtcagctgggcatctgcagcacagacagagggatttgcctgtgggctggagagggtcattactcctatctcagtcttcccacaatgctccagctgaggatctttgaaaccagaaaggtggttatagtcaccccagagacatgtggagaacaaaagaagaggatggtgctagcaccacagccattcatcctgattgaactcccactgtggacacagccagctggagcctcagagcagtcacacagcatgaggaggggtttacaatggggtcattctagaagagaatttcctccgttcttgctactgggagagagaaaatagattgttgagtgtttcctacagcgtttgtgcaaagccatcctcccctcccactgccttcaaagtgagtcacgtgccaggtcaccaggctgagtcttctagggatggctcttccaaatgtgtttacacccaaagatgcagtgttccggaacacacctggaggtcctgaagggagcaattcagagttggaagtgtttctgccagtgagttgggggtctgtctgggttgggcagctacctggaggtgatatgagcttggaaaactgagtcatccactcgatccacagttccacagtcactgccacacaatgaggagcagcatgaccctgactccacacttcccaagactcctggaacagaattctatttctttggcaaggctgcgacgaggacctttcctatttactcagctaggcacaaaggaatagcagaaacatcttttctcctcctctttcctttgaaacctttgagagataccaggcttcacatataaatctcacagataccagccacagggttagggcctggagaacgaaaccctccagatcccctatctgtcacaggatcacatggtgatcactaaagtgccactgccttggccagggggacaggagagccaggaaaatgggaacatttattaaaaataaattgtcggccaggcacagtggctcacgcctgtaatcccagcacttttgtgatccagccaaggtgggcagatcacctgtgctcaggagttcaagaccagcctgaccaacatggtgaaactccatctctactaaaagtacaaaaaaaaaaaaaaaattatccaggcctggtggcgcatgcctgtaatcccagctacttgggaggctgagtcaggagaatcacttgaacccggaaggtggaagttgcagtgagccgtgatggcgccattgcactccagcctgggcaataagagcgaaactccgtctcaaaaataaataaataaataaaatagattgtcagctagaggaactcattcttctagctgcgagtgggtaggggaggacatggttaattacttctctcttatgatccctttttgtgttcctgtgggaccccacgcatactttcatacagtccctgaaacggggcataatgataagagttactctatatacataacaagctctgtatacattgttcatttaaacatccctccctacattttatagatgaagccattgaggcagacggattccatgacttaaccaaaactcctcaactagtaagtggcagagttggaacttgaatttaggcctctgggactccacagtagacactctcccctgtaccacactaccacctgttaaaagagaaaccttagacagattaaactgaacagactttgagtaaagagcaatttgcaaaacaggttcagagagactctgcactgccgtgtggttgaagacaaccgatggacagcaaaaggaaagtgaggtacacgaaaagtgagggacagaaacagccgtattggttacatttcagtgtttgccttatctgaacatggtttgaacagttggccacctttggccgaatctcagtgattggcacaagagtaggttacagcctgtttacacatccagctaggttacagtttgctatgtacagagaaaactttaggccgagctttcactatgtaaggaggcagctttgggctgaacttaatttggcacacctaatacttgtttacttattatatatgtgcctcattcaactgggttataagctccttgaagccataggctgtgtctcatttttctttttatcttgatatcttgcacgcggcctaacaaaggcaataataactgctgaatgaatgagcatgatggaatgttttaaagacgtcataaaaggtaaatcatcttagactgtgtacagagggaaaggtggaattacctctcactttggtgggatttacagattgatgtgaagttgtgaacatggttctcaagtctttcttttctttttttagacggagtctcgctctgtcgcccagactggagtgcagtggcacgatctcggctcactgcaagctccgcctcctgggttcacgccattctcctgcctcagcctcctgagtagctgggactacaggctcccaccaccacacctggctaattttttttgtatttttaatagagacggggtttcaccacgtttggcaggatggtctcgaactcctgaccttgtgatccgcccgcctcggcctcccaaagtgctgggattacaggcgtgagccactgcgcccggccctcaagtctttcatagaatcagccagtagaactacccgcttcttttctgagtcactgctcaagtgtcggtagttcaggaagtgtcaaggcacagagttcctgccaaatatctcagtttgctgcacaccatgacggttgtgcatgattcatttattagggagacagaccagatgcgtgggacggccctgctcaccatcaaggcagatctgtgggcagacagagcattgggttctgctgtgggttttcatcgaccagtgttccctctctgaccatgggaaagccacatgggcagtgcagaaggcatatcccagcccttcactggtatcatgtgctgtggcaacagccttggggattagaacagagaaacctggggaaacattggccactcaatgagaagcaaacttggagggtaggaggaaagtcctaaggaggggtcagggaagtatccaggccatcaactttcaaagtgctccaggacataatttagaaagtcaattggcacacctagccaggagtatatcttgagaaagtagtattctttgaagcctcctgaagcctgggttttaccaacagcctagtcctggcaagattcggggagcttgtacttcacatactcaactttctgtttctaaagggaaaggagactctaccaagcctttttggccatcaggctgctcttccaaaattgtctggtgacttaagtgtaggtgaatcagaaacatgtggatcaaatttcctgctaaaatacacatgggtttggcaattaaaagaaaatgtgtagaatatggcagatttggtggccagaaagccccgtgagaaggcaagggccactgaaaattatcataactatatagtaaaagaaaacttgattccaaatgggcacagaggaatccatggagaaagttggtaagacatttatgggtgtcacacatcggcttctgaaggccacaagtaaaggcagggtgtttgcaaagattcttgtagaaccatgtccttgaatttgggtttaaaaacttattaacttataagttgcaaaagaaaggctcttttagaaaagagctgctataagatgggctgagttagaaaaacctaacagcccatcctaatagactgaatgttctattgtttgatgaatgttatgtgccagtagaacttgttgataagccattcttccgaacagaaaccataactatatacacaggaaacaaaaatatttgtaatggcttttagcagtggcaactgaacacctgaggagtgagatgcatcttaataaagcccatttggaaactatagtgacttccccacaaggtgtcaccttccttgttaggactcatcacgataccattcatttattcattcagcagtaacttatcaaggatctattctatgtgccaaatactgagctatattctgggactggggagtcttactaaagaggtataagatataggctcttccttcatggagtttaaagcacatttgcaaccataaatattcagctatttgtacactattattacacacttgatcccatggcatcacagtttaacagagtagttagatacaaaaactttgtaattagatttgcatttgacgggttctgtgacttacaagttgtgtggccttgagcaaataattccatctcactaaaccttagttctttcatgtaaccaatgggaaaggtaatacttaccttatcatattgatgtgaagatcctgtgatgtgaaattccctgcaatatggcacctgtgttaaacctctatttagatgccaaattcagaattcatcagatttcagggcaagaaacaaactctttactctggatatttccatatgaaagggatttaatgcaaggaattatgtgcttacaaaattatttaaagaagtggaggagcatgaggcagggatccacagttcggtttaaccagttcaaggtcacgcacatagctggaatccagaggtcaggaaatagtggttggtgtcactgccaccaccacatcactaccaatgatgtgtgatactcccaaagtcattgtcttgacacaagaatggtgagtctgcctgcagctaccatctctcatagcagaaacagcagcagaaaaatagatgtttttctttctcttccaacttcaacatctgtgggagtgcatctatttggtgttccagtttgcttccaaaagcctgtctcctgaggagtcaggtatcagctacatcaggggttcccaacccctgagccaccaaccaatactggtctgtggtctgttaggaactgggccattcaggaggaagtgagccccggtcgagtgaacattacggcttgagctccgcctcctgtcagatcagtggcagcattagattctcataggagtgcaaaccctattgtgaactgtccatgtgaaggatctaggttgcacactccttatgagaatctaatgcctgataatctgaggtggaacagtttcatcccaaaaccatatgccccttgccatccacggaaaaattgtcttccacaaaaatagtccctggtgccaaaaacgctgaagaccactgatctatattttccatatagggatagccaaaacccaggtaagctgaagctctatgaaaattcaaagtagagcccagctgtcctgatctcagttttaccatcaatttactatcttataatagctccaaaggagaaaagtgaaaaaccgtagaattttagagatcattttttcccgccttcctggttgataaagtaagaaatagtgcttgaaagaagatgaataatcgcagcacagacgtaaaccaaactcaagctttatcattaggattgacataggaaccatccccatgacatagaccccaaaagtacaatggtatgaatgaaaaaggtgacagcggaggctgatctttatcatttttcactatgcttggcttttttgttattgttgatttttgagttggaatgtgagcttatttatcctccacagcttttggaagatttcagcctggctcatcctacgttagagtgtctgacaggggaataacgcgtggtatttagatggcaccagttatccaagaaggtcaaatttctttgcaattagtctgtcgtactccagaaagccctgagagacgagacgttggggtgtgagagagggagttatcttcatttaacagcagatagacttaggaagcggcaggggccaatgaaaaagcaggaacgagaatggaaaatgtcccaacactatctcccttcccccaccaacaacccaggaaaaattttccaaatcactttctacatatgccttgactgttgattcatcaaagatgtcttcaatagattcacaactcaaaccacattgtggtatttaagtaaaggggagcattgaaaatgtgaatatagtatttcttctatttttgcaaatggatgtgtttgataccaaacactgtcagcagctaatactattactatgtttgctaatatgctcagatcagctgggcacacaaccaaaacccataacattcctgagtgaagtatgatcagatgctcccaaatgcaatttgccttcttccctcgcatcgtaagagaaaaggcttttgttggatatgttttgtgaacaccaaagagagtaaatagctttttgaagaagccaaagtgttttcctcctgattcattgtgaatgcctgcaagagtgtttccttttaagttaaaacaatttacgaattcttcctactaaatcaatctacatatttttatcactgctatttttaataagtaacttttctttctgaaaatttatttcactttgccccaacctttctgtgattcttgggagacaagaaacagagttcatgtaaaacactcttgtttatgatggatgaaaccacaaactttgtgtgatgttaacccactcacagaaggagaatctgaacttcagagtattttgtgtttggagagaaggctcactaagggaaatgggctcacttcaattcaatatattataggaaggaaaggatcaaggaagagctggtcttaaaactgtcaaaatataagaatttgatgggaagaaagaaggaaaacagagcagttggaaatgcaaagataaaagaactggatccagacatgtctatgtaatttcccaggaatggaaattgtactggcaatttggaaagagatatcgaaaaacaatatacattaaatgttgagcttttcttgcagcaatgcacttggaaggctcttagaacacatggcataatggtattatgattcatctacatatggcctgatccttggtgactgatgaaaggggaaaccaagtttcataaggaatcaaacacagaagaggaagctaaacacttttttagagaaaaaaactcttttaagcttctaggtcatcagcagagtattaactaacgcagcctactaaatttgcattgggatagatcacatatgtaatttcctttaattcttcaataaccctgtgacataggcatcattttctctgtttcctgatagcccaagagttgccatctctaaagttgcttaggtagttggtggttgagcttagatgcaaacagaattctttccaccacaccagtgattgtcaaacctggctgcttatcagaatcatctggagagctttgtaaaaatacagattcttggcccaggaaattctgattcagtagtctagagcaagctctggggatcaattttttgttttgttttgtttctccagtgactctgatacacagtgaatttggggaaacattgcacacaattgcaaccagaaatggtgtgagaatgggtgaatacaaaagccccggagggaaggttgtagaacacagggactccactgctctacgagaagcctgctaaactacacccagccataaatagtctcacaaaaatctaccagatctgaaaaacatgcttcgacttcacctgaatttatttctaaggccccagacattcctaatcagcccatctcctcccagatggctctgcaaaccattcctatcgtttggaattatgttttcagaagcctcacaaccatgataaaatgctgttgccataagcattttcctatctcctcaagatgaattagatgagctacttagtccttcatcaataaattgtaaagggagaggcatttggaactatggatgcccttcaaatgtacttggctagttacttgcctctgtttccaaaaagattaaaacgtaaaagaaataagtggcaaaacgtgcatcattcctggccacatacccaaatattctttctcttatccaatatgactttttcctttgcatgctttttcaccaggctaagaaaactaaaatatctttctacaacaaatccttaaggtttcccagaaacacaaagcaatggtgcattatttatttcttaggaaattttaccatgttatttttagcagagtgcatgttaccctgacacaggccataaaacttactcacttctttggggtctgaggaatgtcatcttgtgactggttttacagggagaacttatcggggtgcagttgcagtttccagagtgagtcagtgccatcattgcctccgctgttattcagtgggtggggcacctggagcacaggaatgtgctctctgattccacgacaaaactaaggactgaggctcccctaggctcagttgtagattttgaggctcttgagtttcagttctccaatgagttccaggtaaaatgcagaaaccaggccaggcgccaatggctcatgcctgtaatcccagcactttgggaggccaagatgagtggatctcttgcccccaggagttcgagaccagcctgggcaacatggtgagaccccatctctacaaaaaatacaaaaattagtgtgtgcctatagtcccagctacttgggaggctgaagtgggcgggtcatttgagcctaggaggtcaagggtacagtgagctgtgatctcaccactgcacgccagcctgctgggtgagagtaagagcctgtctcaaaaaaaaaaaaaaaaaaaaaaaatgaaggaggagaaatcagaaacagaagcaaggcaaaaagggggctagagcaagggttataacaggaaggaaaataagaacagctgcacttttaatctattcattcaacaaaggtctgggagcatctatgtactccaagtgccatgtagaggccggggattcagtgagccacacagagacggttcttgcccccacagagcttacaggcacgtggaggaaacagacaaaaaccaagcaaatctacaaattgcataatttaaaaatttggtaagagccaggaagaaagggcgttagtcaaaggaaggacatggcttagtatataagttaagaaatgtccaggctgggcacagtggctcacacctgtaatccagcactttgagaggccgaggagggtggatcccaaggtcaagagattgagaccatcttggcccacatggtgaaatcccatctctactaataatacaaaaaaattagccgggtgtggtggcacacgcctgtaatcccagctactcgggaggctgaggcaggagaatcacttgaacctgggaggtagaggttacagagagctgaggttgcgccactgcactccagcctggtgacagagcaagactccatctaaaaaacaaaacaaaacaaaacaaacaaaaaagcaaaaaacaaaaaagaagaagtgtccagtggctttgggtcagcatcggtgaaagtggggagagcaataaagaagcaattgcaaccttttaggtgagaaatgaccgtgacctggacttggggatgggccgcgaagagtcaggatggactcaagacagctactggactgccactggccgcgacactttggagaaactctagcagttagttcttccgacacagttcctacaggtgacgggataaaaatagaagacagcaggggaaatgatgaggagacctggagcactttagttacgattcaactcagcctgtgctagggccacagggactcaaagaggaggaaggagacactttctccatgcaaggagtctacatttcattgaagaagatgtgtccagcatacatgtaactacaataaaggaaaaatatgacaagaataatagaaaaggcagaaggctctgagaaggaggcttgaggtcagagtaggaattcaaccagaagagagaagggtgggaacttctgaggggagggaggagcaagagcaaacgtgtgaacatggtggtctgtggtatgtgctcagctcctgctgggctcaaatgttgcatgtgcacagagaacattagctggagaccatcaggctggcactgaacaccaggggcaggagtggatgcttgctactcagctgtgcactcctctcatgttcttttctacatgtgtgcaattgaatgtctgtgttatatgtgcgtattaaaagcgaactctcaccttgaaattcttcttagtggcaagattcttttctctagattgacagtgcagagctcacatagtaatcactgctgttaaaatagatatttaggactatagagttaaagcttaaataccatttaagggaagctgctgttatctgaaataatttgtctttcttattgaaaagaaccaataccctccctccctctttccctccttccctcccttccttcccttttttctttcttccttcgttggaagagtggaaacataacgaggggttctggctagtgtcctgaggtgttggctaggtaaactttctggagttgctcgtgccaagagaccagcacatacatttctctaggggaagtacatcctaattattccacagacatccatggatcactctggctagcagagtagcactgcaaaaatcattacgatttttttttttcagaaagttgttctactttggcttaatgtccacatgaccaagaatcacactttacagtctttaagggcctatcccatgctcagccactttcctacaaaatcgtggcgacgtggaaaggcagacatgtgcacctgggagcttctaagatcctgtctgctctggctgatgcagtgaccagagtcaccagaaaccctctgctccatctgggagacccaagagagatcatctggaagctggtatctggggacacactgctacattgtccagtccaaagtccatcagctttgttttctttctctgtcacacgaacaagtaaaacagagtgtagaaacaaacactgcaggcaaggttacctagtctccttgaaaaggtttccttcctactggctaactttcaacctaagggaaaatgcagctcgatgctcaactggtagattttctttcacattttattatacatgtgcatataaaggaatttctcttactattggtttcttccttctctgatcctctctccaaaggcaccacatttctccagagagtgtgtcccaaatgcctcatgtctacggagttctttgcaaacattaatagacaaatggttagtttatataaagcacacatgtattgctctgacataagcagtgaggagcccacagtttacatttttcatctttcttttaaaaaggaatgagaaatcgtattccagatgatccaacctattacgctacgaagggaagagtggagagggaaccaagattgaaaagagatttaaatttggaccctttgtgagccaagtgcaaattggtgtacaagttcacattgatctttagaagggaaagcaggtattgaatttgctttccacctttagctccatccttctctaccttgagaagaagcccaaaatactgaacttacttataagctcctaattttaaaggtagactgatacaggttaggtgcaggggctcatgcctgtaattccagcactttgggtggttgaggcaggcggatctcttgaggtcaggagtttgagacaagccgcggtcaacatggcaaaaccttgtctccactaaaactaccaaaaaaaaattagcagggcgtggtggcgagtgcctgtagtcccagctactcaggaggctaaggcaggagaatcgcttgaaccaaggaggcagaggttgcagtgagctgagattgtgccaatacactccagcctgggtgacagagtgaggctccctctcaaaaaaaaaaaaaaatgtatatatatatatagagagagagagagacagacagacagacagagagagagagagatagacagagagagactgatacagtcattaataactaatggcaataaggcaggctttggtttttgtaggaaacctcaagacaggccatatgggttttctttttttctttttcttttctttttttttctttcttttttttttttgagatggagtctcgttctgtcacccaggctggagcgcagtggcgcaatctcggctcactgcaaactccacctcccggcttcatgccattctcctgcctcagcctcccgagtagctgggactacaggcgcccgccaccacgcccagctaattttttgtatttttagtagagacggggtttcaccgtgttagccaggatggtctcgatctcctgacctcgtgatccacctgccttggactcccaaagtgctgggattacaggcgtgagccactgtgcccggtggcatatgggttttcaatggccatgtgttcagcattctttatgagtaaactcatgtgatatcgaaacccatattcctcatatgtgtgttcatattttacacaaccaaatgttttgacaataccaactatcaaattatttaagtcatttcgcacttaggaatagttttctttcatgaaaaaatagtggtatttgaataccagttctaacagtgtatggtgtagactcttgttcacagtatagagggtagaagctcagtgtatggggctcaggggtcagcagctgtgactgcttcatatagctgtgtgcccttgagacagtcatacaacctctctagacatcagctttctcatctttaaaacagaacaaacaatagtagcaatttcgtaagagtgttaaggtaattaaattagataatgcatataaagcctcgtgtttggtacacattaagtaattaataaaaggccactttaagaaatgtatgtatacacacacacacacatacacacacacattgttaatcctataagaaaaaataaagtgttatagtatgttattcatacaagagaatattatactactcttaaactgatatttttgaagaattttaataatgtccgcaaaaataatcaaaatattaggttaaatttaaaagttaaataaagcatcttattatatacagcatcttctctctctctctctctttctctcacatacacatgcacacacatacacatgcacacacacatatacacacactatataattagaaggaaatccatatatgtacatatatatacagtgtgtgtgagcaaacagtggttatttggggattgtgagattacggcatacttttattttctttgtatttttctctatttccaagttttctgtgatgagtttgtaatatttttacaataacttcatgttataaaatattttataagatgtaatgaatcagtccaagtgacatattaggagagcggcagcaagagcaaaatcacacgtatacttccatgccttcaaaaaaggacacaagagtgaaaacgtgaatcctaaaatgacttctagtaaatagcagagacatcaaggaaacaaagactgggaagggactaaataagccaaaagtcaaaaaaaaaaaaaaaaaagtgaggagcaggatagccagagacagcggggtaaaaccttgcaaccttcagtttaataggtactttcaacagatcttccccaaggcactagcattttaaaattgcattaaaatgagcttttttcaaagagaaaccctccaccaaaaaaaatttagaaaatgaagaacacaagctataagggaaaacacaaaattattaactgaataaagtcccatcacatttttttcccaagagtgaggtcacatcaaagagctcaaaacaaatacattcggtataaacctttcaaacgtaacaggttaccctgtctgcagacaaaggaaggagccttgtttcacacagactctgttacatttaggcactgggtatgtgaattttggctaagaaatacattgctgtctctgtctttctgtcttgtttcactccccagtctcttggatgggagtttcagcctgtctgactacacatttgggcatcttctggtctcttattcttagcttctatcactgcagtggaaccattctgagaagggtaactttaggttagcatgattcttgtagtgcaggcaaaaaagagccagaagtgtttggtaaaactgtttactggttttacaaaaaaaaaaaaaaacaaaaaaaaaaagttgttgtgccatttactggaaggtatcactcattttctttcctgtcttcctccttccctttctctcccttctttccttccttcctccctccatccctctctttatctcttcctctatctctttcttttccccttattttcttctcctctcttcctcccttccttccttctccctgtgcaagtactcatttcatagctttgtcaagcatttgccgtgtgccacccctgcgttacccagagtgaatataaagatacataagacccggtcgggcgcggtggctcacgcctgtaatcccaggactttgggaggccgaggtgggtggatcacgaggtcaggagatcaagaccatcctggctaacacggtgaaaccccgtgtctactaaaaacacaaaaaattggccgggcgtggtggcgggcgcctgtagtcccagctactcgggaggttgaggcaggagaatggcgtgaacccgggaggcggagcttgcagtgagccgagatcgcgccactgcagtccagcctcggcgacagagcaagactccgcctcaaaaaaaaaaaaaaaaaaaaaaaaaaaagatacataagacccagcagacgctgatattagacttactgttttattgtgttagctcccagttgaactctagtatctatgcagacactgatgtttattaggtgcctggcactttcacagagcttgttttacttaattccagcatctacccagaagtgggtgttatcaccattcctataatacagatggttgaatttcagcccagaggctttaaatacctaattgagacattcagcttctaaggggaagtatcaggaatttactctgactttcctgactccgagttccgtgctttttcccactgtgccagaactattgactgtgaaggattatgttcacagtttgaagccttcaccttttgatactgcactgcacgtggagtatatgcaataaatatgtgcatgaaatagggcaagaattgtattacaatggtcctgaataactcattccatatacctgtatttggcaacattgtccagaattttcacatgcacgtgcattttccatacacaggaaactggttaggcatacacctcagacaggtcagcagacatacacacttacataagggcttgtttgcattctgaaagcatgcctactcagattggagcttgttacaaagaacacatgggaagcaaaaatgttcagtttacaaatgatgctcaaaatcactcttgaaatcataatagaaacatcacatttgttttaaatttgagggtttaaaacattatcaacatgtagagagagttatctagcaaacacatccatgtacccatcacccagaaattcaaattgtccacattttgtcatatttctttcaagattttttttaagacataagatttttaaatggtttgtaatgttgaaatttcttttgtcgtccatgcctgatccacctcctcccctcctcattctggtgaacatcattaaaggtatggattccaagtcactatttatccatgcacatgaccatatgtttcacaagcaatttatgctatttttatatgtttactataaaatacacataatggtatcatactacttatatcattctgcagcttccttttttttttaaaaaaaagcatctctatgttttgagctctatgttaaaatataaaaatctaatcaatttcttttattagctatgtagcattttgccatatgaataaaataatttcttatgccttctcctatatttgttgatggacattaagattgttacaaacaataccttgataaacatgcttatacaagtttctagtcctcatacacacgttcaaatttttctaaggtgtttacctagaagtgtaatgtctgggtggcatactaagtgcatgtttaatattaatgcaaattgacaaattactttctgaaatgatggtactaatttaccctctcactagcaatgcatttgcttgcttgcttctctctaccttttccattgctggatattgtcagacttttagatctttggtaactttgtagataagcaacagtatcttctcatttcagtttatatttctctgatttactggtgtaatgttgcatctttttatatttactggctgtccaggtttcttttttgtgaattacctgcccatgtgctttggccatgtgcaatttttttttcctattgggttatttgtggggatttttttcttactaacttataagaaaaattcattctgaatatgatccatttaactggtatttgactcttgtaaatatgtttttacttaatcattatcaagtttataggttaatactttttttctttagaaagggcatacaaggtcagttccaactgtgtaaagggctttattcttttttaatcctatgcaagacagcatacgtagtctctgcaattggatgaacagctgtaaatagcttttgcagatctaagtaaaaactcttctctaaaggtcttcaaagttattctccaaacctggggagtagccctcttttagcttcttggggttacagagaggctagcacattccaaacacaggtgggcaaaaaaagaggaaatggactttacttttacgaaccagtggctgagcagaatctactcttctcacaacctcaaagtagtttgaaagtactttcattaaataaaattaatcatttagtgatcgtggtttaggcatcatggtttaggcatgactacatcgagtcattctacttcttctccccttactaaaagcaggttttagttatgtaaccatgtttagagcggtctagggagtttttatccttatgccttcatcctgattggacaatggtttgcaagaacttgttaggagctgtggaaacacaaatattgggcaaaaaacttgtgtttctatataaatatttacaaacatactagactataaattctttgaggtgagggcctgtgtttatcctatccacgatggttataccctcagcatttggttcagctgacaatcttagtgggaatgtgctcaacattctcaatccacaactatttattgaatctgagtgctgtgttagacaatctatattctatgtgcttcatgtaatcaaagtgacctagacaaaatccctgcccttatgaaccttacattctagtggcaggaaatactataatgccagggagaagggagagagaaatgagaatgaagaaaaatgatgcagtgatgcatagccctctctatctctttgggatacagagagggggcgtgtgttgtggggaggaggtgggggctctattataaaaaatatggcctgagaaactgcatgaggaagagtcatcatgatttgatacatggagatagagaaaaccacagtgtcagggctcccaaaaaaaaaaatcacttccattttgggaggtaatttcagcttctttgtatttgatttggggcagtatataagtcttgggaaaaaaagaagtgactaaagcttttattttagatgaggaggacttaatgaatttgtaaaatatgctcccttttgtggggagaagtacagcagtttgcacgttgggagaacagctggctccaatacagcttggtggtgggcttcgactgaactggtcatcgcctaagtattttgtgtatttctgattacctatctctccaggagcccacgtgagcaagacaggtcttcaagctggttcaatgctcccattctgtaggcaactacaaactgtggctcactgcatgacttaacaacaactgattgagaattgtaaagtgcagcctcgagttcatgtgtagaaactgccatctgcacaaacaaaacattgagaggactaagattttaaggatactaatgcagacgtccttcttgcttcatttatttaaaaatatccatttcacgttcctaacagcatctagtagatgtttcttgcttcttccccctaacgccggactaaagagaaaaaaaaaataggctgttttctggtctggttttgttttcctagtcaagtacttaaattacgggtgtttcgtaagtatcttttgatggatttcattgttttgtttatttcgcgttagacaatacagacaccttcatatttccttctgtagcaaatctttttcaaagtcttcatttgacgtggctgatggagctggtctgcagatcttgcagacgtgttaatttttgcacggactttagcttcaacacacaaaacttacggcctctttgaggaaccaatttttcaggctaagagaacaaatgaaagtgttcgctcatctttcgaaaactatttatgtacttggtatccggaatgtgacattggttttacacgtcggtaggtttttgtcctaaatttctgggaagttacttcctcatctaacgttttattttcctgacttattcgtctttgatatgctacagaaaacccctctcgcccagtggctgttttctctctgtctcttaagataatttaggaacagaagccttgacttttgacggtcatttagttttattctcctcccgtgactcccctctgtacactcacaggggaggccgccggcatctgggctgaaagaacccttggcgggcgaggagagcagggtgtcatgttggcgacaggctcctgctggcggccagcgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggcacgatcccacggagatctcgctcttcccagcgcagtctccgctactgagcgcgggaccaacgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcgcggcgcctggccaatggagaggcgcggccccgggcgccgcgctctgccgccggcatttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacaggtgagcgcggacgcacccggcagggatgtgagtgggcggagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcagcgcctggcagacgcgcccgcttagcgagggcgcgaagtccaggccgccagagcgcaggagcatccggacctgctagtcggccgctgactgcgcggcgagttgccttgagagggtcccatgtgcttggggcgccgcgctgggtctgggggcgtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccaccggctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcattcccgggtcgaatccgtctactgccttcccctcctcgaccgactccgaatctcggctcttatagacagaaatacagcctcagcgttaggggttaaaatccccctcttaaacggtccgagggcagagaggtgaccaccgataggtaattggatctcctgctggaaagagcaaatctgagcggtgtgcgcgtctgtttatgttccccttcgagatggtgccaggacacgaactgattaaaacaatctattgtgttaagtgggtcactagggttttaagctgtcccagggaccccagagtagtggcttccttctggctgtacacacaagttaaataaatagcgtagaagaggttaagataaccccattctagggtgaggagtcctctttcatccctagggcttccccctccccttttctctttttttggaaggagggggagcatgagagtcttgagggggggatgtacttttcaaagcaaggagggaaagatcttaagaaaactatatattctcactgccccccaagccaagtctataacagtaggtgatttgattactatctctggataaatggcactgtcaaattgttaatattaactatttcagggatttttagcagggtagtggcagtatgtgtgcgtgtgtgtgtgtgtgtctgtgtgtgtgtgtttaacctccaggtcattgtaggaattagagtcttttgtaaactttgtaatttcacaggtttcctattttcttaaaagttcatttttagtgaaatgttttggtaacccacgctctgtaggaaatccaggttggctaatgcggtctttatgtgagtagttacacagggaaggataaaaaccttttatgtcctacatctctgaatgagggctgcctaccctgtctttgaaactaagccgaagatgccttcagtctgaatggtcaagtattaaaagtgataaaatgcaaagaaatttcatgccgcagacacctcccccaagaactgcttgttgacagcaaagctgtggaacatgttccacaacagagagtaaaggacagccaggaaatataaaccttttatgtaaaggaaaggcaggtgggggacagtggttaggggaggtgactgcagcctctaaccaaaaggcaaccatcaggcaagtgctaccagcccgtgtcttcgatctgcaaggaattttctttagttttaacatatgctcttagaaattcaaagtacaacaggaattcctgggacaagagaaatctttttattcacatgtgaacatgaagatacaaaatagataattattttatttatagcactcttcaaattgtattgcattagaaaacatatccattgacccactgttaaggacagcactgggtgtcaataggacagtggttaaggacctgtgtttggggctagatagaattgggtttaaactgctggctgggctgggcacagtggctcacaccggtaatcccagcactttgggaggccaaggaggacggatcacctgaggtcgggagttcgacaccagcctgaccaacatggaaaaatcccgtctctactaaaaacacaaaattagccaggcatggtggtgcatgcctgcaatcccagctacttgggaggctgaggcaggagaattgcttgaaaccgggaggcggaggttgtggtgagcccagatagcgccattgcattccagcctgggcaacacgagtgaaaactccgtcaaaaaaacaaaacaaaacaaacaaacaaaaaaatgctggctttcccacttatgagctgtgtgaccttggacaaatttccaacttttctgagtgtagattccctgattggtaaaaggaagatgatattatctacctcatattttgttatgaaaaataaatgataaaattgggtcagaaatcagcataatgcctggcacagtaagggcttcaaaataaaaggtagctcttattattagtaatggtgttaggaaaagtagcaatgttatacagaaccaggatatatcacagggcagttctgaaattaaatcctgaatcctggccgggtgaggtggctcacgcttgtaatcctaagcactttcggagactgaggcaggcggatcacgaggtcaggagtttgagaccagcctggccaacacactgaaatcccgtctctactaaaaatacaaaaattagctgggtgtggtggcaggcgcctataatctcagctacttgggaggctgaggcaggagaatcacttgagcccaggaggcggaggttgcagtgagctgatatcgtgccagtgcactccagcctgggtgacatctcttaaaaaaaaaaatcctgaataccacactacgcagtgactaacacatctttcactacagaacagaacctgtaacttggccgtctctcagcagtgctgctcagtgaacatttaataatttattactttctaactcgtttcttgttgacctcaagaattgtacatagtcattaactttcctaagaaaatctttgacaaacatagagctcctgagatatttcacaaccaggtggtctcctccctgtcctatgcaatgttgggccccagcctgatttagccgacctggtcttcagacttgagaggctgtttagggttcttacaacacaaaggggatgagactttatcctctacctgtgtgccaacaagggattcttcttatctccttggtgcaacttgtctgaaaaagaaagtcaacacaattatcttcttaaaagttaaagatcaaattaaaaataagctatagttttcccaaagatttagacctgagaaaaaggaatagatctttctaaaacctggcctgcacttagagcatttgtagtcacttccactatttcttatgctgagagaataatttgatgtcatgcctattgaatgtctttctaaagcttgattcatcaggaggaactgaccagaagtccatgcacagacatttggctttcactgtaattcctactcaaaactccctttcactgattatgagcaggttgcttagctaaaatgagaaatacagcaagaagagggatggaaagagctggcttaaactttcccaaagacatcatgaacactgggaacaggtcatacatataccatttttatttctcagtcctcagtattagaatattgtgttcctagaggctttgtgaaaattggaatacattgccatgacctgcacaggatagaggtggttaatatggcttaccttgcttgtagatgtttactcttgatccctaagggaaactggaaggaaagcatgctgtagagaggacctgctttgagagtatgtgtcctctgggacaagtggaatgaaagagaggatagaggcaaagagaaaaaaaggtggagatggggtgagacttgctggtggacagttgcaaagaaaactcatgatgagaataacatcacatttcttgaagaagctgaactgcattgatgggaagttgaggcagagtttgaaaagaagatatactgtctgcaaaaaagaatcaacggagatgtcaggtatcttgatgcaccctgagtctatgagatgcagcttaatttaatttaatgatatgagtaggccatttcataagtggtggaaattaccataaagtgtttgcagctaatgacggcgcatgaatgatgtcataggaacctaagtctggatgagctatggattgaatttttactatgggacacccttctacatgttgctgtggaaaagaattgtcctcaagaaatgtacatcttctgcatttcctctacatctctgatatttacaaagtgcacattatttggtgatactacaactgggatttcaagtgcacatcactactatttccttcactgaagaatcaagagcagtctgggggtggggagagcttgagtgattgacaaggatgtggcagagccctggttccactatgaattatagttcttaccctgcttactgtcactcatgtagagcagctagtgtgcctcagagcactgctgttctctgagaagctgaggtctcgattgacattcttgaagttggtgtttacttctctctgaataaacaaaggttggcaactcagacatcttacaataagtactaaagatttttgaagaataggtttttaaaaaatgaaaaaacatttcactttccatagctaataaatcttattttgaggaaaatgtacttttctttaaaaaaaaaaaaaagcctgtctgtcactctagaccctttggcttagaaggtaggcacactcacatagaaacagaaagtctgtccaaattaaaactgaaaaccacagttgactaattttgaatttatagctctgctgttggcttctgcgatagtattaatttcaatggcttcaattagaaaatgaaacccatagcattccatatgagaacaggtaaaaagtcagggacatttggagttttccaagaaaaagaaagacaagtcttaggaagctctctaggatggaaggaatttgccacactgagagttagacatccaaaggatagcaattggctcttctgctcatgggcactggtgaaggcattttaaaatgcgaagaatggtacctctgtaaatcaatgaggttcataataatcatgcatttaccaaatttttataagcacctgccttgtgccaggcactgagggtaaggtgatgaataagccctcatcaactgtcagactagatatttactcaataacagatgtgaaaatgccaagaaggaaaagttgagtataaagaaagccttaagttggttcagagaaataaaattgcatttttcggatagatgtttatggaatcggccttatgaggtaaacttgtcctatgcagtgaacatacattcccagttagtctcagattggcctctgtgatgacaaactcagagggtcctggtctaggaggggtgaatttgtctggaggccattttcaggaggtatggaggaagactggggcataggcctggggccatcccatgtactcctcctctgaaatggggagcaactgaattgtgttttattttagatcttcgtccaacttgaataccagaaattcgtgaaaccttctcaaattcacactatattttgagaccaggagaaggctccttgagaaattgccacactgtcttatcctagtctctggaaaaattcagtcctgtattataactgggcgtttctcataagtgctttttttttttctttttctttttataatactttaagttctgggatacatgtgcagaatgtgcaggtttgttacataggtatacacgtgccatggtggtttgctgcacccatcaacccatcatctacattaggtatttctcctaatgctaccccttccctagccccccacccctcgacaggccccagtgtttgatgttcccctccctgtgtccatgtgttctcattgttcaactcccacttatgagtgagagcatgcggtgtttggttttctgttcctgtgttagtttgctgagaatgatggtttttggcttcatccacgtccctgcaaaggacatgaactcatcctttttatggctgcatagtattccatggtgtatatgtgccacatttgctttatccagtctatcattgatgagcacttgggttggctccaagtctttgctattatgactagtactgcgataaacatgtgtatatgtgtctttatattagaatgatttataatcctttaggtctatacccagtaataggattcctgggtcaaatggtatttctggttctagatccttgaggaattgccacactgtcttccacaacggttgaactaatttacactcccaccaacagtgtaaaagcattcctatttctccacatcctctccaacatctgttgtttcctgactctttaatgacggccattctaactggcgtgaaatggtatctcattgtggttttgatttgcatttctctaatgaccaccgatgatgagctttttctcatatgtttgctggccccataaatgtcttcttttgagaaatgtctgttcatatcctttgcccactttttgatggggttgtttgcttttttcttgtaaatttgtttgagttcctggtagattctggatattagccctttgtcagatggatagactgcaaaaattttctcccattctgtaggttgcctgttcactctgatggtagtttcttttgccatgcagaagctgtttagtttaattagatccaatttgtcagttttggcttttgttgccattgcttttggtgttttagtcatgaagtctttgcccatgcctatgtcctgaattgtattgccctggttttcttctaggatttttatggttttaggtcttacatttaagtctttaatccatcttgaattaatttttgtataaggtgtaaggaaagggtccagtttcagttttctgcgtatggctagccagttttcccaacgttatttattaaatagggaatcctttccccattgcttgtttttgtcaggtttgtcaaagatcagacggttgtagatgtgtggtgttatttctgaggcctctgttctgttccattggtctgtatatctgctttgataccagtaccgtgctgttttggttactgtagccttgtagtacagtttgaagtcaggtagcgtgatgctttgttctttttgcttaggattgtcttggctatatgggctcttttttggttctatatgaaatttaaagtagttttttcatagacatctatagaactctccaccccaaatcaacagaatatacattcttctcagtatcgcatcgcacttattctaaaatgaccacataattagaagtaaaacactcctcagcaaatgcaaaaaacagaaatcctaacagtctgtcagaccccagtgcaatcaaattagaactcaggattaagaaacttactgaaaaccacacaactgcatggaaactgaacaacctgctcctgaatgactactgggtaaataacaaaattaaggcagaaataaataggttctttgaaagaaatgagaacaaagacacaatataccagaatctctgggacacagctaaagcagtgtttagagggaaattgatagcactaaatgcccacaggagaaagcgggacagatctaaaatcgacaccctaatatcacaattaaaagaactagagaaacaagagcaaacaaattcaaaagctagcagaagacaagaaataactaagatcagagcagaactgaaggagatagagacacaaaaaacccttcaaaaaatcaatgaacccaggagctgttttttttttttttttgaaaagattaatgaaatagactgctagccaaactaataaaggagaaaagagagaagaatcaaatagacaatagacacaataaaaagtgataaaggggatatcaccactgatcccacagaaatacaaactaccatcagagaatactataaacacctctacgcaaataaactagaaaattgggaagaaatggatacattcctgaacgcatacaccctcccaagactaaaccaggaagaagttgaatccctgaatagaccaatagcaagttctgaaattgaggcagtaattagtagcctaccaaccaaaaaaagcccaggaccagacagattcacagccgaagtctaccagaggtacaaagaggagctagtaccattccttctgaaactattccaaacaatagaaaaagaaggactcctccctaactcattttatgaggccagcatcatcctgataccaaaacctggcagagacacaacataaaaaaggaaattcaggccaatatccctgatgaacattgatgtgaaaatcctcaataaaatactggcagcacatcaaaaagcttacctgccatgatcaagttggcttcatccctgggatgcaaggctggttcaacatacgcaaatcaataaacgtaatcaatcacatacacagaaccaatgacaaaaaccacatgattatctcaatagatgcagaaaaggccttcgataaaattcaacaccccttcaatgctaagaactctcaataaactaggtattgatgaaacatatctcaaaataataagagttatttatgacaaacccacagccagtatcatactgaatgggcaaaagctggaagcattccctttgaaaaccgccacaaggatgacttctctcaccactcctattcaacatactattggaagttctggccagggcaagcaggcaagacaaataaataaagggtattcaaataggaagagaggaagtcaaattgtctctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataatagacaaacagccaaatcatgagtgaactcccattcacaagtgctacaaagaataaaatacctaggaatccaacttacaagggatgtgaaggacctcttcaaggagaactacagaccactgctcaaggtaataagagaggacacaaacaaatggaaaaacattccatgctcatggataggaagaatcaatattatgaaaatggccatactgcccaaaacaatttatagattcaatgccatccccatcaagctaccactgacttccttcacagaattagaaaaaaactactttaaatttcatatggaactgaaaaaagagccggtatagccaagacgatcctaagcaaaaagaaaaaagctggaagcatcatgctacctgacttcaaactatactacaaggctacagtaacaaaaacagcatggtatagtataagtgcttttttttaaaagacaaagtaaagtaatttttttgttgttggggtaaaacaaaagctctgcataaagagcagggatgttgtaacatacactgaccaaaggtgggaaacctacagttggagcagaagctgaatgtcacattatcagctccgaacttataatggtctaaaagtactaggttaatgttggaaagatggtgccatttaaagatatcttaaattcaatatttaattattttaatttgacattatcctagagttgaatggtgtttacttaccatgtgctgttcattagaaaatctagatcctacactgcctttgcgcaaggtagttgctctaataataccaacctgtccagttttggtgggagaaataatgttactgttaagttgcacttagtggttattatgtgtaatactggtattccaaagagagaaggaaaatgtttgctacacagctgtgttcttaggttcagaaaaccacaggagtgggacaggagaaccttcaggattcaggtccgattgttgtgatggccgcaggagggagactgtgaatttgaaactgcatccattgaaaagaaaatccctccacactttaataattctctccgtgccccatggcagcaagtgcttataggccttgctactcaaagcttaataaaaaaggcagacctgctgaatcataatctgcatcttaacaatatnnnnnnnnnnnnnnnnnnnntttttttttctttctttctttcttcttttttttgagacagagtctcgctcagtcacccaggctggagtgcagtggcgcgatctcggctcactgcaagctctgactcccgggttcacgccattctcctgccttagactcccgagtagctggcactacaggcgcccgccactacgcccggctaatttttttgtatttttagtagagatggggtttcaccgtgttagccaggatggtctcgatctcctgacctcgtgatccgccgcccatctgggcctcccaaagtgctgggattacaggcgtgagccactgcgcccggccaattgtctgcactttcaagtctaagaagcactgtcccaggaggaaaatctttttagtctgtctgaggcttctctcttgcactctcctttttaaaaatatgctgctccttctccacctttccctcttcttccgccttttctgtctgcctttactacctcccctgaacattcaacttgtagaagagttcccctttctctgaattgcattcttcacttcattcattcttttctctctctgtctatggtttcctattttttgtcggttttccctcacctcacctccttgttattttttgccattgttcacatatcactgccctttcagacccatatctagcttctgacccatccactaatccattgccactaatttattcagcatgcccatgccatttattaatgtaaatatttgcacatacttgttctatcatgcccatttttctaccttttaaattgtatatacacagacacatgtgaatgacatatttcactatttaaaaggtagaaaaatgtatatcgtggtacaaagtgatacattgagtatctgtgcccagtttcaagatgagaataagtgagaggtgaagcctcatgagtcacgtcacctacacgctactgtctttcattccatctgcagtactgccacacatttggttagttctccaattgctgtcacattgacatcgagttggatctgaacagcgtacctggggagacgaagtattggtatctttgcttaaatggagtgatttactgagagacaaagtgacatctttaagatcagatagcaagttactgcaccaggagcgcgacctttcctgttttgttgttttccctctgtcaaatgccttctggtctccatgaatctctccttccacatatgataaaaatgcaaagtctcataagcattcacagctcaggaagcctcaggctagttggggagaaaagactgggaggtttccggaggaatgaagtcctctgagcagagaggttaattcatcttgctgtaaaacaaaatagaaaataagttcccctcaataagtgaacgtaatacaaagacaaatgtggttggtgccagaggccaggaagaagttcttgtgagaataggtgcagagaagagctaggccctggctgagtttaaaccttgacttagtcactgtgggactctgggtgagttactccatggattgatggctgggtcatggagataatagtacctaattcatacaggtactgtgagaagtaaatggaatatttcacgttaagtgtttaacggtgcgtttaaatgctaggtgctattattattaatttttaaattaactttgccatgttttgtgtcttcccctctctgtgcttcctttctttagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtgtgtgtgagcgtgcgtttgtgtttggtagtgttcctagggcagaggtggagcagggatgcacttatcatgggaagggaggtagaaaagagaattggatagcctgtgatctttggtggaatttattccttttgcctaggcctttcagaccctgcttgatttccgtaggacacttcaggttgtggcaagggagagctggtctgcaatcggaagtaccagcctcttccctagagcacaactagaaagaagaactatagagtgttataagggaggccctgagatggaaggaccatcacacagaaatgataataacttcatttcagggtgttccaggggaaaagcaggagaaagatttggggctcagtagaaggaaaagcttcctagtgataagagtgattggcaataccatgaggtacctttaaaagatagtgaactcctgtccttggaaatattaaaccacaggctagatatcatttaatagggatgtgaagtagagtaagtcactgcccttggtgtgcaattgtgaacttgtcaatttctgaggtccctttctacttagatatataatacaagatttctattaggtatgggtgctctgatgataatgaaaatcccagcagctatgtatgggatggttacaccagacactgtgctaaggattttctttgaattgtttctcactcaatcttc

SEQ ID NO: 16098 - DNA, 93971 bp, Human; identical to SEQ ID NO: 16097
  misc_feature (1)...(93971): n = A,T,C or G

SEQ ID NO: 16099 - DNA, 23932 bp, Human
acttaaattttatttcagtagcttttgggatataagtggctttctgtgatgtgggtgaattatatagtggtgaattctgagattttagtgtgcccatcacctaggtagtgtatattttatctaatatgtaggtttctatccctgtctccccttccaccctccctcttctgagtctctaaattccattatatcactgtgtttgcctttgtatattcacagcttagctcccacttacaagtgaaaacatacggtttttggttttccactcctgagttacttcacttagaataatggcctctagctccatccaggttgctgcaaaagacattattttgttcctttttattgctgagtagtattccatggtgtatatataccacattttctgtacccactcggtcgatgggcacttaggttggcaattgtgaattgtgctgctgtaaacatacatgtgcaagtgtcttcttcatataatgacttcttttcctttgggtagatacccagtagtggaattgctggaccaaatggtagaactactttttgttctttaaggaatcaccatacttttttccatagaagttgtacattcctaccagcagtgtttaagcattcccttttccccacatccacgcctacactgttttttgactattgttttttgaggttttttttcttttttagacagggtttcaatgtgttgcccaggctggagtactgtggcacaatcatggctcactgcagcctcagactcatgggatcaagggatcctcctgccccaacacacggccccccgccccccgccccccgcccccctcccagtacctgggactacaggtgctcaccactacacccggctaatatttgtatttttgtagagacggggttttgccatgttgcccaggctggtcttgaacacctgggctcaaatgatctgcccaacaggcctcccaaagtgctgggattacaggtgtgagccactgcgcccggcctttttttctgactttttaatgatggccattcttgcaggagtaaggtggtatctccttgtggtattaacttgcatttcttcgatgatcagtgatgttgagcattttttcatgtatttgttggccatttgaatatcttttgagaaatatctattcatgtcctttgcccattttttgatggcattattttctttcttgctgatttgagttccttctagattctggacactaggcctttttccgatgcatagtttgcaaatattttctcttaatctgtggttgtctattatttcttttgatgtgcagaagctttttagtttaattaggtcccatttatgtatttttgtttttgttgcatttgcttttggggtcttagacatgaattctttgcttgggctgattattagacgaacatttattgagcaccaaccatatacgacaaacgatgtactaggtgttgggaatacaatggagaacttacatgaatcaccagtcacacaaatctcttttatctttttttttttttttttgccttacttgagaatttgggtttttgagtaaacgccattattctctctttttttaagcacacttttgcatctcaaccacctaacacactgcatccctgagcaacccggaggggccggttcctgcacccaggccaacacaacttaaaccccaacacaccagaagaggaataaaggccaaccaacttccgcccacccactacaaacgtcgagagaaattcgtagatgaggccttgtcaaaattcagaggcgtcctacgtctgctttcccaatgagacagttcctttttgtttgtctcagagactggggtttttttttttttaaaagactgtaggcagaaaaaacaccccaaccggctgttgtgacaatcaaacgtgtctaagaaaattcagccaatgagagtgcgagagtgcatcttgtgttggccaatgagaacagcgacccgtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgagtgtgcccggggaccgctctcagaggcgagtccgtcggccccacagctcccctgtcgcttctctcatctgctccgagcttctccgtcccaaccggggctgcttttctcttctccggagctcactgcttcgcccgcgtccctggccctgcggccggtcctctccggcccgcctttccccgtctggattccgccctcccctaacccctccctgccccggggtgggagaagtgtaggaaagcgcttccgagatggcgcctgtcaagtgagcccccagagcactaggcctagtactcagcgagcgatccccgagtgctcttcattgctagagagttatctacttccacgttcctgggatttccctccccctttcttacaactccttgccaactaagggacctgtgatggcggctgggaggaggactggaagggttctgtaggcagtaaagtgtacggcgtgtttcatcaggcaactgccaggctgtttttcagattgttcacatttctttttgtatgagtttcccatttatttcggcacgctaagtcttccatgctacgttcactaataaatgggtttgtccccttaaaaaattaatttctttactcaaatgtaacagaggtttttgaatataatttggaccaatgtggcagactgagagaaaagggtccaaattcatttatttcatccttgcagagatcaaagtgttatggtgttttgggtatttttcctgtgggcttgaattgtaccgggacctacttttttcctttgccgaaagctagagggccctgacacacctgagttccatcatcttggctataaggttagataaaagctgccaattttcctatccagatgaatttaaattgagtcacattaccaggcttctacccataagcattacattttcaaacactttttcagattggcagttgctgctggaagaaattgaagtgtgacttttgagaatcctaatagattgaatacatttagcatttaattaatatccttttgtggatctaagtccaactgacaagtaattttttataataatgtattctataacgttatttaatagtcaaaacctttctgttcagggaaggcttgagtttccctggcccctctctctgcctggtagatccactcaaaccccttgttgggagttttattagagtcgggaccctgaactctcagggataggacatgctggttttttgcttttttcttttttaatgaaatgtttatcacttctataataaactttttttggtatgagttgcttttcctagcaagttttatttccaagcacattatgtctaaagcaggttaaggtcaactgacaatttttatttcatacaattccaaccttccctgagtttgggagctaaaactatattactcaagaaaactacttccattctaaatgtccttaatataagagaaaatccattctatggcaacctcattttaaaaagctgtagttctaaaagatcatgcatacaggagcatttcttatttgtgaaatggcataagaatcaaagctagtttaggttttaaacatctggtttttaaacaaccagacctattattaactattaatattatagctttattatttttcatcttaatttactttttaccaagctctgtaaaggaaggtttttaaatatatgcctttaacttgcagggatctctaacaagtgatatgggtactatatgagaaataatcattaaatactaataagctttgaagttctcttacaggcccacttgaatactcagaatagctttgcaaggttagtgggaggatctttattacggataaagtagatgggtgatttgcctaatttagagtgatgttattaatcacaaatagcatttttagacttcctgaaatgtaccttttccatcttgcaaatagatcttgacgtattgtcctttcccaaagcaattctaaatttgagtatctaacattagcaaagtatttcaaattctttcaaggtttcattacttttttttttttttttcaggtgtccagtgatttggagaatattgacacaggagttaattctaaagttaagagtcatgtgactattaggcgaactgttttagaagaaattggaaatagagttacaaccagagcagcacaagtagctaaggtaacaatgatgaagactgaatgtgaatacagaggccgattctgtatagtgctgagtcccacaacgctggctgtcttgcgctattcatgtttctttttccttatagaaagctcagaacaccaaagttccagttcaacccaccaaaacaacaaatgtcaacaaacaactgaaacctactgcttctgtcaaaccagtacagatggaaaagttggctccaaaggtaggaagttctgaatttacaaacgtatttaatgaggtagcctgtttttagccagactacaagggtgcctttatcattgctgtaccttctaacgaacattcatagctggagctctgctttgaagcaatagtgtaggaaatgagtatatacaccttttaacttaataacattatgaccttgaagctgggcatggtggcttatgcctgtaatctcagcactttgagaggctgaggcaggaggatcgcctgaggccaggaattcaaggctgcaatgtgctataatggtgccactgcactctagcctggacagcggagcaagaccttgtctctgaaaaaaaaaaataaatattacgaccctgaataataaagttgattaccttaatacccaaataaaggacagaatggttcagaaaattcatggaatgagtgagatttttaggggtagagagaagatgatagctgacaggaaagggcacgtttgtggagaacaaagtagcaacaaagatcaaggtaccaaagcggatatggacctataatcatgtcctttcgttaaggagtctgaaagacttaactgagtcaggcggcttgagtgaggaaccagaagataaggctgggaagaaggttgcagttggatttgaaggacttggaatttggatttttatcccattaggcttgaggaaacaaagttttgaggagtaccgaaatgatgaaaacaatgtagggaggtaagttaggaggtattgcacttatccaagcaagagctgatgagggtctggagctagcccagatcttccctaagcgcctacccatacaccagtatcaatagtgggtatgaagaaacaacatcaaatgtgttaggatgtctcagaatgtctttcatcttgtatttaggaaagaatactttggacacatggcttgcactgcaggagtggtatccttacccacttggatattaaataaaccatttatgcaataaatgaacaaaaagtaggaaagtcaggagagggcggtagctttggtaaaggtatcctgtttggcttccgatttgttgaggtaaccgagggacatctgcctggaaatgcagttggaaatgtggcagcaacatctgaaggcaaggaacagatttgtcagctttcttcacagagatgatggttgaaagctctttgctctttatgagaactaaagcttagaaaaagtagttgagatgggacttcatttaaaaagccttccctagaaggtttctataacagtgacctcctgaaagccaaacccaaaggctggttttcagaccttgatctcttagcagttgtgcagtgttttacatgtgtaatggtttgaatgtggttcctcccacatcgcaggagggcgatttggcagtatatgtatatatttttggggggggacggagtcttgctctgtcgcccaggctgcagttcagtggctcgatctctgctaactgcaacctccgcctcccgggttcaagcgattctcctgtctcagcctcccgagtagctgggattacaggtgcatgctaccatgcccagctgattttcactatgttggcctggctggtctccaactcttgacctcaggtgatccacctgcccccgcccctcaaagtgctgggattacaggtgtgagccactgcgcctggcggtagtatatttcaaatggttattctccatacccagtagctttgttttttatccaaagaaaatgatcagagggataatcaagtacttttagatagtgctatgatgagtgtctcttatagagtagagaaataccctagttaaatccatttaaggaaatactatgcagccataaatatcatgttttagtagaatatttaaaggcatcaaaatgcttgtaacattaagtggaaaaatcagattataacaatatataaacagtgcaaccccagatttgcttttaaaatgtacatttgtatgcagaatattgatggtagttatttttgaatattatgttggacttaagattgactttcattttcttccttaaaacgtcaaactttggccgggtgcagtggctcacgcctgtaatcccagcactttgggaggccgaggcgggcggatcgcgaggtcaggagatcgagaccatcctggctaacacagtaaaaccccgtctctactaaaaatacaaaaaattagccgggcgaggtggtgggcgcctgtagtcccagctacttgggaggctgaggcaggagaatggcgtgaaccctgggggccggagcctgcagtgagccgagattgtgccactgcactccagcctgggcgacagcgagactctgtctcaaaaaacaacaacaacaaaacaagaacaaaaacaaaaaacttcaaacttttaccatgggtacatattactgttcaagttagagaagaagaaaagaaggcttttttttttctttttttaaaagcaaagaccataaatatgttactaaagaaacaaagggaaaaatagtttcctcctgtgacctccataacttcatcctttttgtgtttcctttactccttggctgactcctttttctcttgcttcctggcaaaattgaggccactgtttgagataaagcattatggacccgtagctcagttcatataaaaatcaattccagggttgaaacatatagctacatgttctagatttagaagttatgaggaattaatgaacaggaattatttccaattcaaatacatttccctctgagaaagtagtgaaggaatctctaagtccacgatttaggtagagtcccaccttctagcaggtgagtctctctgcctgcctgtctctggtcagccttctggcttttactttgtcatctgctttatctgcagggttatcactgttctttagagccaatccctggaggtgtggaaatgccacttgagtgcacaggtttctatcaattttcctggaaaggtgataacataagccatgtgtccatgataggagatgttcccagtcttctaaccaaatttatactatcctttttgcaaaactggagggcaggtttctttctctgtagcagttgacacaactgaatcacaaagtgccctggctgagacctcggaagagttccagccctttacaggtagtcatagaagcttattatcctgcaggttttggagaaaatggtgttttttgctgattaatgaggctttggtaaacacagtagttagaaaggacatggaaggctttctactagtcccatgtttgctggacactggggaaacaagttgaataaaccatcgattctgtctagaggagctcccagtcaagttggaggacataggagtagaagtatggctttatctgtcacaaagagagatgcatgcttatgagaggtactgaggagtcatagctagaacagattacctgaccagatgagtaggatcttagaaagggtcttacaataattaaattatgttggagttcaaaatgaatgctttcaaggaattctaaattaagggccagggcaagaatctttgtcttatcctagtggcttttgttgttgactgcttgattgatggagaagatctcactatgttgcccaggttggactcaaactcctgggcacaagcaatcctcccaccttgggcttccaaagtgcccggatcacagatgtgagccaccacgccaagcccttggtggcttttggatatggctaaactcagttgcacttctgaataggagccagaaaaatattctaaagtggtatgatagcacatgataacctctatctccttaaaccagactttttgttattgactgcccttccaggggtgggtgataatgcttatccttgaaaaagttaaccttcagctgaagctgcatatgcttattacaatgcaaatctgattctagtcacttgataaactccttcagtttttcaccttaacgtttggataaaatctaagcttctagaagctcggctgttgttcagcttttcagctcatcttctcatacctcacaggctatcctgctgacatctcaaatcaatttgcagttcccagaattgccttgattttctttggtttgcttttgcctgttcatcttccttaaggtcttaccgtctctggtaccctgggtacctctactcatttgttctagctccttgaggtttccaggttcccaaattctattctattcttttctttctttctttctttttttttttttttttgacagagtctcactctgtctctaggctggagtacagtggcataatcatgggtcactgcagttttgatctcctgggctcaggtgattctcccatttcagcctccaagtagttgggacaacaagtgtgcgccaccatgcctggctaatttttgtattttttgtagaggcgaggttttgccatgtttcccaagctggcctcaaactcctgagctgaagcaatccacctgcctcagccttccaaaatgctgggattacaggtgtgagccaccgcacttggcctgggttctcaaattcttgtataaatggcatgcatgcctgcatagttcttgctcacctggttcttcctcagtttaagacctttgatttaagaggggaggacatgttttaaactgtttttttgttttgttattgttgttattgatgcatcctcgaagactggaaattataatcattgagctttactgtaaattaaaattgtctttttttttttgagacagagtctcgctctgtcacccaggctggagtgcagtggtgtgatctccgctcactgcaacctctgcctcccaggttcaaacgattctcctgcctcagcctcctgagtagctgggattacaggtgtgtgacaccacaggcccagctaatttttgtatttttagtagagatggggtttcaccatgttggttaggctgatttcaaacttctgacctcgtgatccacccaccttggcctcccaaagtgctgggattataggcgtgagccaccaggcctggccgcctcctctttttaaaaaatattttattaccttaatatatatttgtatagcttagcatcttgttaggttttacttggagaagtactttttttttgaaagcattgatttggctgggtgcagtggctcaagcctgtaatcccaacactttgggaggccgaggtgggcggatcacaaggtcaggagatcgagaccatcctggctaacacggtgaaaccccgtctctactaaaaatacaaaaaattaggcgagtgtggtggaaggcgcctgtagtcccagctactccagaagctgaggcaggagaatggcgtgaacccgggaggcggaggttgcagtgagccaaggtcgtgccactgcactccagcctgggcgacagagcgagactccatctcaaaaaaaaaaacatttaaaaaagcaaagatttttttatctttcattaataaatacttgttttaactgctttataaatttttaatttgcataatttttataaataattacccagtcagcataggaaagtgaaatactgagttgtgaacttgctcagtcttcgctcccttctcctattttatttatagactgcaatatgcttttctcctttttagttgccagtttttcaatttagaataaattagttaaagagaagaaaacattatactgcagaagaggctgctactaaagtagaatgatcagctccagtaatctttgaacccaggtggtcaagtttcttccatttattgagcacctactacgtatcagggattatatagatgtttgaggtgccttagtgggcaaaaccaattaaataaacgtaagcttttagagcttacattctggcagaggtagacagaaaataatacacatactatataaactatagaattttagaagtataggtattatgagaaaaaacagaataatacacatataaactatagaatttagaagtataggctttatgagaaaaaacagaataatacacatattaactatagaattttagaagtataggttttatgagatgagacatatgggtagggtaggaggacagggattggaggcaggtgataattttgttttttgtttatttggttggttttgaggcggagtcttgttccgtccagcccaggctggagtgcagtggcgtgatcttggctcattgcaacctctgcctcagcctcctgagtagctgggactacaggggcgcaccatcacgcccagctagtttttgtatttttaaagtagagatggggttttgccatattggccaggctggtcttgaactccggggctcaagccatccacctgccttggcctcccaaagtgctagaattacaggcgtgagccaccgtgcatggcctgataattttaaataggagttaggatagaccccattgagaatgtaacatttaagtaaaacttgaagtaagggaattacccatatggacataggggcaagagcattctgggtaagaagaacctggcttgagtgaagcagtcaagggagagaagcaggagatgggtcagcgagggaactggggagggccagattatataaggtctgtaggccattgggaggacttaagttttcagtttgagtgaaattagagagttttaaacagagaagtgtctcttgaagaacttcacatactatatcttgaattattcacctcttggtatgaaatttgttgtgtctttaacatatttcagatgtgcgtatgatattgatatttaagccagttggctctgcatgtatttatggttaaggctgctcctacatgtgcctaaatttgttggtgtagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggtaggtgggcctttgtgttttggttgtataagcaatgtggaatttaccacacagctgggaagcaaacaaggtcagctttttaaacttttgattctacccacaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggtaggtgtggcttcagggacttcacgccagtggctcattgaacattgcatttatgcttgggggatagaaaactaaagtgggtacttctgaaaaaaagaccaaaaatcaaattgtgagaagccaaagaactttggggactaaaaagggaagtaatccaagtgtgtcaagcctttgatgatgcggaccaataatgggcatttctgtaaggccagccagctaaaaagtacttgggggaaatattgcattgccacaatccttcatcagaggaaatataccatcagttgggctgaaagtccatctgaagcctgtagtgcctttggatgctggttttctgggcctgcttgcacaatttccatagtttggtgctctggtgttaagtttcctcatctgaaaaacgatgagtttggctggagaacctccacatttccagccaactatgtcattgaatcactgtagaagaagaaggtggcagtatttgttttttttaaaggagcaggggttgtgtgtggagtggactgagaatgtagtgtaataaagagtaatataagaaaataagaggcaaacataatcttcagcatatttatgagtgggtaatgcacagcccctgacctgttagaagagacagcagatataaattgccagtgtgttatctaccaaacaatagccctgcagataaggttttatttatttaaagtcaacattcaggataggggtttaggtcaggcacaaattctgtccaaacaatgtaataaaaattactttacaataatgaccctgagatactacaaaatcccaggtagcatgcattcctctttgggcaggaaagcacaacagtattttaggtaggtttctttattttttatttttttgagacagggttttattctgttgttgcccacgctggagtgcagtgacacaatctgggctcactgtagcctcaatttcctgggttcaatcaatccttctacctcagcttcccaagtagctgggactataggcatatgctaccacgcccagctaagtttttgatttttttatagagatggggttttgccatgttgctcaggctggtctcgaactccttagctcaagtgatctgcccacctcggcctcccaaagtgttgggattataggcatgagccactgtgcccatccgtggtagatttttaataatgagagttgaagcaagaaaagtacagagtttgggaggaaaaaaaaaaagcaattaagggaaacgctttaccctagcctgagagtctgcctgactccaaagcattagcgaaagattttctaagctgaataatgggtatgcttttggtaaggattaaggaaatgagccatccattaaattctcacttttttctttggcctcatttctattcagaccatgtttagtgtgtcaggccagggctgccacagatactcaagtcagcatgaggttgtgggaagggtgactaggagcttggtattcaggcttggattcttcccttcttggcaattgaatgatcttggcatggtgtctgaatctgttctcaggacatctatttgtaattgaggaataaaatatgcctttcctagaatttttatgaggattgggtgagataatatgttagaatcttagcactgtgcctagcacacagtgctcaattacagatagctgtcatgatcagtggtagaacagtcaggtctcctgtgcccttatgagcaaagacaatgtgcacttttccaggacttggtttcctttccccttctcccacctaaagcttcactcttcttgttaggtgtgacttttgttacattaattttccattaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggtaagtgcctccagctctgtaagagactatttttgcttggtgtctcatcccagaaaccttgacctaatttaaggaaagcttatttataggacgcttcctttaggtaagtcttaatgctttcctcatcagttcttaagagaaaaggcctcatgatctatgtttacaacatagtgtggaatagagtaattcttgagaaggataagtgagtcaagtgaattggagttcctaggccttcacgcagaattttgcaagacagtaattacacttgtgattcttactatcccttgctgttctttcttaggttgatgttgaacagcacactttagccaagtatttgatggagctgactctcatcgactatgatatggtgcattatcatccttctaaggtagcagcagctgcttcctgcttgtctcagaaggttctaggacaaggaaaatgggtgagtggtggatttaagaagaaactaattaggctatattttagtccttcgtaatacaaaaggccttagcatttttacaacactatccttgaagcagttggttttgttttgtgtttttgagacagggtctcattctgtcacgtaggctggagtgtggtggtgccatcacagcccactgcagccttgacttcccaggctcaagtaatcctcctacctcagcctcccgagtagcagggactacaggcatgcatgaccatgcctcgctaatttttgtaaatttttttgtagagacagggttttgccatgttgtctaggctagccttgaactcggctcaagcagtctgcccaccttggcctcccaaagtgctaggatttcaggtgtgagccacagtgcctggcctgaagcaattgtttaaagtccaaagtcctaaaggaaaactacttggagaggggcatgggggcttgtgcttgtagttctagctacttgggaggctgagggaggaggatcatttgagcccaggcccaggagttcaagtctatcctggggaacacagagagacccttgtctcttgggaaagaaagcaagcaagctgcttggaacagttcacatagaagtgagttgactatacatactaaggtgcatgtgtgcagtatagagttgtacagaatgaggaaggccactaagaactgacatgtatgatttcttagatattacgttaagtgaaacaagcaagttgtcaagcacacaagacaaaggaaggccaaggcctgactgatttagccagtaagaatagaatgagccacttgtagatttagaagagtagccaaggatggcagctcctcgggtctttgtttcacatggcaaaaaggataatgtggaaacaaatggagctggatggctgcaatgcaagtcacaggtacactgttgtggagaagccagttctagaccaccgctaaacagtcttctagtctgcagttataccctgagagcagtacaatagaaaacctcatcagaacctaggggatacgaagctgtcttggccgggtgccatgccagtaatcccagcactttgggaagccaaggtgggcagatcacctgaggtcaggagtttgagaccagcctggccaacatggcaaaacccccgtctctactaaaaatacaaaaattagccaggcatggtggcagctgcctgtaatccaggctactctggaggcctaggcataagaatcacttgaacccggaagacaaaagttgctttgagccaagatcgtgctactgcactccagcctggcggacagggcgagactctgtctccaaaaaaaatataaaaaagaagaagttgtctcgtgacagcctcccaggggagatagggaggtgagtgggagatggctgggcggcagctctgcccacacctgccatctcctcctttttcaggaggatcacaaagcattttgccaggacagatcagctgtggttcaggccttggcctgtgtggcctatatggatataggcaaggtcaccagggcagcatggtggagctgttcacctaaacaatgtatattgtagtttacattttatgcaagaaagtgtgtgtatgtatatatatttatatatttgttaattttttggtacgggaggaataaaccagaaagaatgaaagtggaaactatggggttctttgggaatagggtggaggttgaggatgagaggacttctgattgtaaccttttattgactttataatacagtgtaacttttttgacttttgaacaatgtaaatattttatgcaaactttaaattgtaattaagtggaaataaacaatgtaactacatgtgaaattggtaacagaacacagaggaaagaattaatttaagtacttgttgcttgagcccagcctgggtagcgtagcaagacccccatctctataaaaaattaaaaaattagctgggtatggtggcacacacctgtagtcctagttactcaggaggctgaggcaggaggattgcttgagcccaggagttcaaggctgaagtagctatgatcctgccagtgcactccaacctgggcaacagagcaaaaccctgtctccaaaaaaaaaaaaaaaaacaaatctgtaacctgaacacagcattctgactgtgcatccttagtgggatttaaagtatgacaaaataaaggactaaagtggtaacatcaagtttacttagtaggttcattgttaatagtaatctgttattataattttggaactagtttatgtgtattgtaggataaaacaaatttattcatgttattaaggactaaaattttcaatataggaagagttttaaattattaattcattaattttttcttatacagggtcttgctttgtcatccaggctggagtgcagtgctgctgtcacagctcactgcagcctcaattgcctgggctcaagtgatcctcccacttcagcctcccacgtaactgggacccagccacacgccatcatgcctggctaattttaaagtttttttgtagagattagctctccctgtgttgcccaggctggtctcgaactcctaggctcaagtgatcttctcgccttggcctcccaaagtgctgggattacagacgtgagccactgtgcctggcctaagagagaaaatattaacaattaaaaacaaaaggttagtcctcacgtaggaaatagcaaaacaaaaacaaaggaaaacccctattatgttttggaaataacagcaaattcataataaagggtctcagaaacagtgacaactcagtagtagtgagcatatttagtgcccacatcttggatactaaataccattatctactggcaactagggctgtttagtgaaattgctgatttcagggctatggcaggggaagtacaaggtgagcctagaacaatttgtgccagatagcacacaaattctcaaagatcaatgaggtcacatcaaaaggacataggagagctggtcatggtagcatgtgcctatagtcccagatactcaggaggctgaggcaggatcccttgagcccaggagttggaggctgcattgacctatgattgcaccacaataaaataggaaggaagggaaggagggagataggaactggcttgaaaggactctggctgactgaattagagcattaaaaagaataatgacagtaatagattatagtgtataaaaaaaaggattcctgggaccataatgacataaaaaataaaagaggggttcatttttaaaaatcagaataccagctaattaaagtagaatgatagagttagaaaccactaattttcaacctgtaatgtaataatttattcaagcaaggtgcatcaatgaatgcaaaaatcattagatggaataattttgggaaacaagattcacgtggtctcaatttatcatcccatagatacttattaattctgtaacaaaactgcacatctatgatgaagtggtctggtggtttccaccttcacccagtgattaagctcagcattaccactggcagacgacctgagttgccatgccgtgttgtgcagtaagatgtatacattatcacctattcatgcccaaaatgtttgacatgaattaaatcttgaggaaatatgcaaatccagaatgtgagacattttaaaaggaactgcctcgatgcttaaaaaaaaaaagtcactggtgacagtgtttcttatgtgagaatggtgttatggataggtacgaaaacgtactttttagaatatgcttctgaaacatttagcagggaagtgctgtgatatctgcaaatcgctttcaaatggcatagcaaaaattgtgtgtgagtatacacagagagggagaggagggaaacgtggcacatgttcatgattgatcagtctacatgaaggatatatagaggatcattctttcagtttttctgtagatttggaattttttgaaataaataaaacatttgaggcaaaaatgtcactggtacatggtaccaatggctcatttttagtcaccttactcttaaatgtgcttcgctctcccagttttctgagaatttatttcaaaaggctagaaattgtgcattatttcagtttttactcgtttcctctttcttcccttcaaagtattttaggattaaattgtgtagactgggcacagtggctcacacctgtagtttcagcagttttggaggctgaggcagacagattgcttgagcccagcagtttgagaccagctgggcaacatggcgaaacctcgcctccacaaaaaaacagagaaactggctgggcgcagtggctcatgcctgtagtcccagcactttgggaggctgaggcgggtggatcacttgaggccaggagtttgagaccagcctagccaacatggtaaaactctgtctctattaaaaatacaaaaattagctgggcgtggtggcacatgcctgtagtctcagctacccaggaggctgagacacgagaattgcctaaacccggaaggtagacgttgcagtgagcagacattgcaccactgcactccagcctgggcgacagaatgagactctgtctcaaaaaaaaaaaaaaaaaaaaaaaaaaaaaaggagaaattacccaggcatggtggcatacacctatagtttcagctactagggaggttgaggtgggaggatcacttgagcccaggatgtcacggctgcagtgagctttgatagtgccactgcactccagcctgggcaacagagttgagacccggtcttcaaagaaaaaaagagattaaattgtggtttattttgccaattataccatgcatatgaaaaaaacgtactttcgcttttagaatttttgtcacagaactcttaaataaagtcagttgacatatctttttttttttttttttttttttttgagacagagtctttctctgtcacccagactggagtgcagtggtgcgatctcagctcactgcagcctctgcctcccgggttccagcgattctcctgcctcaggcgcacaccaccatgcccggggaatttatgtatttttagtagagatggggtttcaccatgttggtcaggctggtctcgaactcctgacctcaggtgatccgcccacctcggcctcccaaagtgttgggattacaggcgtgagccactgcgcctggccttttttttttttctttttttttcttttttttttgagacagggtctcactgtgttgcccaggctggagtgcaatggcgttaatatcgctcattacctcaaacttctgggctcaagcaatccttcctcctcagctcctcaagtaactgggactataggtgtacaccaccaagcttggctaatttttcatttttcatagagatagggtctcccaatgttacccaagctggtctgaaactcttaagctcaagcgatcttcttgccttggcctccgaaagtgctgggattataggcgtgagccactgtgccccgccaatttatatatcttcttacatgatacatcttattatcaattgacagctgttcttttacttgaattttactctttgggaggctaggtcacaaggcttggtgtggtagtgtctaagttctctctgctgtttggtgcttaactacacagggttcaacaagagaatcataggtagtcctagttcttctggatttgatagattgttgcttgtagcacagtttatttcttatttccgaacatctttccctgactgacagtatgtctgtttgggctcttgagctcataacagggacagctgggcagggctttgatgcagggttgtgtgagatgtggccagcactgtaaaggggcactttgttttaagtgtctccttttccatcccctttcagtgttgttacttgaaggactcttacctgtgcaacgtctttgaaagatcgtatgggacctttggcacttgatttagtctggtctcagggccagaatcatcttgcatttaccagctgctttagtgttgctggtactgtgagagtggttagggctttgattgaatttccagaaggtaagaatattcttgtacagcttttacataagtaatgtcatcatgtacaagatgtgttcttctaaagaagcagaggttttctcttgcccctcagtcatgtctgtctgtctgcttcttgtgtttcagaacttaaagcagcagtattacacaggatacacagagaatgaagtattggaagtcatgcagcacatggccaagaatgtggtgaaagtaaatgaaaacttaactaaattcatcgtaagtactactgttttcttaagctgtggaaagctttaggttctgggttttgtgtgtatgttgggcgggggggggcggtgtgtgccgtcatgtaaatatattaataacatgtgggagttttagcacaaatcctttatcctttatatttttctggtacagtatggtatggagcatactgataaaccctgaaagcaagctttatttgaaacaaggtcgataggctagccatgtccaggcccagatcccagtcaaccagtcggttactcaatgtattgaattactctgtgcttatactagcatcctggggagggcactttgcaagcagggaaggctggtctgcatgtgattgggaagagagagggcccacttcaaatggcggtgtattatattgcgtattcaggtgatgttactcagagcctttgtccagggtcttttgaggcaatgatggaaaaacgcctaattagcaagcatggttaagagggaagaggcccattcagggggcatcctgagggcatggtgtctatctctgcatggcccacctatgaggaggagccaaaggagacttagtgctgtcctgtgcttgtgtgacaccaaacatcagagctcaccaagtgtgtggtggcaaagagcaaggtatttgaacctcagaagagtctcaagtgtcctcacaacatgatttgcttcatggaagtgtaatatgtgttcagtcctgagaggactgtctgggatttgttaagcactagttgccaccctcttttattgtcttttattgtcttttaattgttcctattgctgccaggcctggtgaacctgttatgtcctgatggcacttaggtgtcgtaaacacagctccccctcccatccctctggtagcctacaagaggaagcctgctacttggaccttgaaatcatttgttcctatcacctgtgctaccagctgtgttttattcattaatggggatggaaggaaatggtcaggcacatgttatgagcccagagctttcactggcttcagcgattgggcatcatcaatgtgatcatgattgtagccgtggacctttgataattgtgagttagactaggaataaggtatcattgggggttcctgacatgtgcttaatcacaaatgacttctgcaggccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggtatcccatgtgtatttatttgtgtattctgtacttaagaaatcagtgaaagcttgctttgactaatttctttttgagctgttatgaatagcatgtaaattactgccattatggcttgggcaagacctttttaccattttctcaaatggaaaaaactagaacttggcctcagtgaacactaaacctattcctaagcttcttgaatacaaataagtttattatgaaaattttaaatgggaggataaccatgacactttcctttctagaagctagtcagctgctctctaattcctgcataggaacgcctggcccagagcaacccttgtaatgggtccctctctcaaatgcattgttgagaccagagagagccatcccatgggtcacagctggagaaaatgggcccgtggcatcctgttcaaggtgaagcttggcatgcattttttcaggtacattatggggtaaatggctttgcatttttttgtttggttggtttttaatgggcattgaactttttttttttttaattgaagttctggggtacatgtgcagaacatgcaggtttgttacataagtatacatgtgccatggtggtttgctgcacccatcaccctgtcatctacattaggtatttctcctaatgctatctctcccttagtcccccaccccgtgacaggcccctggcaggggttttcccctccatgtgtccatgtattctcattgttcaactcccatttatgagtgagaacatgaagcgtttggttttctgttcttgtgttagtttgctgagaatgatggtttccagcttcatccgtgttcctgcagaggacatgaattcatccttttttatggttgcatagtattccatggtgtatatgtgccacattttctttatccagtctgtcactgatgggcatttgggctggttccaagtccttgctattgtgaacagtgtcgcaataaacatatgtgtgcatgtgtctttatagtagaatgatttataattctttgggtatatacccagtaatgggattgctggctcaaatggtatttctagttctagatccttaaggaatcaccacactgtcttccacaatggttgaactaatttacactcgcaccaacagtgtaaaagtattcctatttctccacatcctctccagcatctgttgttccctgacattttaatgatcgccattctaactggcatgagatggtatctcattgtggtttggatttgcatttctctaatgaccagtgatgatgagcattttttcatatgtttgttgactgcataaatgtcttctttggagaagtatctgttcatatcctttgtctactttttgatgtttttttttttttcttgtaaatttgtttaagttctttgtggcctctggatagtagccctgtgtcagatggatagatggcaaaaattttctcccattctgtaggctgcctgttcactctgatggtagtttcttttgctgtgcagaaaccctttagtttaattcaatcccatttgtcaattgtggctttgttgccattgcttttggtgatttagctatgaagtctttgcccatgtctatgtcctgaatggtattgcctaggttttcttctagggttttaatggttttaggtcttacatttaagtctttaatccatcttgagttaatttttgtaaaaggtataccagtataagggatcccgtttcagctttctaaatatggctagccagttttcccaacaccatttattaaatagggattcctttccccattgcttgttgttgtcaggtttgtcaaagttcagatggttgtagatgtgtgctgatatttctgaggcctctgttctgttccattggactatatatctgttttggtaccagtaccatgccgttttggttactgtagccttgtagtatagtttgaagtcaggtagcatgttgcctccagctttgttctttttgcttaggattgtcttggctatgcggcctcttttttggttccatatgaa

SEQ ID NO: 16100 - DNA, 30054 bp, Human
cccactcatctctttttgctgattctgcctacaggttttccctcctgttacagtaatggacactcaacaacacatacccttcccagcaacctgtcctgctggaaaactactcgataaggtaacttctgcctgaaggggaccagggtcatcatacccgcaagtgcagcatcttcctgcagctctcatactaccaagctggggtttttccaacataaacattacaggtgctaaacgagaggtggcttcctttctcaataagctgttctctctctcggatgcccttgacagagccctgcagcctcccccactggggcttggtggataggtggtcgcttctcccccgaatttcaggaatgtttaggtttgcacaggtcctgcaggcgagcttggagaaggattagaaaaatgctcattcttaatcagttcgggcttgtctttatgccagcgaggttgaccttggggacagaagggtggccaggataaggacaagcatcctggtattggggaattctctgatatggggctgggacgtcaagatgggccatgatggcccctggggatagggcttctctgcagtggaagcagaagcatcccggtgttttctgctgtgtcactgtcctcagagggatgtataaagctgcttgggggctcataggagagggatgaaaccaagagtttggctttccagcaacagcggacaaagagtgggaaggggtactctatgccccaggtctgcaacatcttgccctatgcgctaggttttcccaaaggtcctttggctccaagaattttacagcagaacaaagggatcgatacccccaagggggcataaaagcatgccaatgagaatacccgccgccgaccgggcaccaagaaagtcctcggtggctgggtcacgtgcagatattgttgcctggggtctagactggcctgagtctcaattggtttctacgggacaactcactgcgggctaccgccctgggtgggtttggcaattgtcctgctcgaggtggttcaggccgcccacaaggggcacagccgggcagtcaggaaccggggctgccggctgggctggcctgcaaagaagagggaagggccggaactgcaaccgcagtggcggggagtgcgagggggcggcaggtgcaggagcgggaggcggggcggagctgggcagagtcctcgccagtccggcgtcccggagtgaccttcccccaccccgccagcgcccaggaggggtggacccacagcccagggaggccgaaagcgcgggcgggcaggcagaggcgtggaggctgggccaggactgccgggctggggtcctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagccaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtgtaagtacggggtccgcagctcccggccgccgcgtctgatctttcccgggcggcgcatcccctgcgcagggtccgcggccggttccgcacccaccgcgctggccggggtggcgggggcgagggtggtggacgctgctgggtcgcgccggcctgggcttgcagtcctgtgcggaatgcggtgtccccagagtggggcgcagggtcggggctggaacacgacaggcggaaggttatgcatatcgtagcgatcttggcttggtaatttgcagtctttcctaccgtgcatcggttgagccttttactcctgggaatagtcaggctctgcgagactacatttgtctctcccgtgtcctgagtccttaaaaaaaaaatgagatctggggtcttgagagaacctcgtgaggtgatgggatctaatgcagacgaggttgtgtgttacagcatctttcttctagtctaaatacgtatctcaaaagagaggaaagagaagggtggagaggaatccatccacactgtagtatttcacagcgatggctaaggatttccctccatgacctcccctggagtcatcaccacccagaaatggttcaataagctccatttcaggactccgattcttagctttggcccgaaacctggcaaagtctggttgttttcaaggtctacacagacagttgtggatcagtcagtaggttgggttgattatggtgaagggaatataaacgcagagcagctgatcttaaaatattttgtgcagcctgttgcttggttggatagacttttttccatcgaaaattagatttcttgttttcagcctctccggaaaggtgactttttttttttttaaaaaaaggtcattttgaagggcagagttgtaggcgaatctatgagtcgtgactgcgtgagggaaggagggagggaactccccctgctgcatcactgccccctcctcctccaacatcattcatcatcatcatcatcatcatgaccatcaccaccaacaccactggcaccaccactgcagtcattcagggagtcctgaacagaggccgattggtgttcctgcttgggaggatctgtgggaatcggcaggagaatgagtcagggaaatagtgcttagctgacattttgaaatggaagaagctggaatatatgaatttttgtaaagaaaaaaaaatgcagcctgtgagtctctcttgattgaaaattaaagggttaataatgcatcacacttcaaggttagtcaaggtgaagcgtctttccaaggtgttactgggaagcataggtatccctgagccatggaaaatgtagttctttaatggcttttagcttttgttttatattttattttggggagacttcttcattgagattattgtcatagtgtctcaggcataaaggtagtttcctgtgttttactgtggaaaggaaaacctgaagaactgtggggtgtgtgtagaatgaacagctccctggcaactccttgtaacttgagggaggcctggaaggtgcactgcggtatgggcacccttctccccaggttagctggggcttccttctctggtggtctgaccctgctgcgtcacaggggcaggggctgcattgactctaggcacattgtgaaatttgccttcttgtctttttccccttagtataatatgcatctttgctcattccagtttcatgcttctcagaataatacttgctttagagggtaaggcagtatggactgactcatttttaagccgacatttaatgggcagcacctccatgagagagagaaagagagaccgtgtgtgtcaatttttatgtcttgatatcctatccagcaagctatcagtatgctgatttgtgaatgtagacccaggactgctgtacttgcctcctcttcccttccatgttccacggtacaggtgctgggctaaaaatcccctttttgttttgtgctaatatgtctgcccctttctggcagtgtaaaaactgtcagagcctctcttaggtagaaaaggcggcagcaattaccgtctcctacggagaaaatgccccttttccagcactgggcccaacatggatgcccttggggcgagggcaggatgcccttggctcgattttgcttataggtagattttcaccaagatggacgcaggagactcgcctgtcacctgctggagaaatcacagcatgcaaatcactttgtgccttctgcctttttattaggttaatacagacattggtaggttttatatttacagctaggcctggatgcctgcctgtgaccttttgaagggtacacactgtttgtttgttcatttgtttgtttttccaaaaaaacctctgtattacttttttttaaaagaagaaaaattgcgtgaaagggagatgcctctgaagcctctcagctcccctcacagtgccaccccagatagttggtgtgacttatctagccttttttttggctagtggggagcccctggtggcctgtgtctgagtgagccactgcataggcccctctagtcctgagtgctccactctctcccagtgacctcacggcagtaactagggagattttatcaactaacatctcagagcaaaaagggaaaattcctcacttttcttaggatatcgtgtgggcagaatagaaaggctgtctgtttctgagcttaatcggcgtacttgcaaaatgacttgtttttccattgctcttatttgtattttaaactgtagcctcaattatgtaccctcttatgttgttagaattaggcatctggagtccagggaatgagtatagagatgtttcagttgttcgaaggggcacatgtaggtaaggtaagagcaccaagatgaggtgggggtggggggcagcaagaggaaacttgaatcagggctacgatagctgccttgctgactgttacaccaactcttgcacctcttaggagcattcactggaaaaattttccagatctcttgacgtcacagcgttgccatttgcctactgctgcttggatacagaatgcagcacttaacccttgtcctgcggggagggagtgattgagttgggtgctgtagttctggattacacaaccttttctttcttccttatctttacttctgtctttgcttttttccttgttatttgcttttgatagaggagaaaaaggattatgattaagcattttgctgtggttttgtgtgttttgcttgttttaacagctctgtagcctgatttcctttaactgtttagtgcctgataggaaagttgggcttttaaatgtatggacagggcaacaaggctaattcctgcagttgtgtacccactccctccctggccccctcctaccacatatacttcttttcaataatactgtttttcagtggcttttctccaagtaccctggcatttttaatgcatgagatctggacctttttagcagtaacctaaggctcctttgtgcagtcgtgcttctgactcgataaccttacagttcacttgttccctgttttgcattcacattgagtcgtttggctggcacaggactgccaggcaatgcctagtacagcctgttactatgcagctaatcagggagataatccttgtaaaccagtaactgatagccaccctcattcccatctatgtgttgagtctttttttttttttttttttgcttttgcagctatttcagcctccatcctgttgtcttgttaactatgggaaaaagaaaatgcagcccagcaagtcagtcattattcttgttccagttccagaagatggaattaaaatgtgctggtcattttcactatagaattttctttttttccccttgtcttgtcctccgaggggaaagagtgtgctttgttgataatacaaaccaaagggagagtgatagtaaaaaaaacaggaggatatcatcactgggtttctcaggattcattgctctgccatagcaaaataaccctcaggcatctgagcatttggagaaacagcagagcttggattgtagtatttaaatgtcaagggatatgcaagcaaagaaaacataggtctctaagggagtatactgtcatattttaaattcattgcataagcatccaaacatagctctagattttattggtgatcttcatgattttttttataattttgagaataaaaaatatggatactttttttaaaatttagggaataaaaaaatataaggatcctagttctagctgaacattcctcctacccttaaccacctcccatacacactgcaagtggagggctgcccagcctctcgattttcaccctgtgtcagtggggtgaggtgcactcttgacgttggacaaggaagaaatcatgggaccgggggaaccaggaaggaagcttgttcatccgtgggaagattaaactttcattctgagcatatgactgcatcacagctttttgtttctgttcttcttgcagttaagatccttctattctacgtaatattttatggctgcctggctggcatcttcatcggaaccatccaagtgatgctgctcaccatcagtgaatttaagcccacatatcaggaccgagtggccccgccaggtaaaatccacatgaatagcttcatttccttcagagatagcatgggtgtcactttttctattgagaaaaaattctttggaaaattactctataatgtagttttaaagcaaccatgaaaagggaaaagagaaacttctctcggctgcagccagatgtcctacccgcattgcaggcagagctcccacgggttgcagacatcttatttgcccagttctagagtgagggtgaagcgtcctggttcttggccagcctgctacccaccagctatgtgactgtgaacagattgagttctgatgggggcctctgtcttctcatttttcatattctagggtttggttagtgggatcctttccagaccttttcaactctaacagacatttttttacttcttgaggggggctatgactcaggtaaattcttttaaaaaagtcacttgggctcctgttttaaaaggtgaacttatttttagagatgataagaagctgtggaatgggcagctactcacagggagaggagccatgactttaggggtctattgtcccacctgctgttaatttgcagtttgagcttgaacaaagtcactcttacttctcaatatttatacccattgatttaataagcatctcatttgccagctttctggtcccactttgtagtttaattaactgtctcctttagctcttaaaaacttgggtgaacaaaaagattatcataagaaatgcaaactgccacacgagtccctgctgtgacttgggtgccatcagtgtagagctatgtgtgtccacaccagtcgtgaaaggcccatggccatcatgcctgatgctgataggacaaggcagtggaatagccacaaacgtgaatttaccatctggctgttgtaaaaatcattgtctggaggacctagagagaaagtgttgcataacttccgggctctcacttacgaatgaccttgaagctgctgctgagggatggcaatgacttgtcccttctctgctttcccttggcaaaggtttagtaacagctgtatttaggtgacaatcttcagatgatctacgtggccctgagcagcctagatcaagggctactgcctgccacaggcttttcctgcgtacctccttgaatgtgggaaggattcacagaggaagatcttcaaaatacggaggtggcaagcattgttgtgtagccctaagtcaaatagttctccactgtaagaaaaactcaaaatatttccagataaatttagagctgagggattggggaagtggaaaaaaaaaatcacgtaagtaaataacataacttaaacctgcttaataatccagtttccagcaactgttttccacaagaggtgggtctgtggaaaggttgaagcaagaattctggagtatgcagagaagctgaaacatgttttacgttgggtatggtgatagggaagcattgtgtcttttcatgtcctcttctgctagaactttgtggtaccattagttgtaattttaattggtgcggatattttgtttttgttctttgttatgccatttaaaagttattcttccatcatgatgtgattttataattcttttttttttttgagacagagttttgctctgtcacctaggctggagtgcagtggcgcaatctcggctcactgcagtctccgcctctcaggttcaagcgattctcctgtctcagcctcccaaatagctgggattataggcatgcaccaccatgcctggctaatttttgtatttttagtagagacaaggtttcaccatgttggccaggctggtctcgaactcctggcctcaggtgatccacccacttcggcctcccaaagtgctgggaggtgtgagcatgagctaccatgcctggcctgctgctgttttataattcttatactcaaagccaaatacgactacaaagtcaaatattttcttcaggaaatttcctagattaaaaaaaaaaatggtccttgactatataaactttgaggagtcagcctttaatgaaactaaaaattctctttgtgccctttgcagaaaggaaaatttaactttggaaaagaaatagccaaagggcccaaccttgtaagtaaggacttggaaatgaccttgcctgtaaatcaactggctgaagtgctcagtcctttccaacaccctctcacggtgcctcccttcccttccttccatccccttcctaaaagacatgttcttagtacctatatttagtgtgctcacagcagttggactgacctgacaaaccctgacttctccaaaggaatgctggtggctcatcttggaaaaatgcattcctgtcctgtggtctgagtcacaggaaaagtcctcagtcctccatcttccttgttctttggcctggtaatttctgtctcttcttttcctcatcccttcccccatcacctttcaggagagtctaggccaggcccctcctcttcacctgccttaccctgtggggtttttcgggggcctttaccaagggacatgacattcatatgaaaatgacagtaaccttgatcaggccaggccagcagagtgccgaaccttgatcaggccaggccagcagagtgccggctgccacaaagtgcagctcttgggccaccccttatggccctgtgttgcctgaggaccctccttggcatttttcaatgccaaggaccctccttggcatttttcagagtacgtgttagaagtttgtattttgcataggaaataactccttaagtatgcagacaaacagtgtgtttaagaataccctgacaattttttggcttcacattagtatctttaaagcctccattttcatgtttagttaaagagggaaaattgtaaatttgagttagatacacctagtgggtgtgaaagtttgcatatgatttaaagatataaagacttactaataatattatcagctgaatttgaggcatgaatgcaaatccagcctgactgggtattgactgccctttgtacaccggaataccttgtagttggatctcttctcaataacgtgtgaatgtggccatatcaagcagtggcaattgtgcagtgagtgtatttgggcctgtatggcgataatattggataaactgagaggccaaacatgaaatctgagaggagagactaaactacagaatggaagtgaaatgtaagaaaaaatggtgaatgtgtacagcttcttggccctgaacaatggtggccgtttaatgcacatgatattccttacaaagtcgtgttgcagccggtgtggtagctcatgcctgtaatcccagcactttgagagactgaggcaggaggatcctttgaaggcaggggttcaagaccagcctgggcaacatagcaagaccccatatccacacacacacaaaaaatttttttaagtctcctgttaaaaaaaaaggggtggggccaggagtggtgactcacgtctgtaatcccagcacttccgaggcaggcggatcatgaggtcaggagatcgagaccattctggctaacacagtgaaactccgtctctactaaaaaatacaaaaaattagcctgtcgtagtggcgggcacctgtagtcccagctactcggaaggctgaggcaggagaatggcgtgaacccgggaggcggagcttgcagtgagccgaaattgtgccattgcactccagcctgggtgacagagcgaagactccatctcaaaaaaaaaaaaagaaaaaaaaagggggtggggaatcatatgttctgtgagaactaaatgagatgataaacatatataaagcaaatagtactttatggtggcaaaaccaatggtattaagtgtagggtaactgttgagagcaacttctgtttttttctttttttcttttttttttttttcaagagggagtcttcttctgtcgcccaggctggagtgcagtggcatgatcttggctcactgcaacctctgccccctgggttcaagcgattctcctgcctcagcctcccgagtagctggggctacaggtgcgcgccaccatgcccagctaatttttgtatttttagtagagatggggtttcaccatattggtcaggttggtgtcaaactcctgacctctggtgatccacccgcctcagcctcccaaagtgctgggattacaggcgtgagccaccgcacctggtccagggtttttatagccctatctttctactagaagcagcagtttcttctttttggacactaaatttccagatatgacagggatgctttgcacacttagattttcatggagtcaataaaaccttagctttccatggaaatgtttaagagacatttgggaaacatgtttttaaaaattttaaagtgaatttaaatggcattgtatttgttgtgcagtctctccctttaacaaacccatgcttgttgggttagcgcctgccaagcttttctccagaggagacccccttaggcagtcctgcagtgctgctctgcagcatcgcttctcatctgttgatgcagttggatctggggagagacgcagcaattagctatgctggagagggctgagcaggcacaggcacgcacacccacgtgcatgcccacggacatgcaagcgtgcacacacacgcatgctcatggatatacacacacactcaggctaccaagccctggccctgatttgaccctgcttgccttgctgcctgcccagtggtgtaatggaaaagtctcttcttcacatccgccattgcccttcccccacctcaggctcacttagcaacagtggagtgaaatgaaggtcactgtgtgtcaatcggtgggtccgggagattcccagctggcttgcttcctggtaggcaggtatgaatgtatgctgctgttctctcttttaaggttgtgggtggctgtttgtttagctctgaagtatagacggctcagtgctagcagacacattttcaaagggtcatattcttggcttgttggtaatcagaatcgggcaggagaagtggggtggatgcagaccagctgaccacactggcaccaccagcagtttcagtttcatcttgattgtaaagaggaaatatctaatcttaaaactcattaggggcctggcgcagtggctcatacctgtattcccagcactttgggaggccgaggcaggcagatcacccgaggtcaggattttgagaccagcctggccaacatggtgaaaccccatctctactaaaaatacaaaacttagctaggcgtgatggcaggcacctctaatcccagttacttgggaggctgaggcaggagaatcacttgaacccggaaggcagacgttgcagtgagccaagatcgtgccactgcactccagcctgggcaactagagcaagactccatctaaaaaaaaaaaaaccaaaaacaaaacaaacaaaaaacccattagggttcgagtcattatcattctatctcagcttgattaagtaaaattcctgagaagtcattatgtcagtctcagaatacctaatttttccaccccccgcaaactacctcatacttgtattactatctgtcactcacacttcaaaggagaaataaggggaaattagaaacatttggcttccttatactttggaggggttgttagtgcaaagtgccagtaaggtgtttccagttagaatacactgctttgtaatctctcagctgacgcgatgtatctgtatacacccagctgtctctcactttccctctcctcctcccttcccaccctcaaatggatcctgtctacctggtcccagaatttgtggatgagttagcattggtggcaattagatttccaaaagctactgcacagccttatgacttggtaaagggtttgtggggggaactctgtttggcttcaacaactcaactacccaggtggtgatttctttatttctaaagacaagggtacaactagtaagtcatctcttgggtacacaggaaacctaatgatttactttaaaatgttcttggagccacagaaaaacagatcttacattgtatgcccattgtatgatgaataagcagaacagagacctgataagtaggaaggaccaggtaacaaatctgtgggagtgatggtgggggaaaaaaaaaagctggatttgtgaagcttcatttaaggattttttgctgcattcacccaagggtcatagaaagtggggtggaaagagcagtagcctgacaggtccacttctaccataaaatctgatggggttattggactggttgctcttaactgttggtcagtgctctcatgctagtaatctgatgaccagctggtctgtcggatgcagtcaagactagtgagaagctggggagatgaagggaacagggatgtatcatccagctttttcccacatacatgcatgagtagatcttatcaaatgtcatgtagaatgcagtgtcttgtttcaggatattacttaacaaatgttatgttttatatctagataagtcaaatatactatatgtacttgctcttcagtttggccttgagcataattaatgtaaaatactaggatttatctatttgtttatgttattcttttataaaagtggcacctttcctttattgtattgagaataagcacaattatgagctatacaaaataccaaggatttgcccctatggaatatgcatttttaaagataggtcaactgaactaaataactccctgcttgcctgaaagtgaatatacagccacaggaagaagaggacggatcagagaagagcctaaatcagagttcacggcatttagcttagacaggaggaatgatttctttaccctgagtgttggtaaacatccagattggctgtagagacagtccggggattcagttttctaagactttgtaaagggagcagattctgagtgtcggagggtgtgaatgtgaccctgcctgcaggcagggagatttattccttgctaatctcagagcctgagtctgggagctggaggcagaaggtgagtcaaaggtggctagtttccagaaagtgcaaaggcgccttttttctgtgcctctccccttactttgctaggtaagttgataccaactcacagatgtaaaacaaaaataaacaaacaaaatccagaaatatcttaggtcctacagagtggcacttaaaggagaaatttctatctcatatatgtgcgtatgcatacatatgtgtgtgtttatgtgtacatatacgtgtgagtatgtatgaattcatacctctgtgtattttttttaaaattggaaattacttttcaactcggaatgtataggagacacatgatttgtgcatggctacatttaaaagcatttctttgcttcctgtgcccttctcagtcatatgggtaccttcctggaggtttccatgggaaatgattcctatttagagatttgatctagtgatttatcagatgtattaaatgacaggtgcaagcagctgtgcatttgaataacttacaaggttgaaatggctacattctagtttaaatactttaaactcacatgtagattgagaaatgatgaacttgctacattataaacctaaagaaacaaaatcctttccctcaagccttttcccccttgtgctatcaacacttactaaagctaaacatggaggatcttccttatttctcaagagatggggaccaaaggcaggtaaatgtgtctttgaaaagcaagtgggaagccagaagttttttctaaatctaaatcttatgtaaagttgaaatactcattgaaaaccaaatattaaaattttacatacccagattatgatttctgcctcttcaagtggctttgttaattaatgatatatagcttaaggcaaatgatcctatcagaacaaagctgtctctagagctcagggtggttaatgtaaattcaagtttagaagactggagagggaaaaggttagatttgtttcctggaatataacttgaaattgcgtgccagcgattgggtgttctgctgtctttggccctctgggagttaccagtgcaaacagagctcatccttgtccagagtcataactaacaactttaagaagtgggcagtagaaagaggggcatgatgggagaaagcgtctggtctagtgtgaaatatgactcatgagaactccagtcagcaaggtgggatttgtgcagcccttggagaatgtcatggttggagaatttgggtgtggcctcaaaatgcagatgctcttcgatttaggatggggttatgttctagtaacccattgtaagtcgaaaatactgtgagtcaaaaatgcatttactaaccctgctaaacccactgtgaagctgaaaaatcataaggcaaacattgtaagttgggaactgtctgtaataattaccaaatccaatcccattgctttctatctcttcttaacagtctgataatcctaaagtaaatgatttaaaggatttggacatcctttcaaaggtctttcatctttctcttgtgagtatctagttgctttagagaaataacttgagaagaggaatttttctaatctttggagaagacctcatcaaaaactgtcctaattaagactatccagaacagaacagacccgggggctgatctgtggtaatttccaggagaagttctcaggccatcaggcttcggataaagaaaagagaggaggcagagatagtgggtgatggagtgagagaccttgtggaaatgtgaggaaagagagcagaagagctactaaggaggcagcggccacttgactgtggcgtggcctcctggacatttgtttatgtagtaagcatgtgtgagctgattgcatgacctaaacccagaccatctgtttttttactggaaatgacgtttggatcaaaagctctgtatcttaaatgaatggtcattaaggcttatgttagttaccaccgtctaagacccctcagactccagagggaaacatgagctcacaaaacagtaagacatgactgagctttctggggtttatctgtcattcctcggctccttctaccaaggttctctgttacttaaaatggaaaggacagggcagaggctttggcctagggtctaatccagctgggcaagtcacagggttctaagactccgtgcttagctgtcttatgtttcaccccttgctttcttggtttcactagtttctgatgcttctgtaagagcaaagtcaagattcttcaagcagcctgcatctatgtttccctcacaaagtaattataaacttgactggcttagatcatgagctatgcttactgaaaaatttgggctttcaggttgaaagggatgtgattccattacttggttttcattatttcttatttgccccgtctagagagacatgaggccaattgtgtatataactctcttctgggccagtagtaccacttcatgtaacagtaatacctattattttcacaaatgtgatcttagatattttttttctttctctttttcttttcttttcttttttttttttttttgagacagagtctcgctctgttgcccaggctggagtgcagtggtgctgtctcagctcactgcaacctctgcctcttgggctcaagcgattctcgtgcctcagcctcccaagtagctgggattacaggcatgtgctactatgcctggctaattttgtgtttttagtagagatggggtttcaccatgttggccaggctggtctcgaactcctggcctcaagtgatccacccaactcatcctcccaaagttctgggattacaggcattagccaccattcccggccatattcctagatgattaacaacagaggcacttacaagaaagatttgtcatagtctatcagtaaacatgaacttagttttggtcatagcccctaggctcctggggaatgcactagccttatcattttgttagtaaagagcccagaggactgagtgagagttgctgatgttttgagtctgacacatgtcccctggtcacttttaatagtggaaaccgtggacttgacatcgtgaaggaatgaaaagcgctcagcataatacctcctcctgttcttactctccttttttttgtgtgggagaatctgagaaatggcatcactattcctcatactcatatcaaagtaatggaaccttgagcagccactggaagagagaatgcaagcagccagaaagtgagaggcaaaccactggagaggctcactgaagccaggccagggagaacaaggatgtttgtgacacttgcttcgcaatccaggttttaccatgtttactctcaacatgaccttctagggtcactcctcctttcagcttgttaggtgagactctccaaatctcagtatcaggcttgtttatattttggcttttgctgcatcccgccctctgctgatggaccacagcttgcataattgttgtttatcacaccaatgtccctatggtcccctggctgtgggtcttcccctgaccttccctgaaggtcagatgagatccctccttggtttctgacatttgctctccttcacttgtctagccatccaccaccctcctgccttgtctttcccaagcctggaaacactgtttaaccttgtgtacataagtccatttctgttcctgactcccaaacatcacacagaatacttggaggaggttcctgcagacctcctgcctgagcgatgcacaggcatttgtctctctctctggctgcctatgcactggctcttcgggtggcccctcagcatgaccgtccctcaaggctccattctctcctgactccaggattctcccattctgaattttgttgagcctctggctttgggtctgctggtgtacttcccccaggtccaggcaagtcaccttgacttaagtgtcttatttacaacttaaaccaggagtgaccctccctacccgacttccccatttcactgggtaactctgtttaccattgctgtctcaagcattaactatctgtggaagcttctgctcacctttatttttgcaggtatctcttctctttacaatactgctgttttgcaccataaatgatcacaatgccaattttaacatagaaaaagattgttcagggtatatttaaattgctttagaaatactaaaaaattatggcttgtaggcatttttacaaaattttaaactgtaatctgtgtttattttaaactgaagatttttatgagcaaattctgctacttcccctttgattcatttctatcactgttgaaatttttgtcccccataattcttcaggttctacatcatccttttcaggatgattttttttttttttttttttttttaaattgcgatagagtcttgctaggttgcctgggctggtcttgaactcctgggctcaagcgatccttccatcttggcctcccaaagtgctgtgattacaggcatgagccactgcacctggcctgaagatgattgttaatgtccttaagtcctttgccctgggcacccctgtgccttgctccagtgattacttgtcttcctctctatcccttccattcctctagggaactacatgtgtgaaaaagcatatctatacaaccccctgagcccacctcattatgtaaccacttttaaagcatcctcaatcactagaaagaatagcatttagtcgagccttactgatgcctgcttctcaagccctacaaatggtgctgcactctagttatcacttccacattcgttaacgtcgttgtcttcatatctgagtcactgttgccactctcagattataattccctagagaagcagttctaagccaagggtgtttaaagatcttttcgtacttattaaacagattctcaaatctctttcttagagattacgattttgcaggtctggaggggagtctctgagactgcatgtttgacaagcccctaaatgatagtgacataggtgctttcctgacctgctgggaggtgggggtgggaagccagggtagagtcacttatcaaggatagtgatgatgtgcctccttatgggccccacacagagaggggagatctgggagtgaggagtagaatcaagttgccagatttaataaataaaaatacagggtgcccacttaagtttgaatttcagttaaactatatctctctctctatatatatatatatttatatatatctctatctatctatctatatatataggtttttttttttgagatagagtctctgtcacccagactggagtgcagtggcacgatcttggctcactgcaacctccgcctcccgggttcaagtgattctcctgcctcagcctcctgagtagctggaattacaggtgtgtgtcaccatgcctggctaatttttgtatttttagtagagacggagtttcaccatgttggccaggctggtctcaaactctggatctcagatgatccacccatcttggcctcccaaagtgttgggattataggcgtgagccaccatgcccggcctcagataaacaataatttttaaatgtaagtgtgtcccacatagcatttgggacatacttatatttttttaaaaaaatgttctttgcttatctaaaattcaaatgtaaccaggcatcttttatttggcagtcctacaataaaatgcagttgtgatggacttttccaaccattgctcctgagtagtgctgtgtagtgtggttcacatacccatctaggaagtctcatgaaggcagcggcttttggatattaaagaatgtaacagagttttagagagtgcaaacccaaggcatacggactttgaattttatctgaccggcactgacatgctgagactttcagattggaaagcatttgtggttactgcatgtatgtcccaaattcttcccgtttaggttaaaagatccaaagaaatatcttggttaggtaggcttgagtctagagaatttggaatggttatacatttactgacaataaggattataaaagaagacctctgtgtccaaggcttacacgtaattagggagggtaaagccacctgcacacaatgctagctagcagggtattttaaaaaactgtgcacgttggggtactagaaacataatgggctttggagtacagcacacctgggttggaattctggttctaccactttctgtgcagccttggcccaggtagttaatctttcagtgcaagcagtgttgtcattcataaaatggaggtgatgcctaccatgaagtgttgctatggaaattaactgatctgtgatattaaagcatagtcactggtacttggggttacctaatctaaatgccagaggagtgatttaacaagggaggcaagaccctttctttttagccaagtggagttagcaaagtatgttttgtatgtggaaagtctacttttgaattgtcttcgtttctgccttcctactaatgtttttctctctgcctggtctaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcggtaagtagactcattgtagatgtctgtggctagttttctttctctttaactcttatttcccacttctattttttgtttaatgatcgagagataatcctgaaataatgaaagattgaactctggccatatttagacactttttttaaaaaaagcaggaagacacaatgaaaaacagtacagcctcaagtatgactgttttctgcattggaaaggtgtcttactttaaaacactcctaggtactattttttactattcagagccaagacagcaattccggttttctttctcttacatccgttgaaaagtacagctacttatttccttatcttcccccaaaaagttctccctatagaagagtgcacagggccttctctcatcagaaagaccttttggtgtgattagctatcactgcactggcattcatgaaggaggatgtatggtcagggtatacttttattgatcctggttgggatagataatgaaatatgtgttaggcagctgatcgttttggataaggaaatgacttatgaagggtaaagagaggctcttagtttcattaagtcattgacatgaatacatgtcctcactcttactacctggactgtgaattttccagtccatgttctcattctttccacaaaaaaatactctcgctgggtgcagtggctcatgcctgtaatccttgcactttgggaggctgaggagggaggattgcttgagcctaggagttcgagaccaacctgggcaacacagtgagaccccatctctacaaaaaataagacaagttagctgggtgtggtgttgtgtgcccgtggtcccagctacttgggaggctgaagtgggaggatcacttgagcctgggaggtcgaggctgcaataagccatgatcacgccacagcactccagcctgggcaccagtgtgagaccctgtctcaaaaacgttaaaacaaacaaacaaacataaaacatctctctgagttttactaggtaatatcatcccttctgattcaattcaagcatttaccaactccagttctttataaggcaggctgtggcttggtcagagtatggggcgaattgccattttaagttattttggaaatatttagtaacttaaaagaacattttcagtgtgaatttttctcattagaatttaaatgaggttttcatcttactttgcagtaattaaaaggcctgagggataatcagggtgaatcacttcaaggagatagtctaaattcagactcttcgctatttgaagggaaaatagttcatttgtgaatttaaaaactatacataaattatggtttgcattattttcctccagcatgctatacattaactttgaattctatattcacttggtctttttctggcttttatatgaggattgaattaaaaatgccagaataaaatttctcagtccagcaaatgcttaatgcatagctttaaaaggcagaaactcaaatcaaaaaagcctgggcaacacagcaagaccccagtctctgcaaaattaaaaaaaactagccacagggtggcacacgcctgtagtcccagctactcaggatgctgaggtgggaggatctttagagcccaggaggttgaggctgcagtgggccatgatcatgctgccgcactccaacctaggccacggagtgagaccctgtctcaaaaaaacccttaagtggtggttgaaaaggaaaataccagttcctttttaaaaattctgaccaaaaaaaaaacctagttctgaaaattattgacagtccttttgtattctgattataatatccctgttactgagctaagccagtgttgacagtgtgaatgatgctactcacgcagtgtgatccgtctcctttcagtcttctaaatagctgagtaatccattatttaaaagaagggaaatattgccagagactaaatattacgtgctgatcaagtactatgaagctttggtgtggggccatataccagctattccttttggtaaaatatcttttaatatgagtgaagaggtgagagatggttttcctggagatcttgcttaattcagatcatgcattaaatgcagaatagcgtactctcagaataggtaactatgacaaggaagacagtttctttttcttagaactgctaagggaattgctggtacaatataaaagttgtgtttttatttttagatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaaggcaagtaatattttaaatgatagaatttagatgagtcatttacactaagtacttaattgatctgagaagacaatgtaagatagttttaaagtatactcagtgctgactttgaaacgtagccagtagagtaacaccaaaaacttctgtatccaccctgcaattcttgtagttaggacattaatctcattttctaaagttaaaggaattctgagaggcaaagctgcattctgaagtgagtctgtggcccttttcttaatactcctgctcagtatccagataacagtttctataacataaactctttaaaaaagtaaaaatggaaaaatatattttttccctggtggtctagtggttagagaaaaaaaaaagttttttattttttacttcataaagaatggattaaaaaaaaaattttaacccacttgcatgtatagtccagttttggtcctctggaagccacaggaacatttcaaaaaaattgataatctgaaaaaatattttttctgaattttattgcggaagtagaagtttaacatcatctaggctgaattttgctagccatgctgttggctttttgtattactgcaacttataatggataaacattactctggatcactgaaaaatgagcaaattgccattgctcaccatttggtgagattatattctccataagaatggaaaatttatcgttgttgtctgcttttgtaaagctggtcatttcatcctctcctccagatcatgaattaatgctgtcctttccccttaagcctggcttcttctggcaggtttccccctaatcacccgtatatgagcgttggcattatgagtgttgtttctaattttgatagaaattgactgcagtatattgagttatgtgaacaaactcatttcatttctgaaatctggcacttttgttcattaattttctattgaatgctattaatttatttctacaatgcttgttacccatgaataatattttcaaaagaaaatcaacacagagataaaaagttttgttaactgaaggatgcatcaaagttcctttattgccatcagaggcaaaaatgagtaggtggggatggatggttgcctggctggctagtttgatggactgctggcagaaattaatgtacctctcaaaaggattttaagcttctttccacatagacaggatataatggaagaaaaacggtgagaaccattatgccaaaatgtatttgatattcatattgctggggaatacttcactgagatcaatcagctatttagcagcaaaagaaattgttgtggcatggccaagagaagactcatcccatactttctgagtaccttgcttttgacattactcatcgtagacactgaatgacatttggaccccacagaggcagtctagtctattgtgattgatttcttcccacatctttagagttacttggttcagtgataaattcagctactctttcttttcagtcctttttttcttttttctttggtctctacttggttatccattgccactgcctaattcatcacctccacccaaatctccaactattttggagttatttttgtcagagatcagagtatcccagcatctcactatcctcaccattggaggatagattctggcaacttcttagtgagcattttctctacatatttttaaagacaaatacattgctggcagaaacgtcccaaagagtcaaatctagacgatcattttcttgcatccaaaacagagtagtagcaaaatagtagttccttcctgatgtggaactaatattttatctgactttgattagactatgtatgtgttacatctcacatcaagactcacttgctgtgctgatctgagtaagcaagtgactgtcttccagcgaagtatgttcatcacacttctgagatagatttgagccatgggtgtagaagaggaggctctggatatttcatgacagcagtaattttcagactgtcctctgggtcccttcagtggattcaccccttcaagaccacccttcctcttagggcagtgacacctctgccttttttacatattggactttcctaagaaaattgcaaagaaacgctccttaaatggcagtctccccgactggagattaaaacaacaaaaaaggaaagcctacttgaagtcatgcttgagggaaaaggatgacattatttattcatgactcaggaggaaagcccacgctttataaaaacagaaatgtcaatcatctttctcatgtaatctaatcttagcaaataacgagcattatattttgggttgacttagttttcagtgtctttaagcaaagcttataatgggctactattaaaagttccatttagtactggtttgcatcacagcttaattgtagtcgttataaacttgggcacttattttcatttcaacaaaatcacaaacatgaccttaaattggttaggggagtcattcattctgctgtcctgatgtcttttgttattttggttgacttactgtgaccagtgtgtacttgtttggactacggagtagttttatttttcagaaacttaagaaatcatttacaatctactgatcataatgggttttatttttagcctcccaagaatgagtccttggagacttacccagtgatgaagtataacccaaatgtccttcccgttcagtgcactggcaaggtaaagacaaatttagggttactggggtggtggaagggtaggcagaggaagaggggagaatgaagaagactgtttaagtgacaggtagaattttaatagaagaaataagaaacattgctttcaagtataagtctcagtgagatgaattgtagctatactaggtaaaactttttaaaagaacagaaagatgtaatcagaataagactgatgtcagtttctccactggcataagaaactcaaatatctgaatttaatacattgggatatttgcttatcagaactgagaggtgaattagcccacagaagtacttctttctggcccacagcatgtattaaaaatttggggccaacattaaaaaaaaattaatgtcacataaaaattagtggtttgggcttctcttttaaaaatattgaaatatcgcctggtgcagtggctcacgcctgtaatcctagcactttgggaggccgagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttggacctgggaggcggaggttgcagtgagctgagatcacgccattgcactccagcctggggacagagcaagactatctcaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagatcatttactgggccaacagcaaggtgtttctgcctttcaatgttggccttgtttctaggaggcttgaagaatgcttatttggcatttgactcagcttccccatccatttgcacattgagaatagtctcttcttatgaccatttctcaaggctgcaatggaatagactgagtagatgttctttcctctctcagtagtttgcaaactactgtgtagattgagtcttgtttttgagtacacatagtgatgcatgatgtgagccattaaaatttcatttcattctggatttcagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaatcagctttccaaaaaacattttccagctataattattaaagatttagtatcacttaactaacatgggaaatgcccacactaaaatcagggcattgtatttctgaaacggaaacctttcgcaaagcctgtgcaggcagaggagctcacacacatccttgacgtggcactgtgtcttcaggggtgctgccctcttacagagagacagacctggaggccatggccgttttggtgagaaatgccagaaacagcttcagtttccacctactgcttcatatttataatcacagtaatctatttctcgttttgctatttctagagcaacaaattgtgtgatgcgaaattagtaccagaggaacaatgactccacttaacaaaaaaatagcaagggaactatgaaaaatggcacaactgcttaactttaatagttgaagtctttaggagacttcagtagttgaaatgacacagaaaaatcctcaaactaacatacctacatgaaactgagtttctcaaagtaacccacatttatggaaatagaagtttgtcttgcagaaacatcagctcattttgtaaggtgtatgtgatatttaaatttgtgatgcttgtgaataagggaatggggctttaggtctgaggaaaggggagcattcattcaaactggagggtattttgcatttttaaggctgctataaggtcacgaccttggtgagacttgacctgttttcgtatgtattgtgtactttctgttctaagccattgtgtgtgtctgtaactttctccaagattctctccaaatcttgcttctcttaatttctccagattgtgccaacctatttcccactcctgatctttagtgttatatcaccactaggagactggggaatgtggtttgtgttcttagactcaacagatacctaccatatgccaagcattcttctaacagctagtgagagatctatcagtgaacaaaacagacaaaactccatcttttttcctctgctgctcatattctagtgttaaccatttgcatatttctcagactcttcaatacatttattatttctttttaatcagtttattctgaccctcagtagatgacatatttcatgggtgtagggacagtgccatctatctcccttggggtgttcttacattcaagaaatgggttttcacacaagtcctgtcaaatacttaattccttacacaatataaagggattgagtttttcaaagataggctgactacttggaatgaaaagcatttaaatactgaagagagaaaaaggattctcttttcaacccttcatattctcggaaggaaaactgaaataccgagttagtatgtcctcaaccctggttaatttcccttgcaaacaaagagggacaggccttggtgtcagaagctttgccataagatgttacctagctaggatttttaaactggttttcattgtattttattaccttcaattaagaatag

SEQ ID NO: 16101 - DNA, 237241 bp, Human
  misc_feature (1)...(237241): n = A,T,C or G
tgttaaaaactttgcattaacattaaatgtttaagagtagtcacctaataaattctaactaatgatgttaaatttcacttgtacatctaaagtactgaaatataaacactgcactaaaaaataaacataaagggatctgaaataacaaatgattcccaagggggtccatgagatctagttatctggctcaaacgttccttcacatcgtcataaatgtcatgttttaaaaacaattataaaaaagccacttacctttggtttctaaatttttagtagtcattttttcaccttaaccactgaaaatgcactccaagacttctgctgaacaacctagaaatgtatgcatatgaaataattttaaaaatatcatataaacacatagagtacctccaatttaaaagttatgatattttaattgcttctgtatttagtacgcatgcatttagaaagagaaatgtcccttatatcccattctcacagaaggcattgttatgtctactaaaagtctcaaaaaaaaaaattaggggtggtttacttctaaatactccgtttcaccatcctcaccaatacactctaaattgtcagaagtatgtcctgaattttagccaagcaaagggaatgaagttactgtggtggttttgtcatccatatgacaagaggaattttaaagtaattactttcttaggagacataccgacacaatttgtatacacacacacacatatcaaaaaggagcttctgtttagatgtttaacaaacgacaaaaaatattactcaagataacataatttatacttttttggtaataaaaagttaaaattaaaatagtgtagctccaaaagtaaaaagagaaacatatcgagcccatgctttcagaaatgtatacattgtcttacagtacagactcagatttaccagagaacatataagaaggtgatgctactgcaatgatataaatatgacaaactgtacactagatgacaactggtttcactacaaaaaaagatcgttctcagtactagatacaactcagttcaattagtgaacccgacgactaactttcttaacagtcacaaacttttctacacttacactctactgctccgaaaagaggtatccaaaaaacccttcgtaagagtaacgatccctgaaactgcccttgatagctgctctgcgaaacgtacaggcacagcgagtgcctgctggcaaatgccaaatgaagcggagggggtgaagaagtaagtagggggagtgagcaggtatgaaagcgataggccgggaagcgacaagcctgtcaactttgctgtccggggaagtcgaaacctaagtttcatccctgtctgaaaaagtcttcccggaacaatctttccctaaatccaaagctactggccaccgagctccagccagacctccgtccctttccaacatccttagttatacctgcttgtcctcggatttacctctaagattcttattctccgtatttcagggggcttcacttgataggctcttcggatcggtatcaccaggttaacttctcacagacctcttccattcggaagccgacccgcccagtccctccgcatatccagcagctctctcactcctaaccacttccgattactcagggtttcgcttccggaatacgtttccaaaagagcagggtaaacaaattctgcagtgcgtataaactcaagtaacacagaacacacactgtaaggcctccgtaagtgaaaagcggacagatttctactttaaaataaaataccgtacagcaacttttggagcccaagccgcatattcacttaaacttccgggccagctgttaaacaaacggaagtaaaactgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatggtgagtgccaggggatgccagaagaacggctctggggtcctacttacttagctttccaagtcttcgggcggatgggcacttaaagttgtccggtcctcccgaccttctccccgttatctctttcccccttcccacgggctgttcctgcagtctcctcgctctccgtatttcttacagcaccctgaattccactaatgttactaagtctctagagtaatgaaacagaaaatttagggtaaggcatcgagtctaataacctgttttgaacaaacattatgtgtttgcattgttcatcatggcatttttcatgttcacagattcacattaacgcgctttattaagagtatggggtggtgtgtatgtgactgtctcaacactgatctgaatctccctagatcttggagtctttttgcttttctgagtggcagagcactgccccacgcccccacgagggccattaacaggtgtatgttggatcagcgctcttctatccagttggttaccttctaggtctgtgcttgcttttcttttctcttttcttttctttcttcttctttttttttttaaacagaaatttctcctgggattgcttggagagcttctggacttcactgtttgggcttcacccctggaaattctgaatgaaaggaatggagctcggtatttgcattttaaataagcctatagattattttaattcacccctatgtttgagagggttctagttaattcacttaactaccatatcttttaagcacttatggataacggactggaggatagaaagatctttagatagttatagctatgaatttagaaacagagccctcacccaccaccccttgtttcttcatactactcagcaatccttttggttaccccagttttcccctgacccattctctgtgaagacattttcaaaccttccctttacaaaccctgtcttttgccctcttcatttctcctttctaaacatgatggagtataacaggccatttcttcaacctcatgcccccaacctacacattgctctatatttttgccgagcctttagtcttgtatttctagtgtagagaaagggatattaaaggataatccatccatctttgctcttgatctcatttgcttccatctgttacatttcgcttccagttgtttttttctttcctgtgcgttcagccttttcctctccagtttcttctcttcagtgctcaagtcacacatcttatgaaaattaaataaagcaaaaccatgtcctccatcctgtgtttatccagttatttcctagtcctcctatctatcagtaaacttcttgaaaggatattatttttacttatatcaaacagacaaaagtcttctgtctggcttctttaatggcttcaagaaagttgttcttgcttaagtttctaatggccttttaaataccaaatacagtaattacttctcaaaatttacattacttagtctctttgtgacaactgaggttcatagtcattaattccttttactggctgtgcctggtttttgaatgtcattctttggaattaactccttgattactttcatttcttagtctagacattttccttgggtgattttgtccactcacatggattctactaacacctttgattttgcttctaaatttcaattttcctctcagatctactaatgcctaactcagttgcttcccggacacatctgtctcaaatgtccttcaaacttaatatgaccaaaactgaacttgctatctttcctcctggtttctcctattttcaccaagttaaataatgctactactatattataacctaaactagaaatcagagttatcctacattcctccctcttctatttctcccatattcagttgttcactagatcaaattttagtttgtcatctcctcatttcgtgattattttaatagtgacttttacagtctggtctggaaattctccaatccattattttctctgccacaagaaggaatttttaaaaacccaacctgttgatttactcacctccttaaaactctagattccctatttcctacagtaaaatgtctagaatggcacacaagttcctccatgaacaagcacttttctgtctagcttttgcctttccctttccatacttaaaaaaaaaaaattctcttgccttttagctacttgcttttcattgaacataccaagcaacttcaaactggtagtatgcctcctctttctactttgcacttgcaattccttctacacagaatacttgcaccctcttgttgcttgccaaacttatttattctcctattacaggccaacgtgttcttcttgcccacttcccagaaaggccaaacattgagaatgcaggagttgcagcagagaaagagtttaatggaggcaaggcagttgagtggaaggatgggaaatatttctaaaatccgcctccctgacagcttggaagttgtggttttcaaggataattttgtgggcaggttggtagggaatgggcgctgctgattggttggggatgaatttataggtgtttccaaactgtcttcctgtgctgagtcagttgtctaggtgagagtcataggactagtagagtcagtttcttggtatgaggcatgtatctgggtggcatcaggaggtttgccagaatgcagaagcctgaaaaatatctcaagaccaatcttaggttttacaatagtgatgttatctaaaggagcaattggtgaagttacaaatcttgtgacctctggctacatgacttctgaatagtaagaaattatagaaaagcaaggaacagtagctggttattgcttacctatgcctatattttagcagattttaggtccctcccatagtcctaaccttgcggccttctattagtcttacaaggctgttttagtccctagagggggtcagttttggaagggactattaccatccttgcttcaaagttaaactataaatttctcccatagttagcttgcctatgcccaggtatgagcaagggcagttagctttgtgaggttagaagcaatatggagtcagttaggttagatttctctcactgttataatttttgcaaaggtggattcacttccagacccagtgtaggtgtcttttctgtgatgccttccttccctactcaaagagggttgagtcgagtcaggtgcggtggcatatgtgtgtagtcccagctattgaagaggctgaggtcagaggattgcttgaggccaagagttcaaggccagcctgagcaacatagcgagaccttgtctctaaaaaagtataaataaatacaaatttaaaatctatgcagatattcagagctttcccctccacactgtgaaatcaagaaaaaaagaaaaagaggttgattgttcattctttttgtcaccattttatgtagtatacatctctcctattgtacttgcctcattcggttgaaattatttgtttatagatctgtcactcttactaaaatgtgaactgttggaggaattcatgcttatgttgttcacagtattgcctagatcatattaggcactcaaatgtttgcggaatgaatacaaaataagaaagaatgcgctaagtggtctgagagaatacaaagtaatagggggcaaattgtacaattgagtccctgcttctcagtcagagtcagaaaagttgtcatgaagaaaatggaatagaatttcaatagttagaattctatgacctgtgcaatggcatagggaggtagaaagtgacatttgctcaatactgtttttggtttttgcctgtcttacattatgttatcaaacttcccaggaatgctaagggcaatgaatgaactcctgttcccactcctcctgccgggattgcaggctggggctctttcaaattaggtggtcaatgaaggcctctctgtggaaagaacttttatattgagacctgcataatataatacaaagtgcagtgatctggaggagtccaggccacgctaacaacaagatcaaataccctgaggcagaaaagagattggtatattttaggaacttatggttcaatgtaataaaataatagaaactgggtggtgggatggtgcaggggtggctgcagtagggaaaatatggtgcaaaataccatgaaatgtggttagggaggtaggcagaggccagaccacacgtatacgtacagcagtgtttctcaaactgtacctgatgactcattactcaaatttgtggtatgtagccagcattaaaaagatgacataaaatagcaacttaacatattcactacatgttgtaagggtaacgttcatgaacttttgtttaattgtatatgtattggatgtgtactggattctgatgtaaaatatatttcttactgtgagtcctgatccacaaagttcaagacacagggtactttgaataatatatactttatttgttttatcttattattttatttttatttatttattttttttgagacaggatattgccctgtcacccagcaggaatgtagtggtgagatcatggctcactgcagcctcaacctcccaagttcaagtgatcctccagcctcagccttccgagcagctaggataataggtgtgtgccatgatgcccagctaattttttttttttttcagagacagggtctcactatgctgcccagcctggtcttggacccctgggctcaagtgatcctcccaccttggcctctcaaagtgttgggattatgtttatgttagccaccacgttcagctaatatatagtttaaaaggcaaaatagttgaaatctcaaggcctgcagatattcttattcctcttttgatctagtgaaaatgttcttgttgtatggcagatacagctttgaattaacgaaagcctaaaattggctagagtaaaattttcaagtttctttgtgcatccagatcactctcctccatatttgccatcaatcatttatgagaaagaacaggcctaagaaacagatgtcccttctctgtgttcagtctagccactgttgtatgtattgcagcaaaggattatggcctctcaataagcagctgaagatggaggttgtttgctctgttggtgaggcttcctgaccactgcagtttatctaatcagcttctgtcttcatctagtttgttacagttgaggcttccaaattctggaatcacctttatattgtgaagcagagatagggaaccatagtttagcatgtttctcatacacctcatttaagatgaagcgtatgctggactcatcaatttcttttacatattataaagaggacagagaaggtaattctaagatatatttgacaaagatattaatattatgtatcttctaaaatatagcatttattagaatatcattactccagatgaactgttagtgtaataaaggactttaaagattattagctatgttccataagaactaatctaaacctttgaagtaaaatgtctcaaagttgtttgtttgtttatgtatttatttatttttgagacacagtctcactctatcaccctggctggagtgcagtggtgtgatctcgggtcactgcaacctctgcctcctgggttcaagcgattctcctgcctccaccttgtgagtaacttggattacaggcatgtgccaccatgcctggctaatttttgtgtttttagtggagacagggtttcaccatgttggccaggctggtctcgagctcctgacctcaagtgatccacttgcctcggcttccccaagtgctgggattacaggcatgagtcaaagttgtttttaacagagttttcaaagacagtttcataattactgaagaacaaaattttattccatgaaatgaaatgcttttcagtttccaactttatgacgtttctcctaatagcttttctggttttgtttttagcacctgcctttttttttttttagacagagttttgttctgtcgacccggctgtggagtgcagtggcgcgatttccactcactgcaacctctgcctcctgggttcaagcaattcttgtgccccagcctcccgagtagctgggactactggcgcatgccaccacgcctggctaacttttgtatttttagtagagacggggtttcgccattttggccaggctagtctcaaactcctgatctcaggtcatccgcctgcctcggccttccaaactgctgggattataggcatgaagcttggcacccagacagcatctgctttttagtcatccagaattccttttgttacttgaattgctgatttggaagaattgcagttccaaagatccacaggattttatttacaaaaagtgaatcagaaagcacagggcataaattgcagatatgaaactcttaaaagtttattttcctatatattgtattacaaatgcagtttagagcctgttatattcttgtttagtaggaaacagtggtatttggagaacggaatagtaagtggttaatataatgccataatttttttcatgtagctttttatttatttttgctttcctttttctgcctttttattcccaattctttctcattcaccagttattcttctattcgagaaagtatttattgagtactttccatatactggtaactggtgggtatacattgattaataagatagcacacagtggcccctaactcatggaatttatggagaaaaacagatattggaaaataaattacaagtataagttggattacaaaagaaaaatgacaaggtgaggtggaagttagtaataaaatagagtgatctgaactagcctggggtggtgagggaaagtctctttgatgataaaactctttaattgtttttttccttagtttgagagaaaaacagtttacatgaataaataaacgaatgatgacctcatatgatgataagtactatgaggaaaattaaactaagtaatgcaatattggttggttccaagagcaagtagccttgagtaggacaatcagggacggtcctcatgaggatgtgacttttaagctgagatgtcaatgatagaaagcagcttgccaggtgaaacctaggagaagagcattccaggcagagtcaatagtgagcacagaggtgcattagaggaacaggagggagctagtgtggctggggcctagggaatgagaggacagctggaggagaagagatctgagaggcaggaaggagccaggaatactgagacttatggaacttgggagggattttggattttattctaaatgcagtagtattatacatcttatatattttacctattccatcaaaatattttattttccttggatttgccttaaacttttgccatattaatttggtctcttggtgcttatttttatcttatctgtaaaatttatgatcttataagctttgggaaatatttttctgagcttcttttgtctttgaacttcagagactcctaatttcatcccttatagttgccatttcataatttattttcccatttctggacttattttttgtttctataatatctactctaaggtgtggcgagcagagctacatattccagatgggtatgcattatagtttcaacatgggagttatgtttgctgctgtgatcttcacctagtacctttcttgatgctgctatagcatatgattgaagtatcttactttccagaagtatctccagcattcccaatgaactttgtattcacatttttttcaaaaactgcctaaacttcttcacttccaaagttgtcaatatttaaaactttctgttaattagatgtgagaaactgtagctattaaaatgtactgcttaattcacatttattttctgatactggacactttgccttaataagttgctgttgttctctctcctgactcatcttatgtgctgtgccttcttcatatttctatactctttaaaatgtatcttcatatgcacacataatggctctagagctctctgatagatgtaaattcaacttttatcctttgttttccatagtttcaatatttacatgatacatatatatgctatatatgttttatatatgtttataaagatatttaacttattctgttgtagaaatataggaaaattacttagtcatttttagaaatgagaaaatataaaagtaaaagtaataaaattacatttatctataataacactgcctgtatacaatcgctattaatatttttgtgtaatatcctggtcacatatatactcatacatatatacacacacacacacagagatacatatcctttaaaatatgattctattatattcattgtttagaaatctgttttatcccacttaatatatcttttgcatttttccagatcagttttaagaactacagccagccctgggtagccatgggttctgcatccagattcaaccaattgaggattgaaaatatttgaaaaaaaaaaataacaatacaatgataaaaaatacaaataaaaacaaagcactataacaagtatttacatagcatttgcattgtattaggtgttgtaagtaatttagagatgaattaaaatatactgaaggatatgcataggttatatgcaaatgctatatcattgtatgtaagggacttgagcgtctaaggattctggtatctgtaggagtcctggaaccaatcccctgcaaatactgagggacagctctacgttttattctttcatttactctgatttaaccaatccatttattaatttgttctgttaacacaatactaacatatttttgcgaacacatttttatagacatccataattatttccttacaataaattaaaaaggaaataactaggtgcgagaggtcatgtgcatttttaggctttcaatatacattgccagactactcccaaaatagttttgccagtgaatactctgctagcagtataccatggtgcctgtttcttctaaactctaaactggtatttctatacattacatacatatgtctaacaatagatttgaacttttaataaaactgtcacctgctttgctcagaatattgagagaaatataaattactgtatgttctatagatgaaaggcactgttaatacttacctacaatatttctttgtaattattgttttacatctattataaattgttaaaattcaaggtttattgtctgactgtagtgaagaatattaagttggcctttttttaactattatttgtagacagattttccagtcctctcttgtgtacttattttcaagatgtagcttgttgaagtacaaacaaactgatgtagagctagaaatctaaaatttcagtctttattccagtcctggcttaagcacttatgagctgtgtgttatgtaatctttttggatagttattttctcatccataaaatcaaaataatactttctgtttagattaccttaaagcattttttgtgaagatcaaataagttaatatgaaagtaatttataaactgtaatatacatatgaaatgtgttattttcatattaaccagattgctgcctaatgagaagatagttgaggaaaatggaagagattaaaatatcaaccttcaaaaataaatatttgaggttaatggtgttatgcaattttgtggctattgaaaaatttacttttatatattaaattccctcttcctaaatttctcttatagattcattttcctaatggaaataagaaaaagctggtaaaagggagggaaatggcagagattggtcttgagaccagtttcaataatggtcatatacttttgtggataggggcagctaaacatgtgtgatatgtatttagcaggtattaggtgtgagatccctgaatatctactcaatttaaatggattagctgggaacatttacttttattgctggtcatgtgagattttattattcagtaatttgactgtgaaagtacaatgagaccgttcagacccagtctgtttcttgccacttagactcagaaattcggctctggaaaaactgaaaatcccttcatctagtggcaagtacagttttatcatttatgttaaaccatattgccttttaggtaccttattggattttactgcatgcactgagatctctaaaaggtgaatatctgtctatcttagatatctgaatatttttcataattaaaaatgttcaagtttttatgcaaagaatgaatggcttctataatattatgatcactttttctagcatttccacataaaaattagtattggcctgatgattttatcttgtctcccaatacccttaacacctaggttgtggcatgcattattagaacacttctagaatcaaacttgacataataagcatttatattcagatatagagcagaggctcttgaactcatctttctgcccacttttgggttcttgcaacatgctatatatatgagatacaaagatgaacaagactagatttcttttttaaaaagctcacagtcttggaggaagaaaaaagagaagaagagaaatacatgatacactgtaacattgtaatactaacttagagaaattcaatttcttcatttgtaaaatgaggataataataataataataatactagttcccttatagggatattattataattaaatgataaactgtttagcccaatgctttatacactgtaagcatccaaaaaatgtttgctgttattactgttactactgctgttgttatttccaagtgttaagatagagacctactgaatgtgggaacacagaagagaggctaatgactgaaagaacgctaattaaaaacaagattagttgactttactgctttttctctgcaatttttcattcactgagcttcaggttttctttaacatgtgaatatgtataaatccaaaattaaacttatgcatattaatgtcaacattgattccctaaagttactggaacgcatttggaaatgaagtaggaaactccgtcattgtggttcattcttcagggttcagcctagtgtcctgtacaattaagtgcttcacagatgctgccccctaccccactttcttttaaacatttttgttcattgacccagatgtccctttgggtgagttttgagaggacacaagatacacagagttggtgactattcagaattatttgaggtagttcttattcatataatttttaagcaattctttttggtttagccttctgagatatacattttcaaagtttacatctttttttttccagttttacatacacttcagctgcacttactattccatttgcctgaaatgctcctacacgttttttcagatgtatgttcaaatgacacctcatcagagaggacttccttgtccacctttctaaagtaacaactccagttgctctctgtccccctaccagcttcaccttcttttttcactttagcacctgacaaaagctttgcaaatctgccattttaacgatagtgcctgacacttagagaatgttttctatttttaaaggcatttaagattcttaactaattgatagtgtccttggaagtaggtattgtatttacagagaaaagatatcaatatcatcagggagcagaaaggcacaaacatccaaggaagaaagataatcctctgaaaagacagttgagaagaaaggaaggtaactttccactgaatttccctgctagttacttggtagagaccaggagtggacaaacagttttgatcaagggctgttcacctctagagaaaaatctagaattatgggtcaaaaacagtggactcttttattctgagagagagctctagcttcattcattcaacaattatttttaagtttctcttgagtgccaggcactgttctgagcaatcagtgacaaagtcccacccttatggagctaaaatttctggggagatgcagaataaacaaatatgtagtataatttgaggttttgataagtgttatggaaaaaaaatcaaacaagacagagagtgaagaagttggtatttagttagctggtcagagaagcctccttacattgctgacatatgagtggagacctgaatgaagtgatgatgtggagagccctgggaatcctagccctagagctgtctaggtagaggaaatagtacatccaaagaccctgaggtgggagcctgcttggtttatttagtaaccagcaagaaggccggtgtaactggagcagagaaggtgagggagagggtggcagaggcaggtgaggcagatgagataaagaggtagcctgagaccagatcatacaaggcttatgtggcatgaaatcagtcttttttaaacaaaattaaaatttttatgggtacatagcaggtatatgtgtgtgtgtgtgtgtgtgtgtgtgtgtataatatatatttaatatatataatataatatacaatatattatatataatatacaatatattatatataatatacaatatattatatataatatacaatatattatatataatatacaatatattatatataatatacagatatattatatataatatacaatatattatatataatatacagtatattatatataatatactgtatattatatatagatataatatataatatattatatattatatctataatatataatatataatatataatatattatatctataatatatagtatattatatattatatctataatatataatatattatatattatatctataatatataatatattatatattatatctataatatataatatataattatatataaacatatataatatataatacataatagatatattatatattttattatatttattttatattatattcattatatattattatgtttataattatatatctattatataatataatatatctattatgtattatatatattatatctattatatataatagatatgtgcacacacatatatatatataaaacatatatacacacccatagtatactaggtgtgtgtatgtgtgtatatatatatgtatacatttatatatacccactatatataatatttataaatatataagtatatatttaatactttaatatataaatatgtacaccagatattttggtacaggcatgcaatgcataataaacatattgtggaaaatttggtatccatttcctcaagtatttattctttgtgttaacaaacaatcaagttacactcttctagttattttaaaatgtataattaaattattattgactatagtcaccctgttatgctattgaatactaggtcttactcactctttcaattttttttgtacccattaaccatcctcaactccacaaccccctactacctttcccagccttctactctctatctccatgagttcaattgttttgattttcacatctcacaagtaagggagaacatgcaatgtttttgtgcctggcttatttcacttaacataatgacctttaattccattatgtttttgcaaatgacagaatcacatttttttatggctggatagtacttcatttggtatatgtaccatattttccttttccattctttagatggacacttaggttgcttccaaattttgactgttgtcaatagtgctgcaataaacatgggagtgcagataactctttgttgtactgatttcttttgggtatagacccggtggtgggattgttggattataaagtagctctatttttagttttttgaagaagctctaaactgttctcaatagtggttgtactaatttacattcccaacaacagtgtatgagtgttcccttttctccacatccttgccagcatttgttactgcctgtcctttggataaaacttttttaaaatggggtgaggtgatacctcattgtagttttgatttgcatttttctcatgatcaatgatattgagcaacttttcatatccctgtttgccactggttgtcttcttttgagaaacgtatattgagattttttgcccaatttttagtcagattattagattttttttcctgtagagttgtttgagctccttgtgtattctgattattaatgtcttgttagatggttagtttgcaaatattttgtcctattctgtgggttgtctcttgactttgttgattgtttcctgtgctatgcagaagctttttaacttgatgtgccccaatttatccatgattgctttggttgcctgtgcctgtgtggtggtggtcaagaaatttttgcccagaccaataccttgggaattttcctcaatgttttcttgtagtagtttcatagttagaggtattaaatttaagtctttaatccaaatccattttgattttatttttgtatatgaccagagaaaggggtcttgttccattcttctgtgtataaatacccagtttttccagtaccatttattgaagaggctgtcttctccaatatatgttcttggaaactttgttgaaaatgagttcattgtagatgtatggatttgtttcagggttctctattctgttccattgatctatgtgtctgtttttatgccagtaccacgctgttttggttactatagctctgtagtataatttgaagtcagatagtgtgatttttttcagttttcatctttttacttaggatggttttggctattctgagtcttttataaattttaggattgttttttctatttctactctttgaagaatatcattgatattttgatagtgattgcattgaatctgtagattgctttaggtagtatggacattttaacaatattgattctttccataaacatggaatctttcaattttttagtggctttttcaatttcttttatctgtgttttaaagttttcattgtataaatctttcacttcttttgttaattcctatgtattttattttgttcatgactattgtaaataggataacttaaaaaattttttttcagattgttcactgttggcatatagaaatgctactgatatttgtatgattttgtatcctgcaactttactggatttatcagttctaagagtcttttggtggagtctttaggtttttccaaaggtaagctcatatcatctgcaaacaaagattctttgacttcttcctttccaatttggatgccctttctctcatctgattgccatagctaggacctcctatgttgaataacagtggtgaaagtgtataaccttgtcatgttccagatctgagaggaaatgctttcagtttttcccctttcattgtgatactagctgtggggctgtcatatatggcttttattatgttgaagtatatgttccttctatatccaattttttgatgtttttaacaagaagggatgttgaattttatcaaatgctttttcggcatcaatggaaatgattgtatggtttctgttctacattctgttgatatgatgtatcacattgattgatttgcatgtgttgtaccatccctgcatctcagggataaatcccacttggtcatgatgaatgatatttttaacgtgttactgaattcagttttctagcatttttgaagatttctgcatcaatattagagatattgttctgtagttttctttttcattcttttttttttgatgtgttgttgtctggttttggtatcagggtaatactgagctcatagaatgagcttggaaatattacctcttcctctattttttggaatagtttgaataggattggtattagttctttatatgtttggtagaattcagcagtgaagccatcaggtcctgggcttttctttactcagagactttttattatggctttgatcttgttactcattattggtgttttcatgttttggatttcttcccagttcaatcttggtaggttttatgtgtgtaggaagtttttgattttttacagatttttaaatttattggcatatagttgctcatagtagccatcaatgatcttttgaatttctgcagtatcatttgtaatgtttcctttttcatctctgattttatttgtttgggccttctgtctatttttcttactctgactaaaggattatcaattgtgtttatcttttcaaggaaccaactttttgtttcattgatcttttgtatttttttttcatttcaaattcatttatttctgccatgatcttattatttcttttcctctaattttggtttcagtttgctccaggttttgtaattttctaaggttcatcattaggctatttatttgaagtttttctctctttttttttaatgtaggcacttagagctataaatttccctcttaatactgctttcactgaattccctagctagtagcattccataactaatagtatattgtgtttcctttatcgtttgtatcaagaaaatttgcaattttctttttaatttcttcattgacccactggtcattcaagtcataaagtcttagatctgaaagagacctttgattttggttaacatcagtgattatgaaattgaggttatgatgtatcactggattgtaggcgctaaattgtaagtaatagacagcttttaaaaaaaggtataaaaatatcagtacatttcacatattgagaataagaattgtttttgagaattttattccagttgtagggcatgtgtgtgtgtggttgtgggtggatgtgggtgtgggtgtgtattggtcccaatggaaactgtggttcttactataggttaagaaataggggaaaaagaaaaaagaaaaaaaagaaagaaaaaaggaaacaggaaaatgtttttgaactattgatctagtcttattcccaaattttatagctaaagaaactagttgggacatactgaaaggcccacatgtcttctacctcagtgtgatgatcccatttacatgtgatgtgcatgtctgtatgtgtatatgactattccacattgaagtaattctaatttccaaacgaaggaaagaaattacaaagtttatttagttaataccatatcagtaagtgctcacatcacttctctatttttaatctcttttatgtttgccttatttttctttttttccctcttttcttgaatatccttctatttctctaggaaagaaagatatacaacgtgaagctagagagagggagagaaagaaatccaggaccaataaagagggagagggacagacatccaaaatctaggagacaaaagagagaaacatccagggccaagcagaagtagaggcatctctgccccatcactcctgctttcttcaagatcccctctgcgttttgcacaggctgtagtcttctgggaaggcagtgctggtggagaatggatccatctactttcaaagacatgcattgggaatttattaatacctctctatcctgctgtctggctctctgagttgggactcagtaatgtactaaggagagtgagctccttgagagcagggctctttccttccttccttccttccttccttccttccttccttccttccttccttctttctttctttctttcttttctccctttctttcctttctttccttcctttccttcctttccttcctttctttcttctttctttctttcttggcacgatcttgggtcactgcaacctccaccttccaggttcaagtgattctcctgcctcagcctcctgagtagctgggattacaggcacccaccaccacactcagctatgtttttgtagttttagtagaggcagggtgtcactatgttggccaggctggtctcgaactcctgtcctcaggcaatccatctgcctcggcctcccaaagtgctgggattacaggcatgagacaccatggaggtagggcttatttcttactcactcttgtagtccctcagtaatagcttgcttagaaaactattctaattaatacactgagcttttgagatactgttccttttatacagttacattcttactaatacaaatgagaaatctatagccttaaagaaaggattaggctaaaaagggacttaattttggaaaatttgtaaggagcttgataaaatgaatccagggttttaaaaaaagaggttctgttacacacacaacacacacacactaaatagacatacattgtggattaaaccttttttaaaaatgtcatgagaaagatattcttgaaatgatttaatagcattttttaaattattgtttttaattgtttaagatactgttatgtaatttgttagatgttagaaagcaagcgaaaggaatttattagatgttagaaagcaatggaagagaattcactgaatgtcacgcatattccataagagtggctgtttgataatttcatcaataaatttaaaaactttaaacttatttggggctgactgggcaaaggataacccccccaccccagattgggtcctcttttatgcaaggaattagagagaaatgaaattgttgacctggcacaagctatcctttcattaaaatgtttcctaaagtcccgatgactggaggggatatattaaaaacaaaaggaggctgctcttcctatggagtaggcattcttttattcctttactttcttaataaacttgctctcacttttctttaaaaaaagaaacttattaacttattctttaaaaaagaatgggaaatctctttttcttaatagttaatatctatcacttattgaatgcctactgtatattcttttcacataaggaaacctcagttttttaaaatacccaagattatacgctagaaagcggtagggcccaaatttgaacctatttagcctagaacctcatgttctttctagcctactacttagggtcacgatgtttaaaatttttttttttttttgagttaactctttcttttgcttttatgtagctatagaaatttaacttccttttcaaaaactcagtttctagtggatataggtgatatacatttttttcaggaattcataattcatattttgatacttgactagggctctgcaaaattactatggtttaatgaataactacagggctaaaattgagggtatttgtgaaatggctttgtgaaatggctttgtgaaatggctttttgggcaggatatgttaaatccacattgaacactaggtggcactcttccatcattggacactttcaggaaaagctatcctttatggattttattagttgcttattaattttaatcatattgaagtggcattcgaatgctattcatctagaaatcacagatgtacacagtatcacagattatttctcataaagtcaaagacacacgtttttctttcctaaattagaaaactttagcctaaatgatgaaacaaatggtcatctttgggattaagcttgaaaatgtgggtttttttttttttttgcttttttttggaatctgttactttaccaaaatatcctttgacttatttttaaaaacttaatcaggaaactacaaaataaaaataatgtttgaattacatgaggtaatataggcaaatgcattccaaagaaaacactgtcttaatatcttcttcagatagactgtctgatgatcactacttctaacacttgtggatgtatttaagacttttaccacttttataaaggtacattagtggttacagccacttaagtctgtatcactttattgtaaacacagtattttctccattgactaatattcaaaaagactcattctttttctcatgatgaaaatgctatcagaatcagtagccaactgtagctaatgcagaatagtagtaatttgcaatgcatgtaaatctatatgtatatttagcatctgcagcatttggtatatgacatacaggaaaaaatggaaccattttggtttgcatattttgcatagagctacttttctctatctctgcaaccagggctgctacatactacatataggacattgcacaattatgagtgagttgctgatattcttatttattacgtatttttctaacacgtggcagtaaagtgttctcaggaaggcacaactttttctgtttgcacaggagtactagatggactaaagaatagtcttttcagatttcttagcaatgatactgctcgtctatgccattggctcttattcttgaaagaaaaaagaatacgagaggagggagcacaggagagagaaggtgatataaaagtaccattccaggatgcatctaatttactacaaatgtcagggtgggtttagggcctctacaatggacagatgccacaggatgccatcccactgtatcttctcctcatactctaccttcaaatcatactggctttgtttgttaaacttgccaacgtccatcttcctcccaaagctttatactttttgtctacctggaatgtatttttaccccaggtttctgcatgactggcttttcctcatcccgttttgacatctcagatcaagtgtagttgttattctagttgaaggggtactccctagctcactaccccaataattggcatgtttacctatttatcctattgtttttgtaacacaatttatttatttacttacatttttagagatggcgtctcactgtgtcggtcaggctggagcgcaggggtatggtcataactccaactcctgggctcaagtgatcttcgtgcctcagcctcctgagtagctgcaattacaggcacgagctatgatgtctggctataacacatattattacaagaattatatatattttttatttttacattctataaggagagacagaaaattagtaagtaagctccatgtcaacagggccttgtctgtcttctgtcttgaatatccccagtgtctgttgcagtgcctggcaaagagaagccattcagtatttgttgaatgaatgaaggcatgaataaattcaacttttaaggcataactaatatttcaattgatgatagctagcagagttctgctttctaaatttattcattcaacaaatacttaatagatatctgatatatgcaatgcatatacctagtcccttgggatgcatccataaataaaacagacaaaagtctctgccctaaaagggcttgcattcttttggggcagatatgcaataagcaataaacatatgaagtatagtatacattatatttgaaggtaaataagtgctacgggaaaaaaatgagcagggtaatgaatgttgggggtactgatagtggtgttgaatgtaatttaaagggaagtggccagagttagtcttgtggagaagatgatgatacctgagcaaagtcttgagggtgagaaaagataagccatgtaaatattggggaaaaagtattccaggaaataagacagtcagcggacagacttttttaggtgggagcatgccgtatgttcaagaaacagtgtggctaaggcaaagtaagcaagagtgacagttgtgggagatgaagtcagacggatcactggaggccagatcttggagggctttgtgggctattgaaagtgggttgacattattctcataggctgagttggcaaattttaagcagaggaatgaggtgatacaatttatatttttacagaatcctctctggctgtatttttttgagagaagctgtagggggcaaagatggaagtagagaggttagttatgaggctataatctaggtgagggagtatggtggcttggagtagggggtttgcagtggaggtagtaaagtggctagaatgtgtatatgttttgcaggtagatctaataggatttcctgatgaattagatctatggtctgagagaaaatgagtcaaggatagagttaaaagatgaccctaggattttgtcctgagcaatggtaaggatagcgttgctgttaactaagatgcggaagactggtgaagaagccaatttgtgttagggggctgggagcaggatttcaacttggggcttgttaaactagagctgtctaacatctaagataaaaggcagttggatagatatatgcaactaaaatttagagggagtggtctggcctgagcactgtcaatatgtagattatatttaaagccatgagactagataagatgataacagagtgagtgtagctaaagattaagggtccaaagaccaagttgtagagtatgctgacactctaacatcaagaaaccaaggagaaatgcctgtactggaatagaagagaggtttcaaatcagcaacttaaggttctaccttaaaacaaaaaacaaaaaaaggcagagtgtgatggttcactcatgtaatcccagcacttagggaggcaaagttagagaatcacttgaggccaggagtttgaaactagcctagacaacatagtgagacccccccatctctactagaaaataaaaagagaacagaaaaagaaaaataagaacaaattaaacctaaaggaaatagaaaagaaaggagataagtattggagtagaaaacagtaaaatagaaaatggagaaaatcaatgaaactaaaaattagttattggaaacaattaacataggcaaaactttggttagactgaccaagaaaaaagactgaagatacaaattatcaaaatcgggaatgaaagaggagacatcgctcctatccctgcagaaattaaaaggattataagggaatactatgaacaactttatcccattaaattagacaacttagaggaaatgggcaaaatcattgaaagacataactactaaaactcaagaagaaatagagaatctgaatagagttatactaaataaagcaattgaattagtaactaaaaatcattctacaaagctcatacccagatgactactctcatgaattctattcaacatttaaataataaataatagcaatctttcacaaacttttctggaaaacagaggaggaagtacaactcactcagcgaagccagtattgtcctataccaagccagatgaagacattgcaagaaaagaaaactgcagaccaacatcatgaatagaggtgaaaaaatcttcagtaaaatatcagcaatattagcaatacatagaatggattatataccatgatccagtgggatttatgccaaaaagatttaacatcaaaaatcaatgaatataacacaaaaaatagtgaaataaaggataaaacacacataattatcgttagacacagaaaaacactttacaaaatcaaataccattcataataaaaattctcaacaaattagaagtagaagtgaactttgaactaaggggattcatgaaaaagctgcagctagcaacatatttaaatggcaagtgtgaatgctttcttcctgagattgggaacaaggctaggatgtctgctctcacaattttatacaacactggaatggaagttctagctggtacagtcaggcaagaaataaatgaaagacatctagaccggagaggataaaactgcctttattcacagaggatgtgaccctgtatatagaaaatcctaaggattccacaaaaaagttactacaactaatgtgttcatcaaagttgcagaatacaagaccaattgatttcacaaaaattaattatatttccatatactataatgaacactctgaaaaagagattaagaaattaactccacttacaatgacaccaaaagaatactcaggaataactgaaagaattgtacactgaaaactacaaaacattgctgagtaaaattaaagacctaaataaatggaaacattcaaacttcatggattagaagacttaatgtggttaaggtggtgattctctctaaattagtagatagatttagtgcaattcctatcaaaatcccagtgggcatttttgcagaaattgacgagctgatcctaaatttgatatggaaatgtgaagggcccagattagccaaggtgttttaaacaagaacaacaaaactggaagacttatactttctggtttcaaaacttactacaaagctacagtaatcaattcaatgtgggccaagtgcagtggctcatgcctataatcccagcactttgggaggccgaggcaggaggatcacttgaggtcaggagtttgagaccagcccggccaacatggtgaagccctgtctgctataaaaatacaaaaaaaattagccaggcatggtggcatgtgcctgtagtcccagctactcgggaagctgaggcaggagaattgcttgaactggggaggcagaggttgcagtgaaccaagatcatgccattgcactccagcctgggcaacaagagtgaaactctatctcaaaaaaaaaaaaaaagagacaatgtaatggcatagcatagggatagacatatagattagtggaacagaattgagagtctagaaataaacccttcatggtaaattgatttttgacaaaaatgtcaataccattcaatgaggagtagtcttttcaacagatggtgctagggcaattatatatctacatgtagaaagagcaatttcgactaatctcacaccatgcatgaaaaggagttcaaaatggatcatagacctaaatgtaagggctataactataaagctctgagaagaaactatagaaatatatatatctctgtatccttgggtcaggcaaagccttcttagatatgacaccaaaacacaagtgaccaaaggttgccattccctccccaacaaaaaatcgtgtggaactggcaatgtgagacaggaaggacctctatcccaaaggatcattctgagtcctagctggacacaggtatgtatatatatatatgcatatatatatatatatactaatacaagtatatatatgtacttgtatatatatatatatactaatacaagtatatatatgtacttgtatatatatatatacactatatatatgtacttgtatatatatatacatactatatatatgtacttgtatatatatatatactatatatatgtacttgtatatatatatactatatatatatgtacttgtatatatatatatactaatacaagtatatatatgtacttgtattagtccatgttcacactgctataaaggtactacgtgagactgggtaatttataaagaaaagaagtttaattgactcacagttccacatggctgcggaggcctcaggaaacttacaatcatgccagaaggcaaaggggaagcaggcatctttttcacaaggtggcaggagagagagaatgtgcaggggaagcttccacttttaaaaccattagatctcatgaggactccctcactatcatgagaacagcatgggggaaactgcccccatgatccagtcacctcccactaggtccctgcctcaacatgtggggattacaattcgaaatgagatttgggtggggatacagagccaaaccatattattccacccctggcccctcccaaatctcatgtccttttcaaatttcaaaaccaatcatgcctttccaatagtcccccaaagccttaactcattccagcattagctcaagagtccaagtccaaagtctcatctgagacaaggcaagtcttttctacctgtgagcctataaaatcaaaagcaagttagttagttctaagatacagtgggggcacaggcattgggtaaatgttcccattcgaaatgggagaaattggccaaaccaaagaggccacaggccctatacaagtccaaaacctggcagggtacttgttaaaaaaatttttttttaattcattaaagctccagaatggtctcctctgattccatgtctcacacccagggcatgctgatggaagaggtgagctcccagggcattggcagctccttccctgtggatctgtaggggacagtccccatggctgctttcaaaggctggcatcgagtgcccctggcttttccaggcacatggtgcaagctgtgagtggatctaccattctggggtctggaggacattggccctcttctcacagccccaccaggcagtgccccagtggggactctgtgtgggcaccctgaccccacattttccctctgcattgccctagtagaggctctccatgagggctctgccccagcagcagacttttgcctggacatccaggtgttttcatacatcctctgaaatctaggtggaggctcccaaagctcagctcttgtcttctgcgtacctgcaatcccaacaccatgtgtcggctgccaaggcttggggcttgcaccctttaaagcaatgccccaagctgtatcttggccccttttagcctcggcttgagctggagtgactgagacttagggtgtcacgccccagggccacacagagcagtggggccccaggcctagcccacaaaaccatttttctctcctagccttccaggtctgtgataggaggggctgccacgaagatctctgacacggcctggaggcattttccccattgtcttggtattaacattccgttcctcattttttatgcaaatttcttcagccagcttgaattcctccctagaaaatgggtttttcttttctaccacagggccaggctgcaagttttccaaacctttacataagttccaatctcaaaccatctctgtgaatacatctgactgaatgctttcagaaaatgccaggtcacctcttgaatgcttttctgcttagaaatttcttctgccagataccctaaatcatcttttgagttcaaagctccacagatctctaaggcagaggcaaaatgccgccagtctctttgctaaagcatagcatgagtgaccttcactccagttcccactaagtttctcatcttcatctgagaccacctcagcctggacttcattgtccatatcactgtcagcattttggtcaaaaccattcaacaattctttaggaagtccacaactttcccacatcttcttttcttctgagccttccaaacttttccaacccctgcctgttacccagttccaaagatgcttccacattgtcaggttatctttatagcagtaccccactctgctggtaccaattctctgaattagtccattttcacactgctgtaaagaatacctgaaactgggtaatttttgaaggtaagaggtttaactgactcacagttctgcatggctgtggaggcctcaggaaagttaacaatcatggcagtaggcaaaagggaagcaggcatcttcctcacaaggcggcaggagagagaatgtgcaggggaaactgccacttttaaaaccatcagatctcgtgagaacccgctatcacaagaacagcatgggggaaactgcccctgtaatccaatcaccttccaccaggcccctgtcttgacacatggggattataattcaagaggagatttggctggggacccagagccaaaccatgtcaatactcaaatggaataactgaagagtttactgaagggactagttacaaaggtatgggcagagtaagagaaactaacaagggatggtacaggaagcagaagtcagggttagtgacaacaggaagcctttactacttcttgacctatcagggaaaatggagagaactaccagagagcagctgtaatggaaaggctgtctgacatgagctgtggtcttcattgcagaggagaaacttaaccaatgtgatctggcaaggaggaggaagtagaataaatatcttggcctctctgttcttcctttgatttgtagccactggcttctactggccaaacccatgtaaaagtccaagggcaagggggtcctttgatgaagttcatggaggtcagctgaccaggcttagaacaggatggagaagagcagagtgaaggtctggagagacaaatggaaaatgacaaatggaaaatgtctagcacatccactttcagaccaagtagtacaatagctatgggataaaggaataacaagacttggctcagtgtgtttgtgaccttgacaacagttgcttttttggaaaaactcaaggttagcatttatattgttattttctgtgttatcatttgatttctagctcaataataaagtcaattttctatctgaacattgagtagtttataattgcttaaatattttcatgccattataattagacccagaatttatttattgattaagagccatctctctttttggaatattgtggttcagttaattgttggcaagtgatctctcatgggtaactcatgtcctggagttacttaatactttatcaagtatattcttttaagatggtagtcagagaagcccatacttaccaaaaaagtaagaaaagatgtcctctttgagaatctttctggaaatataagtaaacagacttacaaacaaatattagagtttgggggggagttttttgaatatggaagagtggatttttgccattttgtcaagatctattgctgtgcacatttatttactcctttagatctttattttggtaaatatttatttgagtattttatggtcccagaactaggagagccaccttgaagtttcaagagaaataaatgttacagcttctttgagaatttcataattttattagagagacaatttgtattgtataatacaaaattagacgacaacccagtgttctactgtgggaacatcagtctgcccgtgaagaaacaagggtccttgttaaactatgccacttaacaagtcaacatcatttttgccaagtcatttaacttatctgaccttctgtttcctcattgttaatgttcctttgatctctgaaattctgtgaaaatcaaattccaagtaacagaaatatacattggctggggttggtctgggaagacttcataataactgtgttttctttgagatgtctaaaggaaagttcaacctttttagagaggtttcccttgatagatggtgtgtggcattgttttttcactgggcagtgatctgcagaagtcagagagcaaaaattttcaagattatggggcccaaggtgaagaagtttaaaaagctgtttctcccctgaaactggatgtgtgcctttttaaacgattccatcttgtttgaccagcttcctgctatatattcatactgtggaaatggttcttttctggcatttttcactaacaaaatttagcaggagttaagttgaaagtgcatcttaaacatcacagttggggaaatacaggtgtttgtgttctgttcattgcatcactgacttttttctgtaaacacaaaaacaatgcattctatttctgagatattgtcttgaagtaacattaaaaaacacaatcttggaaatatgtggaattctgttgaaaatattttttcaaaagaaattttaaactgtaattttttaaaagcaaaaagtgattgcaatggtatacttagtgtttaaagaatttaagtgaaataggatagctaactaaatttaatgattcacctaacttttccttctgttataatttgttttcctttattaatgagaaatgctaagttggagttgacaaattagattcttcacacgtgaagaccctttttacttgagtttgccttctgtctgtctttacaagatagatttatgaagaaggaataggtctctgtgaacaacctggacaggctcaaaactggttatggtcacactaaagtaaggttaatatttgacactattcaatgtaagaaaatttcttggtctttgaaggaagccctggaggaagactatttgataaaggataggtacaaaacaagttagtgcttaaaatctagcctctgacaatgggataatataaaccttttccttgtgtttttatttctattgtacttatcactgtgacatctaagtaaagcaatgtgaattactatgcttgtttgcctactgtgtagataatacatttttaatgatctgctattgagaggtgacagcatgctggcagtcctcacagtcctcagtcgctcttggcacctcctctgcatgggctcccactttggcggcacttgaggagcccttcagcccaccgctgcgctgtgggagctcctttctgggctggccaaggccagagcccactccctcagcttgcagggaggtgtggagggagaggcgtgagcgggaaccagggctgtgtgcggcgcttgcgggccagctggagttccgggtgggcgtgggcttggcgggccctgcactgggagcagtcggccagccctgctggccctgggcaatgagggacttagcacccgggccagcagctgcggagggtgtactgggtcccccagcagtgccagcccaccggcgctgcgctcgatttctcaccgcgtgccttagctgccttcccacggggcacggctcgggacctgcagcccgccatgcctgagcctcccacccactccgtgggttcctgtgcagcccgagcctcccctacaagcgccgccccctgctccatggcgcccagtcccatcgaccacccaagggctgaggagtgcgggcacacggcactgggactggcaggcagctccacctgcagccccggtgcgggatccactgggtgaagccagctgggttcctgagtctggtggggccttggaggacctttatgtctagctcagggattgtaaatacaccaatcggcactctgtatctagctcaaggtttgtaaacacaccaatcagcaccctgtgtctagctcaaggtttgtgagtgcaccaatcgacactctgtatctagctgctctggtggggccttggagaatctttatgtctagctcagggatttaaatacaccaatcagcacccagtgtttagcttaaggtttgcgattgcaccaatggacactctgtatctagctgctcttgtggggccttggagaacctttatgtctagctaagggattgtaaatacaccagtcggcactctgtatctagctcaaggtttgtaaacacaccaatcagcaccctgtgtttagctcaaggtttgtgaatgcaccaatcgacactctgtatctagctgctctggtggggacttggagaacctgtgtgtccaaactctgtatctaactaatctgatggggacgtgaagaacctttgtatctagctcagggattgtaaacacaccaatcagtgccctgacaaaacaggccactcggctctaccaatcagcaggatgtgggtggggccagataagagaataaaagcaggctgcctgagctagctgtggaagggaaggtccccttccacactgtggaagctttgttctttcgctctttgcaataaatcttgctactgctcactctttgggtccatgctgcttttatgagctgtaacactcaccgtgaagatctgcagcttcactcctgagcccagcgagaccacgagcccaccgggaggaacgaacaactccggacgcgctgtcttaagagctgtaacactcaccgcaaaggtctgcagcttcactcctgagccagcgagaccacgaacccaccagaaggaagaaactccgaacacatctgaacatcagaagggacagactccagatgcgccaccttaagagctgtaacactcactgcgagggtccacggcttcattcttgaagtcggtgagaccaagaacccaccaattccggacacactatgttctcagaatgttcaaggcaaagtgaaaatttccttgtttagaagccacttttcactcacccttactggaagcagctggcttgagggagcaggttcttagatggtgttgatttctttctatatatatgtatatatatatatctcttctgaaacatatatataaatatatatttaatatataaaagtatatattaaatatatattatttatttaatatatataaaatatataaacatatatattatatatatttcttctaaaaaaatcaggatacatgtgcagaacgtgcaggtttgttacataggtacacgtgtgccatggtgatttgctgcacctattgactcgtcccctaagttcccttccctcatcccccaccccacaacaggccctggtatgtgttgttcccctctctatgtgttctcattgttcacctcccacttatgagtgagaatgtgtagtatttggttttctgttcgtgtgctagtttgctgaagatgatggcttccagcttcatccatgtccctgcaaaggacatgatctcattccttgttatggctgcatagtattccatggtgtatatgtaccacattttctttatccagtctatcattgatgggcatttgggttggttccatgtctttgctattgtaaatagtgctgcagaaaacatatgtgtgcatgtgtctttatagtagaataatttatattcctttgggtatatacccagtaatgggattactgggtcaaatggtatttctggttctaaatccttgaggaatcaccatactgtcttccacaatggctgaactaatttacattcccaccaacaacgtaaaagcattcctatttctccacagcctcgccagcaccttgtttcctactttttaatcgtcattctaactggtgtgagatggtatctcattgtggtttggatttgcatttctctgatgattagtgatgttgagctttttttcatgtttgttggccacataaatgtcttcttttgagaagtgtctgttcatatcctttgcccacttttggatggggttgtttgtttttttcttataaatatgtttaagttccttgtaaattctggatattagaccttttcagatgggtagattgcaaaaattttctcccattctataggttgcctgttcactctgatgatagtttcttttgctgtgcagaagctctttagtttaattaattagatcctattgtcaatttttgcttttgttgcaatcgcattcggcctttttgtcatgaagtctttgcccattcctatgtcctgaatggtattgtgtaggttttcctccagggtttttatggttttgggttttacatttaagtctttaatccatcttgagttaatttttctataaagtgtaaggaagcgttccagtttcatttttctgcatatggctagtcagtttgcccagcaccatttactgaataggagatcctttccccattgcttgtttttgtcaggtttgtcaaagatgagatggttgtagatgtgtggtattatttgtgaggtctctattctgctccattggtgtatgtgtctgttttgctacccataccatgctgttttgattactcatgctgttgatttctattataatgtcattcaaggtgaatgtgggttcatggagactcagactaaactttagaagcttgttgaactgtaacctttatcatctacataatttactccagaatgtctttgaagtcaaacagaagcagatacttggcttgaaatagattgactagttactgacccttcaacatgcaaatcatgaaaataagacttctagttagtttaagatatttctccatcatgcattatggaatccatttagtatgatttaaagaagggagcacttttgtatgaacaaaaatattttgctgcctattgtgaagtaatttttcctaaaatacagcattacaaaaatgcaatgtacatttttttcagtgcactgttagaattacaagtctgataagtatgtcctgatttttattgttgtggttgtgttggtttttaaaacctgatttgtcttaatagggggttaaattgaaagaatatagttgctgtttctagaaatcgagcaaacactgcagcttatataggctgcttagtccagtgtctctcagaagggagtttccatcccttcttgccacagttaaggagagtgtctaagagcagatctggagtcaagctgcctgggttcacctctgtttataagctgtgtgatcttggcaaatttctttttttttaaaatattaaatgtttatgggtacatagtagatatatatatttatggggttcatgagatagtttgatacaggcatgcaatgtgaaataagcatatcatggtgaatgtgctctgtcccctcaagcatttatccttttgatacatttatccttttgatatccttttgttacaaacaatgcagttacactctttaagttattttaaaatgtacaattaagttattattggctacagtcaccctactctgctatcaaatattaggtcttagtcattctttttaattttattttttttgtacctgttattcacccccaccttccctacagcctcccactactcttcccaacttctgataaccatctttctactctccatgtccatgagttcaattttttttcattttttagaacccacagataagtgagaacatgtgatgtttgtctttctttgcctagcttatttcacttaacataatgatctccagttccatccctgttgttgcaaatgactggatctcattcttttttatggcttaatggtacttcattgtgtatatgtaccacattttctttattcatctgttgatggacatttaggttgctttcaaatcttagctattgtaaacagtgctgcaacaaacataggagtgcagatatctcttcaatatactgattcccttttatttgggtatataccctgcagtgggattgctggatcatttttagttctgtgagaaaccttcaaactgttctccatagtggttgttttaatttacattcctaacaacagtgtacaagggtcccctgttctccacatcctcaccagcattttttattgcctgtcttttggataagagccattttaactgggataagatgatatctcattgtagttttgatgacatttctctgatgatcagtgatgttgaacaccttttcatatgcttattttccatttgtatgtcttcttttaagaaatatctattcagatcttttgcccattttgtagctggattattagatttcttcctgtagagttgtttgagttccttaggtgttctggttattaatcccttgtcagattggtagtttgcaaatattttctcccattctgtgggttgtctcttcactttgttgattgttttatttgctgtgcagaaggtttttaacttgatatgatcctgtttgtccgtttttgctttgattgcctatgtttgtggggcattgctcaagaaatttttgcccagaccaatgtcctagagattttctcccatgttttcttgtagtagtttcatagtttgaggtcttagatttaagactttaatccatttttattttatttttgtatatggctggagatagggggtctagtttcattcttctgcatatagacatctagttttcccagcaccatttattaaagaggctgtcttttccccagtgtatcttgtttgcacttttgttgaaaatgggttcgctgtaggtgtgtggattttttctgggttctctattctgttccattggtctatgtgtctgtttttatgtcagtaccatgatgtttgggttactatagctctgtagtataatttgaagtcagttaatgtgattttttcagttttgttctttttgcttaggatggttttggctattctgagttttttgtggttccatataaattctagaattgttttttctatttctattctttgaagaacgacattggtattttgatagggattgcattgaatctgtagattgctttaggtagtgtggacattttaacaatgttaattcttccaattccatgaacatggaatagcttcccatttttttttttggtctttttcaaattatttcatcagtgtttcatagttttcattgtagagatcttcatttcttttgttaattcttaggtattttattttatttgtggctattgtaaatgggataactttttaaaatttctttttaagattgttcactgttggcatatagaaataccactgatatttgtatgatttcgtatcctgcaactttactgaatttatcagttctaagagtctttcagtggagtctttaggtttttccaaatataaaatcatatcatctgtaaacaaggataatttgacttcttccttttcaatttggatgccctttatatctttctcttgtctgattgttctagctaggacttccattattatgttgaacaacagtagtgataatgggcaccctcgtcatgtttcagatctcagaggaaaggcttttagtttttccccattcagtatgatactagctgtgggtctgtcatatttgtcaaatatgcttttattatgttgaggtatgttacttctatattcagttttttgagagttttcatcatgaaggtatgttgagttttatcaaatgcttttacaacatcaatggacatgattgtatggtttttatctttcattcttttgatatcacatatcacattgattgatttgcttatgttgaaccatccttgcatcccagggatatatcccactcggtcataatgaatgatctttctaatgtattgctgaattcagtttgctagtattttgttgacaagttttgcatcaatatttatcagagatattgacctgtagttttatttatttatttattttgatgtgtcattgtctggttttggtatcagggtaatactggcctcgtagaatgagtttggaagtagtccctcctcctctattttttggacttttctttactgggagtctttattatggctttgatctcattacttgttattggtctctttaggttttgaatttcttcctggttcaatcttggtagattgtatatatctggttatttttctgtttcttctagagttttcagtttattggcatatagttgcttgtagtagccactaaagatttttttaatttctccagtaacatttgtaatggattttatttatttatttatttagagacagagtcttgctctgtcaccagactggagtgcagtggtgcgatctcggctccctgcaatctcctcctcccgggttcaagcaattctcctgcctcagactctcaaatagctgggactacaggcgcctgccaccatgcctggctaatttttgtatttttagtagagatgggggtttcactatgttggccaggctggtcttgaactcctgacctcgtgatccttttgcctcaacctcccaaagtgctgggattacaggtgtgatccaccacgcccagccattttgacttcttagtagccattctgactggtgtgagatggtaccacattgtggttttgatttgcatttctctatacgccacagttacagtgttataatatcctgtgtttttctgtgtacttactattaccagtgagttttttaccttcaggtgattatttgttgctcattaatgtctttttctttctgattgaagtactccctttaacatttctcatagaacaggtctggtgttgatgaaatttctcagcttctgtttgtctgggaaagtctttatttctccttgatgtttgaaggatattttaactaaatatactattatagggtaacagtctttttttccttcaccactttaaatatgtaatgacactctctcctggcctgtaaagttcccattgaaaagtctgttgctagatgtattggagctccattgtttatttgcttctttactcttgctgcttttagaattctttctttatccttgacctttgagagttagattattaaatgccttgaggtggtcttctttggattaaatctgtttaatgttttctataatcgtcttgtatttggatattgatatctttctctaggtttgggaaggtctctgttattagccctttgaataaactttctacccctatctctttctctacttcttctttaagaccaataacttagatttgccctttccagcctatttcctagatcctataggtgtgcttcatgttttttattctttttttgtctcctctgtgtattttcaaataacctgtcttcaatctcactaattcttctgcttgatcaattctgccattaaaggactctgatgccttcttcagtacgctttttgcatttttcagctccagaatttctgcttgattctttttaattatttcaatctcattgttaaatttatttgatggaattctgaatttcttctctgtgttatcttgaatttcttgggtttccttagcagaggttttttttttttttttttcaggaaacacaaattttcatgaaatttgaaaattcaaaccacagcatgacattaagaaaacacaaatattacttatccagaagaaaaagtgttttgaactttttcataaaatatttaggaacaaggaagttgaagcttggagcggtagagtgagaaataaggaatatgtgggagagaaagtaaagtgaaaaaaattagatcagattttttttttgttgttgttagcactaaactggtttgcttcaggcccctagccagggttgattttgaaacctatagcagagctattttgaatactctgtctgaaaggtcacatatctctgtttcttcaggattggtcccttgtgccttatttggtttatttggtaagttcatattttcctggatgatcttgatacttgtggatgttcatctgtgtctgggcactgaaaagttaggtatttactgtagtctgcaatcttggcatgtttgtacccatccttcttaggaaggctttacatgtatttgaaaagtcttgggtattatgatctaagctatatctgctttaaggggcaccctaagtccattataaaactaatgatgaatgtgcaacagatagtgttataaaatttaaaaagaaaattgttactaaaatttttattgacaaaaacagatctataactgtttgaactccccaaaaggtaagaattgtactttggctctgatttattaatatgatatatcctttacaaaaaaatttacctagtattatatgttcaatagtttttattttcatttataaatataattttagtcatttttttgtccatcataaatccctttttccttcatactgatttttttctgcaaagacctttaaaaaactatttacctagggttagttgcagctgaggctgcatcatcacaaatccagagttgctcttcttgtatgtcagaaaaagatcagtgagggagatgagtgtgtacaatgcagttctaaagtcacaggtggacctataagccaccatcatcgctttgggagacataggcaacagaaatcctaagtgcttcatgtaaactaagtcatttaatccccaaaactaccttatgaagaaagtactgtttccatttttcaaatggggaaaatgagagttagagacattaagtcttgcccaggtcttttggactctcacaaatattcctccataatccccccctccaaaaaacccctttatagtttcctggatcttctctttaagcaacacatttcagggccatgtctcttgctgtaggctgccagcaaatgatagcagcagtagcaccagcagcagcagacttatcagattggtgtgctcgttgcactcagcatgctagtagtaccaggcccagttggtatttgttgattgatgatcatagtatcatcaggaatggaatagctttctgatcagtattattgaaatgaggccaaggtacaattttgcttggtaacatacgcttaaacttactcttgaactgagagtttggattttttaaagtatatctgtatggaaaagattgttaatttcatatgatccactgtaaagctggaccttcctttaaacagtagcagagagaggtggtggtgtgatttatttctccaaagacttgtttaatcttcaaatataatttcacttgcaattccaatattggtcaatatttccataaaatcacctattttttgttataaaacttatatgaattttacattccactcaataacatatatttatatacacatatatgcatgttgcaatgtaaaaattgtttacgttacttaccatcgagtaagactggtgctctaggaaagttctctctgtatagacagagaccttaagactttaagatactaaggcttctgggtataataataccacattgtccagttcaagtcacttcaagacttctggtataataatacacattttcctttaagactttaagatttctggaacaaagtgtgattatgtgtgagggatcaactcttttattatgtataacttatatttaaaatgttcaaaagaggaaaaatgatttggcttctttaagaaagtctctttttgatgcagtgtaatctttaaatgttcctcataaagtacttttgatagaagttggaatcttcagggaagaaggagctaatgattgtctgtgtaatcattaggttgtggcattctcatcagagcatctgtgacagacaactcaaggtgtatctatgtgctactaaagtgttagtttctctctcttgagttggccctggaaggctagtgatatggaaatatctgagtcataggaaatgtagtttccagttttggctcagttattaaccagctctgtgaccttatgctagtcatttatattatctggagttcagtttctttatccataaagtgaagagttaaaacaaaatgatatatagctttaatagcatttgaggaaggaaaccaagttcctccttttttctagatttggctcaacaaagctgaaaagtaaattttctttaaattttaagggtggctttggtctggatggtgtgtgtatgtgcatgtgtgtcaggcaggtagttgaaaggccaacctcactgtgatgttttatcccaagtccagatgtaccactgttatatctccaggtacatcttttaactctaggaagtaaacacagtttttactgtaaaggtaaaccagaaagttaagtttaaatcaagtttgaatataatttgtacttggagtaataaaccttttcccacagaggaaacagcactagcttgggagttcgtttccaaaagctctactgaacaagcacaggtttcagctcacttttgtacctgtttctctgtcccttggtgggctccctctaccagcttcttaggcttctcagtcacttgtctgcttgacttgagactcagcacatgtcttacgagtaaagacaacgcaatgaatgttggtttcacttcaatgggcttcctgtctttctggatcttggatcctcagatcctggctgccttaaaagctctccaaatctttgatatcctacttttctagttgttcttagaagtagcattggtttgctgtgagctactttgtcatagccagaagcaacagttcctcagtttattttctttgtattaaaactcttttctggatagagtatagtgcaaaattctgctgcccaattcagaattaaagagtgtggttggcaggtttggtggataggctacatggataaatggaagtaccaggtttcgtggatttttcatttgctttagttagatgtgtcatttcttctattttatatttattttagtgaaggcaacatttcaattatgtatttaaataaatattttattatggatagtaaaaattttaataatctactaatatttaaatttttatttgtaggtgagtacaatactagaatgcacagtgaaacctaaactcaaaaaagctgtattgttataatcaatatgaaaaatatatatgatgaaaggcttttacaaatgtcatagtatgtctcttattttacatttattttctcttgagtaatcagcatggtttaaatatgtctttggatgattgtgggaaaaataaaagtgtcttaaaaataaaagtgtcatctacgttatagtttatggatatattataaacatcattagacacacaacttctaccattagaatttataagtcaattattaacttaaaaagaacccccaaattttccctaaccagagcatcagatggcaaatccagaattagcaataaaactcctagattcccttcttccctatgcttttatttgcttattataatgaagatctttggggcgagggtatttttactaacatatatgatgggaagtcctgctcaatagtcaagggaaaaggacccatctttgacttatttttttcattttttgctctctgtggtagccctaagagtgtacttcacagacctccaactacaggcaacctaagtgaccaagggtcccagctgctgttctctgaaatccactgctgcttttgtgctgagcacttgcttcccaaaggctgctcccagccactgattgagaggagcagggatactaaagctggcccctccctgtccttgggagtcacctggctctagcacttcctgatgggcttacagaacctttcttagagggtgtagcaatgtgggatgattccacttaaccttccttgcatctctccaccactctgtgtcaaacttctattgtttttatcggcttttctagtcttccttggctccctcatcattttatattacgggaattttccttaatgaaattcttgtatgttcaatcttgtcttcacattcattttcagaggtcctagactaacacattctctatttctataaaaagatactatcatatgaaattactaaggaaaaaaaaatgtttgctataattttaatggtaatattctgatactactagattctcaaatttagggaagtcaaaacttcatataattgagagctctcctcagaaatttattcttatattagtttattgatagtctgtatgtaaacttgctttcagaaggactgaattgttacaatagtaaaatcaggagctcatgttctcagaaaacgttaatttactcaggatgattagatggctgtaaagtaaaaagcaatccataagtcatctttgagatatctaagggtatttagtgagaaattgaaaggaaatattgctgagggtgtgttgataactgatactttgttgaaaagcagaaacattcaatataataggtagaagtaattttgtttcttgcatattggtaatttcattttgtgtgacttacagaagagtgcttgttctttatatgttagtgttaaaattcttctgtctttctttgcagaatcatagtgaaagattcgttttcattgcagagtggtatgatccaaatgcttcacttcttcgacgttatgagcttttattttacccaggggatggatctgttgaaatggtaaataagcctttctttgcttgaatgttggcaaagggggtgaacatgggaaccattgccttttatataattgctttttaaaaacacatttatatgtatgtgtgtgtgtatatatacatatggaaattctttttaaacttattcattataattccaatataagaagttaacttgtgcctttatttttaatgtcaaaaataggaattttttgttgttgttgttagaagactgaagtgggggctgggcgcggtgcctcatgcctgtaatcccagcactttgggaggccgacccaggcagattacttgaagtcaggagttcgagactagcctggccaacatggtgaaaacccatctctactaaagatacaaaaaattagccgggtgtggtggcacatgcctgtaatcccagctactcgggaggctgaggcaggagaatagcttgaactcaggaggtggaggtggcagtgagctgagatcacgccactgcactcctgcctgtcctgcctgggcgactgcatgagactcttgtctcaaaaaaaaaaaaaaaaaaaaaaaaagactgaaatgggattattcatgttttggataagaaataaacaagtgattatagataaggattattatggtcataaatacgtcctcattattgaaagctgttattgctacaaaaagtcaaattgaagaggctcaagctaagagacttctgtttctttgtgttctttcactggcaacacaattttaacaagtagatctttttggtattgggattttgtgtacacaagaaagcagaaatttgggtgtatgactctttctttagcattttgtaaggactactttgctgaaatgatttggtaataaacaaatctttctattcaggtttttaagagtattaaatttgtaataagaagcttttatgttattaccagattggattaggaaatatggaagttattaaaaattatgatttatatttgtaacaaaaaagaaacagaatataacctatctttgataagacagaattaagaattatttctaccttatgatgagattaactttccttattcataactttttttgtttgtttgttatattgttgtgtctggttctagcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaagtaagaaaacaattatataatctttttacatgctctaactttgggttcaaagtcaatctgaatcaagactgggagtatgtaaccatatgaggatggataggacctggaaaatggttgtcttcattctttttctttttttcaatttaaaaaaaaattgataataccatagttgtgcatgtctcatctgacttaattcatgtttatgtctcctgtggcacttagcacatctccatccacattgcaagcaccttgtctgtattagctgaacgaattaatgaatcacaatttaaaatctatgatctattctttcctttttccactttctccctgttttcaaatgatgatctttgatctagttgaccaggaggtttttgcctagattgtttgtaactaatgctgcctattgtcaagttttgttaacagatatatatatatatatttatatctaatagatgttgaccaacggatcaattgaaaaatgacaatgtgagtgttgtaaaaaggaaaaaaaaaagaaaccatataaagaaattatgatacagggagactgatgtatcttattcataactgtatccctaaaaactgttgtagtgatacctcaaacagtaaattattcacagagtgtgacccacaaaagtttgttaaatatatgaatgaataaatttatgtcatcgaaatgtctggaggtacggtatgtctaaaggaagagtttcccactggctggcatccccgcctccctatcttcctcccactgcatgtggctctttctgtgagagaaactgtgacatggtgcctccacatgtgtccctgttcttctctctattgtttgtcaaagctgcattcatcattctttttctcagttttgatttagaagagatacagtcatctgtaaaaggggctaagaaaaaaaatggaagagaaagaacaacttgtagatacagctgaaaattagacttatagaaaacaagaaaacaaggatttttgatgttttccttctgaatactgattttcagtattagcaagatgacattttaattttcagtctctacatttatgaatttcaactttctgagactagaattaattatatttgaagtgaaattttaattcctttgtcatctttcttggctttaatttctgtagcttatactttgtatggtttggggagtttttttttcctgtagagtgattggtgctgtaattaaaatagggattatttgtagaagttaaggctatatgtataaaaggctccaaaaatgatttaattcaatagggaaaacaaatcaatcaaactattttttgagatctactactcaaatgactagctgattgcctaacgtctgagtcactcttatagtaatatgatatctctttctgtgacttccatagtctttctgtataagcactttatagctcttgaggtgattggattcttagtgtgggtgttagtacacaaatggtgatggatcagaggggtggtgcatgcctcattaaaaaggaagaccaaagactctctttgaaataggacagaaatttcaggtattagataaataaataggaatcttttaatgttatgagatcttatgtaaaagtctttgggattaaagaaatgccaaccataattcctttatttaaaactcataaatatgtgtagcattcatttatggagcacatactatgtgccagacactatgatatgcactttacatacacctcagttcaagactactttattttatttaattattgttatttttgaggtggggtctggctctgtcacccaggctgaagtgaagtggcatgatcatagcccactgcacccttgacttcccatgctcaagtgatcctcccatctaagcctcccaggtagctggaactacagccatgcaccactattcctggctaattttttggtattttgctagagatggagtttggccttcttgcccaggctggaagactgctttaaatttttatttaaactagcaaaataagtgagttagggagtcagggttaacagtctgacctaagaaaaataaaataacaaccataaaaattataatttatgtattttaactatgatttgactgaagtgaatgttgttaaatctattttatagaatgggtaagtaacttgtccacagtaacacagctagaaagtaaagggaaaccagaaaaccgtgttttgtttttccctaaaattcattctctttctactaaacctctaattaatatgctggcaaatactgttgaatgggactgattttaaaacaggatgaacagaagaattctattttaatgtaaaaacaaatttgaagtatttgggctttatatagttaatgaaaatgaaaatatatgtagtatatattttactgactcaaattgattcaccattttctcttcttattctttcttaattgcatatgggttagtaaatccaacaaccatttgggtgatttaaataaacttcttccaaaccgaagagtttcaaaaatttattgttttatttaaatggcaaaaagtaagcatatggaaatatgtgtgtatgtctatcagcgttccacagaaacaccttctatgtaacaaccgatttagtctagttctcagttttgtatagtgttgagaaaaatttatgaaccaattacattttcaactcttttctttctatagtaaagcctgtagtgaggaggatgagtgaaattgatccccatggagcctatcagctaattggggagcagttatccagataatttaatataattcagcttaactcatgaactagcttcagctttccaattccctttgactgtagaaatctgacatttgattcacatttttatcctctctttataaagatcctctaatcaaatggataaaggttacaagttgtcaatgagtcagtctttgattttaattttagctagtaattaattggtgctttatgattgttgtttagatttggagacacgatacaatttgtgtctttctaaaaatttattacctcaaaccagaaataattaaagttttcatatgatgagtcaatatgtatatgtatgcatgtgtatgaatgatagaggaattttatatgaatagacagctattccccatgtgataagtgaggtattaaatgtttactttgatagcttatatctttagtaagaagtttataaaaatcaatgaaaaataatgctagtatcctatttaaaaatccattaattttaagtactgagccacatatttacattgagcaatcctcattccttttgagtctcagccagaaagcaagccatctaatcaaattaaagggagaaaggcatcagtaggttgggtgaacaacattatagtagatgttaaatacatgaaattcttgtgcccatctattaactttcagtgaaaggaagacccccctgtttttcagaagaaaaattatgaagtcaactgtgtgtataatctttgatcccaaggtctaagcccaagttatttgaggctccatcacagcaggaactcagtcacagtatgcattttcctgtcctcttggagatgtactgaaatggtatatggataaaaaaacaagccgtattttagatgagacctgtgcttggaaggggcttaagaatacttctccctggaggtagggagattgacctaaataaccttttgaactaaatcaccttttgaatttttaaatacagcccaaaaattccaagcatttgcttaattgataattttttaaaaggtactgaaataatactttatatgttttctagacttatgtagtttaacaattcttatggatgaacatacattttctaatattagaatttgactcatatgaactatacgttttttctatgtgaagatttggcagtatcatcagatatatgtttgaagaaatttcattggaaggaaatgtcataaaatcttggctatatcaagtttgaaacaacttcagtgttcaggtattatatagtttagcaggattacagtattgggatatcataatgtatgaatgacttaaaagacattttaattttaattaaaattaaatttaaaaattaaattaaaattaaaattaaaattaaattaaatttaattttaataaatacaaaaaatgtacctcttctgttcttccatcccaactggaataaattaagtttagaatactttaaaaattattattctgtcttcccctggttgttatggcacttcaccaccgctacccccaccgctgcttccatctctatctctctggctattttttctcagagtcattccttctcagaggcaaaaaagactcctggtattccccagggttctgttcatggccctttttttctcattctatatactctcccaggggattctatgtactccatgacttcaacaatgtgttgctttccaaatttatgtcatcaccccagctgtaaaaccatatgtttaagctttttcctgaacgtttccatgtagatttttcacaggaacttaaaaatccaaaattgaattaattgacaaattcaaaattaaattaattctctttcattgaaaaacctacttctgtatgcactaacacaatattcacctaattacatacttacaaaattggtggctgtccttgagttccatatgtattttatccctaaatccacatggggacctaatcttaccaatttacttgtctccttcatagatctctcttatttctcttctcttttttatcttttacattcctccttaaaacagcttcttgtcatctcttgagctcagttagtctccattcttccctccaaattactaactgatgaagaactaacacaggagatagatgtagatcaaaatattaagtattaattttacttaggctgtcttgtgaaagcgtgtttgagaatggttgaggctttctttctattcctatttcctctatcccttacactgatctggaacttgaggcctgcctgaggaaaagttggatctacagaacaaactaagggcatacttgcccagggttctcatcctgcctcccagcccatggagcacaggagagagagcactagagagaaacaggcttccactgcaggtgccggactctgattccaatgtgcttaacatgtgaaagcaggagaacaatacgctatcccttacttgtacactatcccctacttgagggtctgcaggtctgagaaaaaagaggtcgggccacaaataaccagaaacccttaaatatggccggacatggagaagcaaatggaagaagtagagagagagagcactttcttatgggaacagggatagaagttactttactcatgaggagcaagagtacacattcctagttgttttctgggttttatacctttaagccaattggctgccatgctctagtagactatggctacttctcggggaacagaccagatgaatattagtttagtcttgctctcacctttgggaaacctttccctcaataccaattactgttgctttgtatattgtcctaggaccagtggtgagcagttgagttttggctgcagaagggcaccctaatgccttagaggaataccttagttcagtaacagaggccttgctaaaaactcacccccaatctttttctcatctttacttatctatagtatcgttgtctaagatggcatgctattgattatacgatagacccaacaacagtgtaactgcctcccaaataatacaatgaagaatgccttctcattattaaattcccagggagaaattgatatttttttctgtaaaataagaattctgcctttccattctacaattctcagtcatatggtccttggtcagttaacagattagagttgaatttccttttcagctccagcttgagccatctttccttagaaagggtttgattgatagcgtatttgggttaattaatatctttttgccatctcttttatacttgccctgttatgctttagatatgtctcttgtaaataacatataggttttttttcaatttaatctggaatggttatattttcattggtaaagttaatacatgtacattgaaatatgctgtgattattgttatttttgtatatgtttctattttactgttttcctgtttttctatttttttcttcttgccttttctttggattagttgaagaaatttttcttcctctcttcagttttttttttctattatatggttttctattgaagttataacaaattactaccaagttagtcacttaaacaatacaaatttatgatcttacagttctgtcagaagtccaatcagatctcatcaggtaaagatcaggtgttgataagactgcatttctcttgaggctctaggaaagaatcaatttccttgcacattccaacatcttgaagccatccacattccttggtttggggccacctttctccatcttcaaagccaccaatagcaggcttgagtcctcctcacactgacatctctctggttctctaaagctaggaaagattctctgactttagggactcatgtgatgagattgggcccaggggaataatccagaataatctctactatctcaaggcctgtaatcttaatcacatctgcaaagtcctttttggcaggtgaggtaatatatttatacgttctggagattataatgtggacatttttgaggggtagtgttattctgcctactatattctctgttgctttagaggttatgtgatttttatacttgttctttattggttaggcttgaaattttttcatatatttaacttacagttctataataatatggctctctcccaactcatacaacaagattaggacactttagctctaatcttctctcttaaatcttacatagttttgttattattgttgtttttggacattcagtttttttgcctgcatgttagacattcttttatttatttatttatttattttgatagaaacaacatttgcttagatttacctaaacatttgttcaccaatttttcttgcatatcaacctgtccttttagaatattttctcttcttgttattcttcatttcttcattgtaaactacccgtttctttttaatctgcacgttttttattttaccctctttctttaatgatactattgctagacacacaattctaagttgatggttattgaccaattttctttattccccttttctgctattagtagttacagaattatatattctatcaatttttaatatttttaatatatgcaattaagggtataaatttccttctaactgcttataactatatcctattatttttgatatgtaatttttattcagtttgaaacattttttactttctttgtgttgtcttctttggtttattatttatttagaattatgtttatttccaaacatacggagatttgtttttctctttttgtattggaatctagctgaattgcatgtgtctagaggacatattcttcatgatttttgcctttcaaactggttaagatttgcctctggcttagaatagtcaattattaatgatctatgtgtgttagaaaagaatgtttaggccaggtgtggtggctcacgcttgtaatcccagcactttgggaggctgaggcgggtggatcagttgaggtcaggagttggagaccagcctggccaatgtggtgaaaccttgtctctactaaaaaattacaaaaattagccggccgtggaggcgtgtgcctatagtcccagctgcttgggaggctgagtgggagaattgcttgaacccgggaggtggaggttgtagtgagctgagatggcaccactgcactccagcctgggtgacacagcgagactccatctcaaaaaaaaagaaaaaaaaaaaagaaagaaagaaaagaaaggaatgtttagtctgcagttgttttgtatagttttatatatttattcattaggtgaagtctgtgaattgtgatgttcaaatctttcacatatttactaatttttgggcagcttattctatcaattgccaaggttttattaaaattttctaatgtaattatcatttgtctatttcttcttgtagttatgttagtctttatattataattttaagggtatgttactaggtgatttaaattgttatatcttcttggtaaattgaatcttttattactatgaagagaccatcttcatctctagcaatgccttttactttaaactgtactttctctgatattactatagctgcactggctttcttttagttaacattcgcatggtataccttttccattctttttactttagattttcagtattctcttctatgtgtgcctttcattagtttttgtttttgtttgtttgttttttatatctttttttttctttaagttccgggatacgtgtgcagaatgtacaggtttattacataggtatacatgtgccatggtggtttgctgcacctttcaacctatcatctaggctttaaaatccaatcagattatctttttaaaaaaatttttttataaatacagttttataatctgcatctactgtagagcacttatttgtaacgtaactactaatatacttggctttaactctgacatcttatcctgagctttcttctcctgcctgttttattatcttatttttgattgttcggattgcttgaggatttttttcatctattttttttctatatacagttagtatttacactagaaactacaacatatgtacttaacttgataaagcttaaatctaattaatattttaacctccttctttaaaatctaagaatctcagaagactttagctcaatttttgttgggatttttgctgaattatatgctgtttttgttgtgtatttttttttgttttttttccatgaacctaatgatttactattattgttttatgtaatgagtattcatttaggtttcttcactttttgctttttatcctttcttttatctcaaacattctgtttgggattattttacctttgcttaaattacatttttaaaaaatattttccttttgagtgtgtttactaatagaaaactcagtttgcactcatctgaaaatgtctttatttcacttacattcatgaaactattttcttatctctgttgtatctttttgtttctctgtgcttcattctgaatctgctttcttctgtcaaaccctttatctagttctcattttcattattgtattttcatcacaagatattctaatatattctttttcagatctgcttattccattttgtagcttacagttttctattacctgataatgttttgtagcttgtcttttagtcctttaaccatagtttgcacagatactttacagtttttctctgattatcctagtatctgaagtatttgtgggtctctctcttttctgttgtttctcctggttttccctcatgttggccttttccctgtatgtgtgtatgtgtctgtgtgattatctttctatatgattgccatgtgtgtatgtgtgggtgtattgcatatatgtaaataatatatgtgagatatgcattttcatatgaattatttgaggtacaggatgacattactttcctactaggagggaattaattgtctttgcttctgtctttttcccataggcattagcagtctgtatgattggtagttcaaaaattctaagttttgagactgcttagatgatgtgaacttgtattgccattcaagacctggttgtttctgattcaccttaagcgggggtggtatagcctttgggtccaaattattttaggaaggatcatctcttgggttctgttaccctttcccaatgatgtactgcaaatcaaagttcagattttccagataggcaatgctgtcaagtcaaaaacaactttcattcttacttttcattctttggttgtttttttttttttttcacttttgtcccagtaattatttatgatctagtcaatttatctttaatttttaaaagattttttaaaaatatcaacttttttagtttttggtggaagaattgttctgaataattttgctattgttgccaagcaaaagtcttgatcactgaattttccaccaaattacaggtgcctcatttgagacagttttcctttatccatggggcagatatacactttatgcttgtaaacaaagtatgagaaaaaccaaaaatttagccttgatgtttagaataggtttacttttagaataggtttagaatagaatatttacttaagacaaatatgaatcccatatagattaaagtttacatatttattctttttggtcaatggcatttaaagagtccatagcactgcactatctaagatgtttaatagcactgtactatctaagactttattacatagcaatagcactatactgtctgggacatttattgtactgcaatcagtcatctttctcagaaatatatttgctgcaatttttgctcagaacctgatggtatatgaagacatttattgcatagctctgtgagaattgttattttctggaaatctatattctgggttcgtgaaggctggccatactgttttttcacaagaagtagttaccgtgtattgctaagaagttttaatcttaaatagtggtttttataatgttttgttttcttttgagaatatctcacgctgcatcttacagtgcttgcctcagtgcaggcaagaggattactaagtggtagattgttacactgatggctctcaatgaatcataccttgtggttttctctcacagtgactctgagcttgaccacgtgacttgcattggccaaagatatgtcagcaaaaatgactcaaggggacacttgataattgcctgtacattggttgatgtgtggtggtatttgaagaggcctgctctagcctccttaaggaccacaggaaagaaaagcctagttgtctcagctgagcacagcccccagctggcccactagctgaatacagctgtgtgaatgatcctaggtgaaaccattgcacagcctacctacagaaccttgagaaattgttgttttacgccactacatatgtggatggtttgttatgcagttacagataacagagatactactgatatatctttgtcaccctattgtttcttcatgtgctgtctttatttttaaattaacacatatgatgctgatctctctcttattttccctccaaaatacaatttactattacttactgaaaaattaagcagcaaagacatgacagaggaatttatttagagttatttatcacatagtcaatcctttgtctcttgtaggcatttaagagaaaatcagattacattttaagctgtttgtcaattttagacttttcacattgcttcttgtttatagacattgatgactactgccatgttttattttttctttaagagccatggtcagtgaaatgttcttccagagtttagcataaacagtttataggttagtctggattaaaatatttaaataatatgaattaaaaagtgaagagttttaagtgtgttttcaatgaagccagacaatataaagtaatataactgactcatctgctttaaaataaagaaaaacattatctggtataatttgtaataaacacactaagatgaacaatttcttttgttattacagttttaaaactcagccataagctatatccaatttaagtaaggatatttgattttttttttttttttttttttgagatggagtctcgctgtcgcccaggctggagtgcagtggtgctatcttggctcactgcaggctccgacccccgggttcacatcattctcctgcctcaacctccttagtagctgggactagtagtagcccgccaccttgcctggctaattttttgtatttttagtagagacggggtttcaccgtgttagccaggatggtctcgatctcctgacctcttgatccgcctgcctcggcctcccaaagtgctgggattacaggcgtgagccaccgcgcccggccaggatatttgaattttatcctgagctaagtttgtcttattggtgaaaaaaatccaaaatgaaaagaccaacctttctccttttatggattccttgaattaatgccagtgttataagaacaactggaaatgcagagggaaaagtagcagcaattctttatcacaaaagcagaattactccagctaatatagtttttatgttgcatttgcaaatagtattcttgaggatttggtgatgatgcccctttttaataatattaatagtaacattatttgtgatgtggaaggacagacctaggagtctggtaaactgggtgttttgtcctgaaaatgttgctgaccagctgtgtaacctttgtcatgttaccttggtaggcctagtttcatcattagtaaaatgaggacactcaggtgatcttcatctccaaatttctcttaattctgaatcttcagagggggagagtggagaatgcattgttctgatgtatcctcctggagaaaaacatgattttaaaagttagcatgttgttacgtattcatatacattgttgtataagaagacatttgattcttcatgcagtcacccatgttatgaataaagagtcaatagaagaatttataattatttccaaatcaatgttgaactgactatatagcatacatatgttgaagtctaagagaccaaaaaccaagctcataatatatttaatgcaatgttttagagattagtcctttgtataaaatgtattctaagaaatggagattctaaatgcctgtgttttctcatttggatatattaaaaataattaaattttagtgctttttttcctaagcttctccctcccccaagtttagtatctaattttgatgttcatgggaaaaatactaagcttactttgtgtaagtttttaagggatgtctttaatacacttttctatacaattaatttcaaattttgatgatctaggatgattgttgagaatactgctgcttgggaattataaataaaaactgttgaactatttttatttgcaaacttattttttgtttccttatagaacgctagccctaattaaaccagatgcaatatcaaaggctggagaaataattgaaataataaacaaagctggatttactataaccaaactcaaaatgatgatgctttcaaggtaatttttttatcattttcagttatgtaatgtctgattcctttttaaaaaatcattttctgtctttcttgtcattgtttaaaattaaaaaacctcgtattgaatgacaaagaatagaatagtaacttaaccaaaatgggaactgacaggagttcatctagaatgttactgacaaagccggccccctaaaagatttgatcttttcctattcagtgtcatgaagcccatatacaaaaccgaaagtgagtatcaagcagtgcaggctttattcagtgtctgtggaattgagaaacaggagtgtggctcacaaatcaacttctcaactagtgaggggtgagggggttaaaataaaggatttctctaataaaggacatgaaaagcaagaggagcaatatgcatgtcttttctggaaattggtggtgaacttccaccagtttcacaattgatggtgaatcgcagtgctgctttcctttttgtctttttatggcctcttccggtcattgtcatggtgattttcagctgtcatggtgctggtgggagtgccatatagtatgaaaatgagattataatgaagcccgaggtctttttgatgtcatttggttgcatatcttggttctaaccagtcttaactggtctggttgtaaagggaaccttttattgcagaagtcctgtttcttaaagataagcaaagttaggacagggtagaaattcagctgtcatgtaggcattacaccaggcaacaaaaagaaaaagaagaaagaaaagaacaataagacaccaagtaatcagatgcataaataaccactgaagtctaagtaattaggagttgtcaaattatgcatgcctcatttaattattattgtctttcaaaaccccatctgcttttataacaccagtgcttgataattataatcatttcttaatatataaggataacacactgtataaaattaatagaggaaatgatgtctgattatttttatttgacaagaggatttactgttgagatttccaaagatgatgcatttggaaatgtttacatttagctcttcttattataaataataggcaaatatacctatttattttttacctagataggtaaatatacctatctaacaagcagtacaacctgtttgaccagatattttctaagttatttagtgaaaataagacttatacatttacttatccctttctatcatgaagtaagtaactctaaccccgtaagaatggcaaggagaatattaacaacgtacaaacaaaggatagggaaaaccttctcttcagttttttttagagatcctttagaaaaaaaactagtgatttttccatgatattggacatttgtttttaaaaaatttcctaccaaatggacaaagcaaagactgaaacattctggaagatgaagaagggagatgagtataggacagaggcctttgtttcctgggatcaccctctggttggctgagtgtaacacagagtgtctctagggacaggaatgtagcagttaggcagatctggctccaatagtgttcttatgtttctccactagtttttgtttgtttttggtcagatatcttcttaatgcttcaataaatcattcatttctggatttattccatgggtcagttgcatttttgtttctgtgagagcagggacaatggggagcagtagacattcaagtcagcttcaatacatctgattccgagaaactttaacacaaaaccctccattttaccctgacaatgacatgtttaattggaatttttcccttatgtatgatctcctagtttacatattttctagagagacaggaggcttacatttcagagcacagtatttagaccagattgcttgtaactgtgctacttactaggtgtgtgactgaacagttgaccactgtgtttatttcttcatttgcaaaatgggatttttttttttttttttgagatggagtcttgctctgttgcccaggctggagtgtagtggcacgatttcggctcactgcaacctccacctcccaggttcaagcaattctcctgccttggcctcccaagtagctggaactacaggagcacaccaccacgcccgggtaatttttgtatttttagtagagacggagtttcgccatgttggccaagctagtcttgaactcctgacctcaaatgattcacccgcctcagcctcccaaagtgctgggattacaggcatgagccaccgcgcctggcttaaaatgggatttataatagtacctatctcataaagtagttgtgagggttacatgagtttagtgtctctatacttctagtgtctgatgacttggtatctaacttcctgtggtaaagatgctacttgtttatcataatggccctatagcacatgaagaaagatgctaaaaccagcaaacacttcaagagcaccatagggcatacatttgctagtttctttgaaaccttaagtcttgttaattccacccatgccttttgaaatacttcattctttggagtaccacagatgcaagcccttctaattacttgttgacacacctgttcatttgtagttatgcacttccttttcccatagtcttctgaacacaaatctcttaccaaaccattttcactggcccctctggaaatcaagtttcattgtgaacaaatatccctatgtccatagtgtcttaacagagtgtatctttgcccgcacatttttagtttagttgaaatctgacccttctccagggacattcctttccttttagccctgtaggctgctcactcacaaatgtttcttatgtcacagggtcacgatatagcgtattttagctctctcctaaaaatctatactcttcttcatccttggaaattcatgttatttagttgttttaccatccactgagcctcatttccattctacagttcacaaactccacatttgttaaagatttgggcactttgtttatagtctccttctattccagtgtctcctgacagttgggatgacttcaacatctctgtcagtgatcatccagggctctgctctatttgctttcccatctcagtgacggtcactatgatttcaattaggtattcctccagatccttgctttttgtttttttaaaaaacgtggtctcgctttgttgcccaggctagtctcgaactggcctcaagtgagtctcctgccttgtactcccaaagtgctagaattacaggcatgagccactgcatccagcttgttgtatgttattttctttacaactttacttgagtagtcccatgcatgtccatatgatcacctaccacttacttatagatgaattccaaatacatcttcagccttgacttctctctgcaactgtcaatctgaaagtgatcctagattcatcttgctgctcccccattcctcatacctacctgatatataaatatttttacttctgctttctgtatatctctgggagcaattctctccttataattcctattgcagccccttagtttaggcattttataggctcatattcaggctttcaacgtatcaacataggctactgactgatttgtctacttcttgacttactaccttctattccttgatggctcatttcctacctcaagattgctccatgccattttcttattgccattagaatgaacctcataaaatgaaaatttgaacatgttaccattcccttccttaaatccgtcagtggtttcccatatgcaggaaaatatggtcaagcagacaagctctttgatagagtatacaagactcttagtcatctgtactcacctactgtaatagctctaagaggatacttaggtttcagttccctgaacatgttgtgctttatcacatctcagttttcttgtacataatattgtactgtcttgaatgctctgccttgtcttctgtctcatccattcctattcatcgttcagaaccaactcaaatgtctcatggaaactaattcccaagaaaacttaactgcttatctaatcattcatatcacttcatatatttttattagtatgttgagcttgagatttcatccaatttataagctaggaagttacctgtaactcttccatggatgttagcagatgacatgagacttctgggtcagagacaaaagactttataatggtagagcaagcagcatgagcattgtgtttatattggttctccttgcctccatatcctacaggaataaaatgaccaatgcccaggtgtatactgtgtatctagagggtggcatcacaactgaggaggagtgagcttgggttaccagctgttccattagcaagcaataaacaagcctactctttatactgaagagaggctttaccttatccctcaaggtttcttgttgcaaacacaatcctgagaaacgacaccgatgaagatcagtcaggtccttgcattcttggcatacccgataagacaagttagaagagagaaactcacctggaggaatttctcacaatgtatgcatcttttctaaaattgtttgttcaaatgtcggttccgccatgatgacaatatccagaagatagctgctgagttctgtatgactttgtatttctagttcttggatcagtgcctcaatcaaggttggcattaagtaaatatttcttgaaagggttaatggatagatctttgtgaaagaatggttagtttcttcataaaaacacaacaaaacataacaaaacaacaaaaaacttctctagatagtgattcacttgttaatacctatttccttctaaacctttaaagcaaagaattagataagaatgatgggaaaaaatttatgaactctcatcgtggtttcaattttagattttgaatggagataactatggaatcagggacatgttggatgaaaacaatgaaacatttttagtaatggattgaggtttttcttttcaatgacgttaaagattatgattgctttttcctttcttgtagttcagttttttgcgtttgaaaagcttagaattggttgttttagtattcttctgctaactcttctaatttactctccatgtaagtttttcagttattcagttttaccccattttaggctgtaatgcagtatatacgtatctctttttttgtgagtttttctctttaccctctagaatgttgttctacagttagtagtagcaagagcataagcagtcagaaatttgcaatcagagagctttgggttcaaatcttcttgtcttgtccttactagctttgtgaactggacaacttatgtaaccatgctgaactttattcttttccgatgtaaaataaaggtgatcacacctatttcaatatattgttgtaaggaataaatataataatttaatcatggctataattggctctagaaaattttgatttttttctcctttccatgtctcgggatgaattttattctctatattggcattacatatttcataatctcttcatagccaaatgaatgtttaagtacatttggttagaatgagagtatgcgtgatataacttgttatgtaaattcattttgtaatatcctgataaaatcttaaaagcattgcatatcaaatgaattctcaagcctgaaaggttgattctttgctagggaacagtttccagttttaaaagtagttaatgtttacatatatttgtcacatactgtgaacccagttcaaagcctttaagaaaactacacagtgttaggagagtcatctggtttgcttttaaaaaaagttttttagactttttagctaatcagtttaaaatgcattcttttattgccgctgtagatattctttagtggtaatataaatgtaaaaataaatccctgttacaattaataaactctgaattctaaatgtttccatattctccccttttttagtgatgtcagttaaagcattagtaaccaataaaataaaaacatattaagatacataatttctcaggcagcttttaaaaacacgactgtagtctttcctttggagagacctagctaagaaaaaaagctataaacattaaattaaaattctagcctaagctcttaagtttaaagcctgtggaaaaaaatgacaaatttttaattagaagatggctttgcatttttttgatgcaacttatttagactttaaagaacaaatattctcactggtcaaatattaacctttgtttctagaacgttcaggatgctgtgtaaaaagatggataaggccaggtgcggtggctcatgcctgtaatcccagcactttgagaggccgaggtgggtggatcacctgaggtcaggagtttgagaccagcctggccagcatggtgaaaccccatctctagtaaaagtacaaaaattagctgggcattgtggcacacgcctgtaattccagcgacttgggaggctaaaacaggagaactgcttgaacccaggaggtggaggttgtagcgagcgccaagatcgtgccactgcactctggcctgggtaactcaatctaaaaaaaaaaaaaaaaaaaaaaagaagaagatagacaatatataacataagtagaaaagtaaacattgcctcctacattaatttttatttacattgatattactcatacttaaaaaatattttaaaagagtggctttgacagaatatttggtgaaaaattattaattaaaatataaattagtataaattgagaggattttatcttaattttattaatgtaagctaaaataataagtgtttaattttataattcttaactattgtcattttgattattttataggaaagaagcattggattttcatgtagatcaccagtcaagaccctttttcaagtaggtccttaatttggggattagtggtatgtaaaggaggatatcctagaaaactatggagttacatttgtaaaatttattacttgagaataatctgtcaaaagggccatagcaacatcttgcaactgcacagaattctaagaattatattctctgtctttttattaagtaagaattcctatattttatcattaaaaatcttaaagtttaatcagttgcaaatagaaagatttgtttacattacaagaaggataacttttaaaatttttggttgattaaaaatggagtgataattatatttgatgttcaatatttttattatgcttttgtgtttgtggggcttttaatttttttaatttttattttttatgtcaacttttactttagattcagggggtacatgtgcaggtttgttacctgggtatattgtgtgatgctgaggtttggggtacaattgatcccattacccaggtactgagcgtaatacccaatagttagtttttcaacccttgctcccttccctttctcccactctagtagtccccagtgtctgttgttgccatcaatagatattattgtccatgagtagccattatttagttcccacttataagtaagaacatgtggtatttggttttctgttctgcgttaatttgcttaggataatggcctccatctccattcatgttgttgcagagaccatgatttcattcttttttattgcagcatggtattccatggtgtatatgtaccacattttttttatccagttcaccactgatgggcgcctgggttgattccatgtctttgctattttgtatagtgctgcaatgaacaggcaagtgcatgtatctttttggtagaaaggtttgttttcttttggatatatagcagtaatgggatttaaggttcaaatggtagttctgttttaagtcctttgaaaaaactccaaactattttctacagtggttgaggtactaatttgcatttccatcaacagtgtataagtgtgttccctttctctacagacttgccagcatatctgtcgttttttgactttttttttaaaaaaaaatcaacttctattttagatacagggggtacacatgcagatttgttacgtgggaatattgtgtgatgctgaggtttggagtatggatcccatcatccaggtagtgagtatagtacccaataggtagtttttcaaaccacctgccttctctcctctagtagtccacagtgtctattacccccaaatttgtgtctatgtgtgtttaatgtttagctcctacttgtaagtgcgaacatgcagcatttggttttctgtttgtggattaatttgtttaggattatggcctccaattgtgtccatattattgccaaggacataattttatttttttatggctgtgtagaattctgtgttatatatatataccacattttctttatccaatctgccactgatgggcacttgagttatttccatgtatttgctattgtgaatagcacagcaatgagtgtatgagggcatgtgtctttttggcagaatttcttttcttttgggtatatacccagtaatggaattgctaggttaaatggtagctctgttttaagttctttgagaaatatccacactgctttccacaatggctggagtaattaatattcccaccaaccgtgtataagcattctctttcctctatagtcttgccagcatgttattttttgactttttaataataaccattctgactggtgtgaaatggtatctcattgtggttttgatttgcatttctccgatgattagtgatattgagcgttttttcgtatgcttattggctgcttgtatgttcttttgagaagtgtgtatttatgtcttttgctctttttttagtggggttgtttcatgcttgtttgattatttaaggtcgttacagattctgcatattagtcctttgttgaatgcatagtttgtgaatattttctctcattctgtggattgtctttttactctgttgctagtgcagaagctttctgtgcagaagctctttagtcccactcgtcaatttttgttttcgttgccattacttttgaggacttagtcataaattctttccccaggccaatgtccagaatggtgtttcctaggttttcttctaggattcttatagtttgaggtcttacttttaaatctttaatccatcttgagtaaagttttgtatatggttaatgttaaggggccagtttctttcttctgcttatggctagacaggtatcccagcaccatttattgaatagagaatcctttctccattgcttatttttgttgactttgtcaaagttcagatggctgtagatgtgtggctttatttctgggttctctattatgttccagtgatctatgtgtctgtttttgtaccagtaccatgatgttttggttactgtagcctgttgtacttttaaactattttggtagtcttgtatacataaagcaatgttcatggaacctttctattttaactagtttgatatatattttgttccttgacatagaacagataatatatgttacactttatgtattctaaatatttgacatgtaattaaatttaagtgaatattttgcatgctcatattattattactgttgccaaagactgtttacacttctaataagaaagaatgttacatcagccaaactaaatggccacagtagacatgttatttgatatcctgcactgagtagtgggtttttaaaaaaatttgtatgtaagaaaattattatgctatagattatttcaaatcaagtgttataaaatattcctaagccttcttagaatagctatatacacttttctagaaaattggtggaaattatcttttggtataaactttgtatatgtttatagcattaacttacaactcctagtctaatgatttatgtgtgatttgcatgcagtaaattttattaaaggaatgaattaactagttgcctgttaatgagaatgatgtaacaaaagactaggtgaagtaattaaattttcatgaagcagtatctatgatcaggcacatccttccctatattgttacatgccatattcataggcttattcaattgtgtgttttgagaattttgtattaatagggcgttagattgtaagtgtcttgaagggggatcttttttgtggcacagacgctgatatgttataggcaattattaaatgcttattgagtgaataaacatggtttgctcctttgatttgggtttttttaaatctagtggttggtcttgggggttttgtttgttttggcagcaaaggtctggcagaaaatgtatgaggaggtattatagaactcttaggatagaagacaagaatacttttttgtacatgctgttttttagaaatattcttcaaaatgaatgggagtgttttaaaaaggaagtactgaggggagctgacatataacatgcagggtggaaggaagtgtgtaaaaaatagtcataagttagtgggcacaaaagagcctgtcacaccatgctcctttctccaggaggatctcttctctctactttggatgagagaaaaccatgggcttactctaaaaagtactgtgtccctgcttaatatagtcagagggaggatgtcacttatttcatagttaaacttgtcattgcatcctgtacacatataaaagtagaaaataaaatgaagtattgtcttttataccttgggggactgtgactcagtgctggatttttagtcaagaaccgatgcgtacactttaataatttaatacagaaataacccagagtagtttttacgctaataaaaggatatttcttgaagcctgctggggattttttttttatcaccaaaccagctcagtgtttattgattaagagagttctttgtcagtctttgaattctaatagttttacacaaaaataaataaattcttactaaaaatatgttacaaggcatccatccctatatattgtgaaattgtacttgactgcagtggtaaacacatgtaaataaaaaggaaaatcctctgtacctgttagagcactgggaaaagcataggtcaacagtatgcattttaagtcatgaaatagtcttaattcaacagaacagtgatttttctggtaacagtaatttgacattactagtgatttgaagtgaattgagccactgcaagacactcaatttatgaaaaatttctcctgcccatgtaaaattaactatgcttaatggttctaagattataatattcatgtctatgttgaaataatccaatttaaatatatcctgtcgttaagacaaatacctagttgacagaaaaaagaagcaaactaatcttctatctgttttgtagtgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagtaaggtgttttaaaaatattttaatgctcttctagttctgttaaatgttttatatcaaaggaaagcatttctatcactggtgacttagggtggatttatgctgctgctctagtagtagagaaaacctttgacatcttgcctactatcaaacagtgattcagtgtgtctcctttgtgaactggtaacctgatcatgatcaacgtaagttttctccaattaaaacacttctcatcctgtttcttgttcccaagacttaaattactgaggctcctaaatgtttgaattattgaattcatgtaagaataccagtttatggctagtagatattaaaaagaagatataatttgagatatttccttttgattcagacctaacactgtgctttcaagcttaacatcctattattttcctatatatagctagtgtttatgaaagtttctctactccttatttttaaatccatataaataaagcatttattggatttatactgaggttgaattaaagaagtgtaagtttatttttagcatcgtgagaagtgtctcacttaaggtagtttttaatctggttgtgtttgcaatgaaacaatattagacagttttataattgatttctttctttttcctaccatttcatcagcaagtcccttcagctctttcaaaataaaccctgaatctgatcattgtggtctgaatcactattatattttgccagaactgctacaatagcctccaaattcttttttcctcttttcttacactcaattaatgaaaattttaccttacccaagtaaaatcagctatgcccagtgatcttttaaagacaaatcagattaacattcacctgctgaaaacccttcagtgaatttctgtctcttctagaataaaatctaaagtctttattgtggcctccaatgctctatctagtctggcccatatctatctctaactgtatctttgatcaatctctatcttaatcattgtgttccaggcacactaaccatctcgctattccttgaatagcatatttctgtctggaatggtcaactaacagcaaagaggacagtgtggttggataggaatgagagagggaggaagagggtgatgaggttacagaggtaattaggggaaagattatatggtcttataggccgtagtagtacttttagatttttctctgaaaaaatagagagccattttagggttttgaacaaaggactgatatcttccacttgccatttaaaaggatcattctggctgttgcattaagaatgactatagaggctgggagtggtggctcacacctgtaatcccagcactttgggaggccaaggcgggcagatcatttgaggccaggagttcgagaccagcctggccaatatggtaaaaccctgtttctactaaaaatacaaaaattagctgggtgtggtggcgcccacctgtaatcccagctactccagaggctaaggtgggagaattgcttgaaccagggaggtggaggttgcagtgaactgagatcatgccactgtgctctagcctgggtgacagagtgagactccatctcgggggaaaaaaaaaagaatgactatagagggcaaaaacagcaacagggagcctaatcaggagtctgttggaataacccagtgagatgatggcttggacctgggtggtaataatgaaagaagtatacaaatatattttaaaatatatattaacggttgaaggtcaaataaacaagattttctgctagattgaatgtagagtatgagaaaaagataccaagtattactccaaagttcttagcctgattatcagaaggatagaatttacgtaaactgaaatgaggaaaactgtggctagagtcagaatgaatggacaatcaggagttaacgttttggacatttataaacttaacctgtttgttagttttccaattagactgatgaaaaaaattagtgtgacagcttagagttatcagcacataaatggtatttaaagccgggagactggttgagattaccaaggagaaggtatagatagagaagtaaagaggaccaaagatgaagctacatcttgataaaaggtaaggagaagaaggcagcaaaggaggttgaagaggagccaccagagaggtaagaggaaaaactgagagataattatgtcctggaggccaagtgaatcaaatattctaaaatgagagaatgaccagtggtgtcaaataaggcaagtaagaagaggactaagaatggattgttaaattttgcaatgtggatatcattggtgaactttgtaaggtgaatgttgatggggaggtggaggcaaaaccctgtgtggagtagacttaaaagaaaattgtgggacgggaattgtagttagtgaatatagacaactttttttttgaggagtttttttgaggagttttcctgcaaagagatgaggtggtagctgtcaagaaaagtagtatcaattttttttaagaggagaggtattgggtaaaaaattgatgatgtaggaaaaagaggaagacttgttggagcaatttcattaattaggcaaaaggaaatggaaattagaacccaggtggagagattaggcaggtgtgcctctcaggtactcgtctatagcaacagatgggaagggagaatatgtgaacacagatgctgattcttaagtaggaagcaagatcaaaacagctgaaagtgaggatgaggtataaggtattggttggtctgaagggagagaagaatatgtgaaatggtgatctggaaaaggaatagatcagggaaatgtggtgtgtgattgctatactgaattaatggcccatgtagtgttcatggccatgaactatgagtgtggttctccagcctgttcaactgcctggctgaaggtaaggagtaggtggagagctggcttttaaccatggctgtggttttgtgaaacaaatgtgacggaagtgttaaggaagttaaagatacatgcaagagagcaattatagtctttgaccatatcttagtagtagacatttattgtaaatgtggtattgttttgtatagttaaatttccaatcatattttaaagcattataaaaataataaacatatctaattaatgaaggaaataattgaggctgaactgaaagtcactaccatgtttactgatatttcctgcctatttcaccctattaccaccttatgccatccatttcttttttatttctactagattatttaataaatttgagcataaatatacttgttagattttagcatatcttgtagtggagcaacttttgttaagttagctactgtctcagtccattttgtgttgctgtgaaggaatacctgaggctgggtcatttataaaggaaaaaggtttatttggctcatagtcctgatggctgggacatcaagattgggcatctgcatctcgtgagggtctcaggcagcttccactgcctgaggtggaaggtaaaagggagcctgcgtgtgcacagatcacatggtaagagaagaagcaagccaccgggagaggtgtcaggctgtttttaacaaccagctttcagaggaactaatagagggaaaattcgctcaccttggagggagggcattaatctattcatgggatttacccctactatccaaacctcccattaggccctatctccaacattggggatcaaatttcaacgtgagatttggaaggaacaaacatccaatccagagcagctaccattgccatttcacctaaagaaatgtcttaaacatattcgtttatattttgtgcatttaatttttttaacctctttctgccattagttcctgaaatatcctattatttgtatgaaccctttaggatatatatttttttacccttgtctggggaagagtgagtgttgttgacattatgttaggtggctctaggaattaaggaaaaatattgtagctggaaaatgagcttatgtgaagaagcaaagaccacaggtcttaaaaaattgaaaaacatcacagccccaaacttatgcagccccaaacagcctcttctttaccttgaattcctattagttattgtctaatttttcattccatctttccagattttaccaaaacatagacttatactcactattttcattcctcagctatctttgactactcatttgtgagcaattgttaaaatttagcattattttcatcattcctgaaaatactgtctttggagaccatgacttgtgtcttactaattggtttttcttccttcacttgtcctttcagatgctggtattgtgcaggcttcttttcttggtttactgcttttcttgctctaattttcagtttcctagtctgtaaaataagataatgattgaacctgcattatagaggtctttgaggattaaatgaaattatttcagtgcttagtatagtacctagaacatagtatttaatgaatggatgttatcttttattattaatattttacttgcatggtgcttcccaaacctgtatctgtaatttgtactggatgtaatattagtatacaaaaatcaatagtaatcttgatatacttgaaataaccagttagaaaatgtaattttagaagagatttccattcatacggttaaaaaaaagtctatgacacctagaataaattgaacaaaagatgtgggagatctgtatggagaaaattataaatatttattttagagaataaggaaagacataaataaatgaagatatatgccatgtttatgaatgggaagagtcagtatcctgaagatatcagttctttccaagttgatctataaattgggtaatttcattcaaaatcttagcacagattttcatgaagtttaacaaacttatgaaacagccaagggtccaaaacagttaagacagttttgaagagggagaaaaagatgtggtgatgataaggtgagacttattttaaggatatcatgactttttataaagctttagtaggaaaaactgtggtattagcatgggagtaggtaagtatatcagtgtaacagtctagagtgctcaagagatgacccaaatataatgagaagttggtgccattataaatcagtggacaagggatagattgattagtcaataaattgtgtgagataattttatatggaaaagtgtaaattaacttcttaagtttctatctaggattctccttagagtttcagacttatatagaaataatacatttgaaactgaactgactacaattttttttttttttttttggagacaagagtctcactctgctgcccaagctggagttcagtggttggtgtgataatagttctctataactttgaacccatgggctcaagccatccacttgcctcagcctcccaagtagctaggactacaggcctgtaccaccatgtccagctatttttttttattttttctaaagacagggtcttgtgatgttgcccagtctggtctcaaactcctggtctccagtgagcctccttcttggcctcccaaaatgctgggattacaggcataagccatcatgcccagcctgcactgattataatttaccaaagtattccttttgtattctgtacatctctaggaaagaaatttgggagccagtattctttcttctgccctgtttatccccttaatagaatcagcaaaagatcttgtaggtttttccttctgaacattttcttgaattattccctttctctgtattcctaccatcactcttctagttctgacctgggctgctgcaagagtcctggaatatacttttctacctcaaatatatcttccacataggcttcagaacaagttgtctaaaaatattaatccgtcaatctcatgactattaaaaatttttaaagtactccattattcccagaatcaagttcaagctccttgacatggtttccaaggcgttccagtgatctgtctcccagcccctcctccagccttatatcctgcctcaccttctgtatactgtgggattcttactctgttgcttttactcattctacccctctgccttggaattccaattctgcctttgcccaggtaatttttatttgccttttaacactcagctcagagttctttatattatgcatacaaattctttatccagagatatgatttgcaagtattttctcatggtatgtggtttgcattttcatcctctttaacaatatctttggatgagcaatttttacttctgatgaagtccagtatcagttgttctttaatgtattgtgctttaggtgtcaagtctaacaaactgttcccacacctaaggtcaccaatatttcattatttgcttctagaagttttatagttttagtttttatacttaactctatgatgcattttgagttaatttttatgtaaggtgcaaggtatgatcacaatttgttattctttagacatatattcttccagcattatgctgaaaagaccttatttctttaattaattgcttttgcacctttgttgaaaatgtattgaatatatatatctgggtcaatttcagcgatttgttgtgttctattcatctacaagcatacctcagagataatgtagatttggttcagaccaccacagtggagtgaatatggctatatagggagtcccatgaattttttagtttcctggtatataaaagttatgtttatactgtaggctactaaatgcaatagcattgtgtctaaaaaaaactatgaatatatcaattaaaaatacttcattgctaaaaaatgcatgctaacaatcatctgagccttcagcgagtcataatctttttgctgatcttactttgatgttgatgtctgctgattgatcagggttgtttttgccaaaggttgaagtggctgtgtctatttctttttattattattattattattattatactttaagttctgggatacatgtgcgtaacgtgcaggtttattatgtaggtatacacgtgccatggtggtttgctgcacccatcaccccatcatctacattaggtatttctcccaatgctatccttcccctagccccccaccccgcaacatgccacggtgtgtgatgttcccctccttgtgttctcattgttcaactcccacatatgagtgagaacatacagtgtttggttttctcttcctgtgttagtttgctgagaatgatggtttccagcttcatccatgtccatgcaaaggacatgaactcatccatttttatggttgcatagtattctatgctgtatatgtgccccattttctttatccagtctatcactgatgggcatttgggttggttccaagtctttgctattgtgaatagtgctgcaataaacatacgtgtgcatgtgtctttacaacagaatggtttataatcctttgggtgtatatccagaaatgggattgctgggtcaaatgctatttctggttctagatccttgaggaattaccacactgtcttccacaaaggttgaactaatttacactctcaccaacagtgtaaaagcgtttctatttctccacatcctctccagcatctgttgtttcctgattttttaatgatcatcattctaactggcatgagatggtatctcattgtggttttgatttgcatttctctaatgaccagtgatgagctttttttcatatgttggctgcataaatgtcttcatttgagaagtgtctgttcatatactttgcccactttttgatggggctgtttgtttttttcttgtaaatgtgtttaagttccttgtagattctggacagtagccctttgtcagatgaacagattgcaaaaattttctcccattctataggttgcctgttcactctgatgataatttctcttttgctatgcagaagctttttagtttaattagatcgcatttgtcaattttggcttttgttgccattgcttttggtcttttagtcatgaagtctttgcctatgcctatatcctgaatgatattgctgaggttttcttctagagtttttatggttttaggtcttacatttatgtctttatccatcttgagttaatttttgtataagatgaaaggaaggggtccagtttctgttttctgcatatggctagccagttttcccaataccatttattaaatagggaatcctttcaccattgcttgtttttgtcaggtttgtcaaagatcagatggttggagatgtgtgcctttacttgtgaggcctctgttctgttccattgatctatactgttttaatttgggacatttacagaaatgatattcattttaaattactattacaagtaaaaagttttggagaaacttttaactggccaccatttagccatacttttattatcataataaaattattagtatagattaattacaaatgctttagtgaaattaccaggaaatcctatcagcgtgaaaatttatgaagtagtacaactatatactttataatttgtttaaaaatttaaaaattatatacctaaagctttcgaattcagtctgaatttttaattttttgtaaagctataaatatttattctttcctactagggaatttaggaaaatgtaaaagggcaagagtaatagcaggaatctttggaagaacaggatctttatacaaaatattttagcccctcaaatcccaaagaagcctggatattatttttgtgactttgttttataaagactttgaattaattgccataacaatgacctagtaaaagcgctcttattcacgtttcactaagaagatatatttatgtaaaatctttatgctttataaataaatatttattcagcataggtaaatatggtacttgaaaatctgggtagttggaaagctggcatttttatttttaaaaattgagcgagaaaagaaatcaaaggaaagttgagacaaaaataattggtcaattaattgttaaataatttgttaaactagagatagaacaatttatcactgctttttactttggaaagacagataatagaaaaagtacatggtttttggagctacagtcacttggatttgaatcctggctttgccacttgctaacttgtaagggcttgttacttaagctttctgagtctcatttttctcatttgtacactgtggatatatttattttgtttagcacatgcagaatttattaggtgctgaatttcagtcattcccaaatattcattgagaaactgctagtgaacaagtaataaagatggactaagccctggtgctctccaacacatagaggtcagctagataggagaaaaccatcgaaggagactgagagggagtagccagtgaggtaggaagaaaggcaagtaatgaaagcattccagagtgtaggatgtgacaaactgtgtcaaatactgttggtcaggtaaggtgagggctgagaataattaaccagtggacttagcaacatggaggtagtaagggattttaatgagcagctttggtggaatgaaaacctaattggttatggatttaaaagagactgtaggagaggaagtaaaaatggaaatggaaaagaaagacatttcttttgaattttgttgtgaagggaacagaccaatgggaactctcgaaagagcatgccctttctagtttgctactctatcatattctcttgtcacaccacttctacttcattccttcattgatcatctgccaggtccctgtaggtatttgaattttcatctgtaccataaaggttctctcggaccatgcaatcaaagcatctggtataggactaaaaggggtagttgctgttgttattgattaaaaagaataataaataatggcagcaatatgatagaaaggcagttggtatcttaggaatagaacactttttattctagtgtcttaccactggaaatgctcaggtgtatacactactatttgaataattcctcatcatccttgtgtttaaaaaaatgctcatcagtgtggcacattaacacattctataatcttttcattttaaatttaatgaaaaataaatacagttgatccataaacaacacaggtttgaactgcacgagtctacttatatgtggatttttttcaacagaaggattgaaaatgcagtatttgcaagaggtgaaactcacatctacagagatttgacttttcctataagcaggttccacagggctgactgcaggacttgagcatgcatggatttgagtacacacagggatttgagtaccaatcccttgtgtataccaagggctatttgcattgagccagacattgttttaggtgctaggggtcctacagagctatacaacttagttccctctttttcaaatttatgatttgatggaagataagtacccaaataaccataactttgggggagcaaaggttgccggaaggaggcatcaggaaatgcctcctagtggaaagtggtatttgaggtggctctttacacattggtaagattctttggagcttgagtcagagggttttataggaaatagtagaaataatagcagtgaaagcttagagacaggaaagcatctaaataattaaaagaactgattagtgtgaacatctttgtggctagttcaaattgttgtgttgtcattttagtgaaccacatgcaaagtgaataacacagcctgaatctgtttataaaacatggttcatttgattttattttatactaggcctatagttagttttaagtagctgtagttctcagattcctgatattaatctctgttcctataaaatttcctagttttaaattttattttacatattttaatgaaaaatttaaaattaaatttgtgtctaattaactaatgctttggggagaataagaactttatattggtatttccaatattcaaaatttattaaatctttgtccactatattcctggaacaaaatgacacatattctcattgctttgattgatacttctttatatgctcttctggttctaagtcttgaaacagggttaatttaatcagtgtgtctttgtaaaactcatttttagaaaatctgaaacaaaaaatttatatgatgaaactctaaaagtaattgcatgattctcctcccccacagaaatatcttgtaagttcaagataagagatcacatttgtcaaaatcatttctctctgtctttaggaaatggagttgttttttccttcaagtggaggttgtgggccggcaaacactgctaaatttactaattgtacctgttgcattgttaaaccccatgctgtcagtgaaggtatgttgaatacactatattcagtacattttgttaataggagagcaatgtttattttcttgatgtactttatgtatagaaaataaagtatacttttagtatttccattttttttctttgaaggcacttgagtaaaggtgacaaaatataagggaaaatctgtctaaatctctatttgtcttttctttgtgcatttttaggaggtgttctttgagttgctgatcatgctcaggctcagtcatactgttacagatcttggctaattgacttttagtctgccttctctctttctaatcacaaattgtgattcacttaatttacttcaatagcactttttttttttttttttgagacagagtctagttctgttgtccaagctggagtgcagtggcatgatctcgagttactgcaacctcagcctcccgagtagctgggactacaggtacatgccaccatgcccagctaatttttgtatttttagtagagacagggtttcaccatattggtcaggctggtctcaaactcctgacctcagatgatctacccacctcggcctcccaaagtgctgggattataggcatgagccactgtgcccagccaatagcactcctgttgtacaaattaaaacaatgtctgccatacctctagtataccctttctgagaaggctggagaaatttccttcagttctttgtatctgaaacagttctttgacatatgtatgtatatacatgtttgcatatatatacatatataaagagaaagagtttgcaagttcttttcttatttttgtctcaatttctttattttatttattttagtctggtatatatatttttgttaggtatctcaaatctttttggaagtaagatggggtatggttaaaaagatcacccttaaaaaactagaatatactaaataatatacagaagtgattggattttaaaattttatgtctcctaagtatccaagtaatccatgtatatagtagaaaattggaaataaaaaaccattaaaaatgaagtaaaaaaatactgaattcccatcacctgaagatagtcattgttaatgttttgatgcatttcctccaaatcatttttttctgcatttgtatgtgcatgtgtgtacactgctacacatgaatgtaatggttgagatgtaggtctataggctgttgtttaaatataatttttgtgagcatttctggctgctgttaagtcctcattaatattttaatagattctttaatatttaacagcaattgtatagatgtagtatggtatttggatacttaggttgttttcagtgttttgatattaaaattaaaactttgaagaatatctttatacgtaaatatttgatgatatctctaatcttttcctctggctagtttcctagaaatagaattacttgttggaaggatatgagccttaaagatcttgctgcataattaatacttctttaattttttaggaagtattttagtatattgtaaatccttaggaccatgattataagtaaataacatgcagcatggataacaaacacttatggagaatataccattatgtgccaggtggcagactggttccttatacattatttttaatcttcacagcaagtatgtcaagtaggtaaatttgttgctcttttccagataggcaagctaaggttccatgagattaagttgtttctcctaatttggaatggaaattgaggatgcaaaccctgtttgtttgtttgtttgtttttaatctccattctgttccctctatactctattgccctaatagcaatagccacaaaaaagtcacatggcacatgattagtaacaattccataggaagtgatagtaatatttgaaatggctggtgttgaaaatttatggaaaaaaacctgggattttatgtttcactcatttttcttagctggagagattgtgtatgtgtatgtgagtgtctacacaggtgtggtatccctaatccaaaaatctgaaacccaaattactccaaactccaaaactttttgagcacagacatgaagctcaaaggaaatggtcgttgtagcattttcaaccactggtttatgtttattggatttttgaattgggtatgctccacaaatacgtatctacagatatttcaaaatcaaaaaaaaaattgaaatccaaaacactgcttgtcacaagcatttctgtaaggaatattcaacctgtacacacacacatgcacatacatacacccgtgtatatttgtgtacatatacatatatacataaacacacatagtacactcacattttgaaaaagttcttgtttataggcatcaactttttaaaaagcttatccttgacaccctaaaatgttttattcaatttacctgatctaatccttttcaaggaaaaatatgttgcaaggagagtgaaataaaataaagtggtactagaataaatactagttgtataccttaataattgcacatatagctgggagaactgatagccacatggagaaaattgacacgggaccccttccttataccgtatacaaaaattaacttaagatgaattaaagacttaaatgtaaaacccaaaactataaaaaccctagtagaaaatctagtcaatagcattcaggacataggcatgggcaacaattttgtgaacaaaatgtgaaaagcaattacaacaaaaacaaaaattgccagattggatctaattaaactaaagagcttctgtacagcaaaatgaactatcatcagagtgaacagacaacctacagaatgagagaaaatttttgcaatctatccatttcacaaaggtttaatatctggaatctacaagggacttaaatttacaagaaaaaacaacctcattaaaaagtggtcaaaggacatggacagacccttctcaaaagaagacattcatgcacccaacaaacacatgaaaaaaagctgaagtcaaattgctaactagaataaccaatgcagagaagaacatgaatgacctgatggagctgaaaagcatagcacaagaactttgtgaagaatacacaactatcaatagtcaaatcgatcaagtagaagaaaggatgtcagtgactgaagatcaacttaatgaaataaaaagagaagaccagattagagaaaaaagaataaaaagaaatgaacaaagcctccaagaaatatgggattatgtgaaaagacaaatctgcgtttgattggtgtacctgaaagtgacggggagaatgggaccaagtcggaaaacactcttcaggatattatccaggagaacttccccaaactagcaaaacagaccaacattcaaattcaggaaatacagagaacaccacaaagatgctcctcgagaagagcaaccccaagacacataatcattagattcaccaaggttgaaatgaacaaaaaaatgttaagggcagccagagagaaaggttgggttacccacaaagagaagcccattcagactaacagcagatatctttgcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagggaatttgtcaccaccagacctgccttacgagagctcttgaaagaagcactaaatatgaaaaggaacaaccagtaccagccactgcaaaaacataccaaattgtaaagaacatcgacactatgaagaaactgcattaactaatgggcaaaacaaccagctaacatcataatgacaggatcaaattcacaactaacagtattaaccttaaatgtaaacaagctaaatgccccagttaaaagacatagactggcaaattgggtaaagagtcaagacccatcagtgtgctgtattcaggagacccatctcacttgcaaagacacatataggctcaaagtaaagggatggaggaatatttaccaagcaaatggaaagcaaaaaaagcaggagttgtaatccgaatctctgataaaacagactttaaaccaacaaagataaaaagagacaaagaagggcattacattaatggtaaagggaacaatgcacaagaagtactgactatcctaaatatgtatgcacccaatacaagcgcacccagattcataaagtacatgcttagaggcctacaaagtgacttagactcccacacaataaaagtgggagaatttaacaccccagtgtcaatattagacagatcaacgagatagaaaaataacaaggatattcaggacttgaactcagctctaaaccaagcagacctaatagacctccacagaactctccacctcaaatcaacagaatatacattcttctcagcacctcatcacacttattctaaaattgaccacataattggaagtaaaacactcctgaccaagtgcaaaagaatggaaattataacagtctctcagaccacagtgcaatcaaattagaactcaggattaataaactcactcaaaactgcacaaaatacatggaaactgaacaacctgctcctgaatgactactggataaataacaaaataaaggcagaaataaagatgttctttgaaaccaatgagaacgaagatacatcataccagaatctcagggacacatttaaagtagtctttagatggaaaattatagctctaaatgcccacaagagaaagcaggaaagatctaaaattgataccctaacatcaaaattgaaagaactagagaagcaacagcaaacaaattcaaaagctagcagaagacatgaaataactaacatcagagcagaactgaaggagatagagacacaaaaaacccttcaaaaaatcaatgaatccgtgaactggttttttgaaaaaatcatcaaaatagatagactgctagccagactaataaagaagaaaagagagaagaatcaaatagattcaataaaaaatgatatagaggatatcaccactgatcctgtagaaacacaaactaccgtcagagaatattttaaacacctctacgcaaataaactagaaaatctagaagaaatggataaattcctggacacatacatcctcccaagtctaagccaggaagaagtagaacccctgaacagaccaataacaggttctgaaattgaggcaataattaatagcttaccaaccaaaaaaagtccaggaccagacagattcacagccaaattctaccagaggtacaaagaggagctggtaccattccttctgaaactgttccaaacaatagaaaaagagggaatccttcctaactcataaaatgaggccagcatcatcctgataccaaaacctggaagagacacaacaaaaaaagaaaatttcaggccaatatccctgatgaacatctatgagaaaatccacaataaaatactggcaaaccgaatccagcagcacatcaaaaagcttatccatcacaatcaagtggcttcattgctggaatgcaaggctggttcaacatacacaaatcgataaacgtaattcatcacataaacaaaaccaatgacaaaaaacacatacctcaatagatgcagaaaaggccttcaataaaattcagcaccccttcatgctaaaaactctcaataaactaggtattgatggaacatatctcaaaataataagagcgatttatgacaaacccacagccaatatcatactgaatgggcaaaagcttgaagcattccctttgaaaaccggcacaagacaaggatgccctctctcaccactcctgttcaacatagtattggatgttctggccagggcaataaggcaagagaaagcaataaagggtattcagataggaagagaagaagtcaaattgtctctgtttacagatgacattattgtatatttagaaaaccccattgtcttagcccaaaacctccttatgctgataagcaacttcagcaaagtctcaggatacaaaatcagtatgcaaaaattacaagcattcttacacaccaataatggacagagagccaaattgtgcatcaactcccattcacagttgctactaagagaataaaatacctaggaatacaacttacaagggatatgaaggacctcttcagggagaactataaaccactgctcaaggaaataagagaggacacaaacaaatgggaaaacattccatgctcatggataggaagaatcagtatcacgaaaatggccatattgctgaaagtaatttatagattcaatgctatccccatcaagctaccattgactttcttcacagaattggaaaaaaactactttaaacttcatatggaaccaaaaaagagcctgcgtagccaagacaatcttgggcatgaagaacaaagctggaggcattatgctacctgacttctaactatactacaaggctacagtaaccaaaacagcatggtacttataccaaaacagatatgtagacaaaaggaacagaatgtaggcctcagaaataacaccacacagctacaaccatctgatctttgacaaacctgacacacacaagcaatggggaaaagattccctatttaataaatagtgttgggaaaactggctagccatatgcagaaaactgaaactggaccccttccttacaccttttacaaaaatcaactcaagatggatcaaagactttaataagacctaggaccataaaaatcttagaagaaatccttggcaataccattcaggacataggaatgggcaaagactttatgtctaaaacaccaaaagcaatggcaacaaaagccataattgacatatgggatctaattaaactaaagagtttctgcacagcaaaagaaactatcatcagagtgaacaggcaacctacagaataggagaaaatttttgcaatctatccatctgacaaagggctaatatctagaatctacaaagaatgtaaacaaacttacaagaaaaaaacaaacaaccccatcaaaaaatgggcaaaggatatgaacagacacttctcaaaagaagtgcagccaacagacatatgaaaaaatgctcctcatccctggtcattagagaaatgcaaatcaaaattacaatgagataccatcttacaccagttagattggtgattattaaaaagtcaggacatgacagatgctggagaggttgtggaaaaatgggaacgcttttacactgttggtgggagtataaattagttcaaccattgtggaaaacagtgtggtgattcctcaaggatctagaattggaaataccatttggcccagcaatcccattactaggcatatacccaaagggttataaatcattctgctgtaaagacagattcacatgtatgttaacgcagcactattcacaatagcacagacttggaaccaagccaaatgcccatcaatgatagacgaattaagaaaatgtggggaggagccaagatggccgaataggaacagctccagtctacagctcccagtgtgagtgacacagaagatgggtgatttctgcatttccatctgaggtaccgggttcatctcactagggagtgccagacagtgggcgcaggacagtgggtgcagcgcatcatgcgcgagccgaagcagggcgaggcattgcctcactcgggaagtgcaaggggtcagggagttccctttcctggtcaaggaaaggggtgacagacggcacctggaaaatcgggtcactcccacccaaatactgtgcttttctgatggcttaggaaatggcgcaccagaaggtcatatcccgcacctggcttggagggtcctatgcccacagagtctcgttgattgctagcacagcagtgtgagatcaaactgcaagttggcagcaaggctgggggaggggatcctgccattgcccaggcttgcttaggtaaacaaagcagcctggaagctcgaactgggtggagcccaccacagctcaaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtagggggagtggggagggatagcattaggagatatacctaatgctaaatgacgagtcaatgggtgcagcacaccagcatggcacatgtatacatatgtaactaacctgcacattgtgcgcatgtaccctaaaacttaaagtataataataaaaaaaaattaagaaaaaaatagaaaagaaagtgtggtgcatatacgccatggaatactatgcagccttaaaaagtgatgacttcatttcctttgattggacatggatgaagctggaaactgtcattctcagcaaactatcacaagatcagaaaactaaacactgcatgttctcactcataagtctgagttgaacaatgaaaacacatggacacagggaggggaacatcacacactggggcctgtcagggggtgggaggctaggggagggatgacattaggagaaatacctaattatatgtgataggttgatgggtgcagctaaccagcagggcacgtgtatacctatgtaacaaaactgcacattctgcacatgtaacttagaacttaaagtataataattttaaaaaaagctcaacatcactgatcattaaagaaatgcaagtcaaaaccacaatgagataccatctcacgccagttcgaatggtgatcattgaaaagtcaagaaacagccgttgctggtgaggctgtggagaaaaaggaacacttttacactgttactgggagagtaaaattagttccttcattgtgtatgacagtgtggtgattcctcaaagatctagaggcagaaataccatttgacccagcaatgccattactgggtatatacccaaaggaatgtaaatcgttctattataaaaatacatgcacgtgtatgttcattgcagcacggttcacaatagcaaagacatggaatcaacccaaatgcccatcaatgatagactggatatagaaaatgtggtacatatacatgatagaatactatgtagccataaaaaggaacaagatcatatcctttgcagagacatggatggagctggaagccattatcctcagcaaactgactcaggaacagaaaaccaaacactgcatgttttcacttaccagtggcagctgaacaataggaatacatggacacatggtcagggaacaacacacgctgcggcctgtcatggggggcggggggagggagagcatcagaaagaatagctaatggatgctggggttaatacctagataatgagttgatatgtgcagcaaaccaccatagcacacatttacctatgtaacaaacttgcacatcatgcacatgtgtcccagaagttaaaataaaagttgaagaataaaaattgcacatgtaactaaaaccaaaaaatactgtatgtaagtgaaagttgatatcaaaataactattaataattttaatatattatttttctgtttatacaggatttaatggtttttagagctatttatagattatattttatatatttatatttgatatataacattaggtcatataacttaattaaggcaaagaaatttttgtaaaaatctactcagatggcagaataaactttggcaacccaaggcttttttttccttttatttctaaacctgtatttttggaataatttaagaccattttgaagtatgtaattaacccagttcagattaaactgccattttaatgaaatatagtttgaagtctcatattgaatttattattaggttcacatggccccctttcatttgctggtttatgtttatctgtttctataataatcccatctcctggtattaatatatttaatattacctgtaatatagtataggcatgaaagatttttatttttatttttaaagatttttattttaaaaaaggagttgctgataagagagcagctgaaatggaataggattatcccttctgttgactgctgacttcccaaaaaaaggccagaatatcctgttgatgaagcaaagctaagtttattccttaatacaataaagggcaagcacaaccttgatagagccttagtagactctgcaagggagagttcaggggtagatattgcaaaaccttgagatgtttaagagctttcaatgcagtcgtctgattgagacgacagcgttcatgatataataatggttgaaggtttgtagcaacagcaggctaaggatcttaaccaagtcttgtaaatacacagttgtttgataaatgagttgtttgagcagtagagggagtactgtgaaaggggactgtttgagtactctattgttggggtaaatggatttttgggaagttcctgaagccaacagtgaagttatttactgatttactgccttatctttctgggcaagaaacttcttggcacaagtagtagtcatgtgtatgtaggcggccttagttcatagacctatagttaatctatgtggatgcagtggtttcacttctcatttctaagagagctagaacataaagagttcttggtctgtgagataaattgtgggaaaaataaggtatatttgaggcatctgtggtctttttagatatgcagattaaaatatattgtcattttaggactcaggttttaaaaggaaagaaaaacaaggtgaatgttcttgtgttctttttactttaaaaattatgcaatgtgtttattatgttctcagtattgtttataggttatagttattaattccatccataaaataaattacttttactctgaaatcaggctgtttaggtttgaattctggctctgccacttactagctatgggatattggattaattacttcatctctttctaccttgtttccttatttctaaaatgagaataattctatacatttttcatggggtaactaaggattaagtgcattagtgtatggaaggtgctctagacagttcccagcacgtagtttagtgctgtataagtgttacacattgttagtattatgattactactctattactactactactgctgctgccactaatatcattatcttttaatttttaagcaaagttgaatgactgtcttgtaacaaagtaatagttttataatgctaacaaaaatccaacatttacattcatcatctacagggagaaaaatgtagtcattgttaaaggaataaagtgctttaatttttttccccagttaaagcctaggtctgatttaagtgcatgaagtaggtttattgcttacatctggttgattcagtagctattttttgattgcctattatggttgacactgggcaagaggaggtagccaaatctgggagagtggcttttatacttgtaatggagaaacaatttagtctttttattgagtagtagaaccctgaaattttgttagaaattttccttataacagatttatgcattaaacaattttactgcattgtttataacagtcctttttgaagtttagtttcatcagtaaaatgagttaagattgttttaaagttttatctgagcatttaaacccagttattctattattctgtgaaactgtgtagaaaattcttataaaggaaaattttggccaggcatggtggctcatgccagtaatcccagtactctaggaggccgaggtaggaggattgcttgaggccaggggtttgaaatcagccaggccggcatagcaagaccctgtctatattaaaaagagagagagatagagaaaaataaataaattggaaattgtattctataccttgatgttgtgttttggttgtaaaaaataattctattttcatggagaatgtttcaaagaaagtttagatattttgtggttgtctgcatttaatttactaggaagcaaattatttattagaatattgaccaatttgtaaatttagcatcagaattggctctggtataagaattaaaatgagactggtaggcgctaggtcttatttatcatgtcctcacttttagaaattgggttattcttactcagagcctctttcagagttttactatccactgtaatggtagctttggtgctgtgtaagccaagagccctggtagatgcatgcaacctcctaaatttgggccgattgaatcagttaagtgctcagctttttcatatttgatttccttcctgcagttcatccactaggatactgtgaaagaggcatgacattttttggtataaagagagctaaacattgtatatttaactcagttttaacaaaaattccagaagtggtcccagttttgcttagaatgtcaccattttggagttttgtgaatgtgttctgttctatctgaaaaagtaaacagttggacggaattttatcaattgcaccaagtacactgaactacatgttaggaccctgactttgaatgcacagagcttagcatacatttttgaaacataaaattatagacagtgaaaatatcctaaggatctgtaagttttagggactttaaataaaactggtgatttattgatttagaaggaatctcaagagttctgttagtccctacaaaagaatcctaattttgaggaaggattgcatttaatggccctgaagaggtaagtatgtattaagcttaagaaaaatcatttacaaatagtgaaatttagatattattgctgtataacaaactatcctaaaatattttttaaatttaatttaactcttaaaaatattttaacttctattttaggttcaggggtacatgtgcagttttgttatgtaggcaaactcttgactcggggtttagttaacagattatttcgtcaccccattaccaagcacagtactctgtaggtattttttttcttccaaacctatcccttctccaatcctccacccttaagaaggctccagtgtctgtttttcaacttctgtccatgtcttttcattatttagcttccacttgtaagtgagaacatgtggtatttggttttctgttccttcattagtttgctaaggataatggcctccagttccattcgtgttcctataaaggacatgatctcattttttttgttaatggctgcagagtattccatggtgtatatgtaccatgttttctttatccagtctaccagtgatgggcatttaggttacttttatgtctttactattgtgaatagtgcttcagtgaacatttgcatgcgtgtttatggtagaatgatttatattcctctgggtatgtacccagtaatgggattgctgtgtcaaatggtatttatggctttaggtctttgaggaatcgccacactgtcttccacaatagctgaactaatttacacttcccccaacaggtatataagtgttcctttttctccaccacctaaccagcatctgttattttttgactttttagtaatagccattctgactggtgtgagatggtatctcactgtggttttgatttgcatttctctaatgatcagtgatattgagctttttttcatggttgttggctgcatgtgtgtcttcttttgaaaattgtctgttcatgtccttcacccactgtgttatggggttgtttttatttttttcctgtaaatttgtttaagttcctcatagattctggatgttagacctctgtcagacgtatagttagcaaatattttctctcattctgtaggttgtctgtttactctgttcatagtttcttttgctatgcaaaagctctttagcttatttttgatttatcaatttttgcttttgttgcaattgcttttggcatttttgtcatgaaatctttgccagttcctatgtacaaaatgatatttcctaggttatcctttagggtttttatttaggttttaggttttatttaggttttaggttttacatttaggtctttcatccatcttgagttgatttttgtatatggtgtaaggaaggggtccagttttagtcttctgtatatagctagcccgttatcccagaatcatttattgaatagggagtcctttccccattgcttgtttttgtcagctttgtcaaagatcagatggttgtaggtgtgtgggtttatatctgggctctctatcctgctccattggtctgtgtgtctgtttttataccagtaccatgttgtttttggttactgtagccttgtactacagtgtgaagttggacaatatgattcctccagctttgatctttttgcttagggttcccttggcaattcaggctcttttttggttcaatatgaacattaaaatagtttttttccagtttgtgaagaatgtcactggtacatggaaaggaatagcattgaatctgtaaattgctttaggcagtatgaccattttaatgatattgattcttcccatctaagagcatggaatgttcttacatttgtttgtgttatctctgatttctttgagcagtgttttgtaattttcattatagagatctttaacttccttggttagctgtattcctagatattttactctttttgtggcaattgtaaatgggattgtattcctgatttggctctcagcttgggcgctgtgtaagaatgctactgatttttataaattgtttttgtttgttcgtttgttttttgagacacagtttcactttgtcacccaggctggagtgcagtggcatgatctcggctcacggcaacctccacctcccaggttcaagcgattcttgtgcctcagcctcccaagtagctgggattacaggcacgcaccaccatgctcagctaatttttatattattaatagagacagagtttcactatgttggccaggctggtctcgaactcctgacctcaagtgatccacctgtctcggcctcccaaagtcctgggattacaggtgtgagccactgcacctggccctgatttttataaattgattttgtatcctgaaacttcgctgaagttgcttgtcatctcaagaagcttttgggcagagactaatggggttttttagatatagaatcatgtcatcttcaaacagggataggttgacttcctttctctctatttggatgccttttatatctttctcttgcctgattgctctggccaggacttcgaatactatgttcaatagatttggtgatagagggcatccttgtcttgttttggttttcaaggagaatgctttcagcttttgctcattcagcatgatgttgactgtgggtttgtcattgatgactattattattttgaagtatgttcctcaatgcctagtttatttgagggtttttaacatgaggggatgctgaattttatcaaaggctttttctgcatctgtggttcctgtctttagttctgtttatgtgatgagtcacatttattgatttgtgtatgttgaactaaccttgtatcccaaggataaagcctacttgatcatggtggattcactttttgatgtgctgctggatttggcttgcgagtattttgttgaaaatttttatatagatgtacatcaaggacattggcctgaagttttctttttttgttgtgtctctgtcatattttggtatcaggatgatgatggcctcatagaatgagttgaggaggattccctcctcctcaattttttggaatagcttctgtaggaatgatcctagctcttctttgtacatctggtagaatatggctatgaatccgtctggtcctgggccttttgtttgattggtaggcttttactgattcagtttcagaggtcactattggtctgcttgaggattcaatttcttcttggttcagtgttgggaggatgtacatgtccaggaattactcatttattttagattttctagcttatgtgcataacggtgttcatagtagtctctgatggttctttgtatttctgtggggtcagtggtaatgtctcctttgtcatttctgattgtgtttatttgtatcttttttctttatttgtctagctgtcaatttatcttactttaaaaaaaaaaacaactcctggattcattaaccttttgtatgattttttgtctctatctcctccattttagctcttgattttggttatttcttgtcttctgctagctttggggttggtttgttcttggttctcaagttctactagttgtgatgtttgattgttaacttgagatctttccaactttttgatgtgggtgtttagtgctataatttccctcttaacactgccttagctgtgtcccagaaatactgatttgttgtgtctttgttctcattcatttcaaagaacttcttgatttctgccttaatttcattatttacctaagagtcattcaggagcaggttgtttaatttccatgcaattgtatggctttgagcaattttcatggccttgatttctgttttaattgcacagaagagtatggttggttatgatttcagttttcttgagtttgctgagggttgtcttatgtctgattccgtggttgattttagagtatgtatcatgtggtgatatggtttggcgtgtccccaaccaaatctcatcttgaattgtggttcctataattctgacatgtcatgggagggacctggtaggagatatttgaatcttggtagcagttacccccacactgctgttctcatgataattagtgagttctcacgagatctgatggttttataaggggcttttccctcttttactctgcacttctctttgttgccgccatgtgaaggacatgtttgcttccccttctgccatgattgtaagtttcctgaggcctccctagccatgctgaactgtgagtcaattaaacttctttcctttataaattacccggtctcagatatgtctttattagcagcatgagtacggactaatacatgtgataatgaaaagaatatatattctgtcttcttagggtgatgagttctgtagatgtctattagatccatttggtcaagagtttagttcagatcctgatactattaattttctgcctcaatgatctattactgtcagtagggtgttgatgtctcccactattattgtgtatgaatctaagtctcttcataggtctctaagaacttgttttttgaatctgggtgcacctgtattgggtgcctatagatttaggatagttgaatcctaaatttttaggatttaagaattgttgaattggaccctttaccattatgtaatgtcattctctggcttttaaaaatctatttggcttaaagattgtttggtctgaaattaggcttgcaactcctgcttttttctgttttccgtttgtttggtagatttgtctctatttctgttttgagcctgtgggtgccattgcatgtgagatgggttacctgaagacagcataccatgtatcttgcatctttatccaacttgctactctgtgccttttaattggggcatttagcccatttatattcaaggttagtattgatatgtgtgaatttgatcctgtcattatgttcttagctggtaattatgcagacttctttgtgtggttgcttcatagtatcacttgtctgtgtacttaagtgtgttttgtagtggctggtaatggtcttccctttccatatctagtgcttctctcaggagctcttataaggcaggtctagcattaatgaattccctcagcattttcttgtctgaaaggatcttatttttcctttgcttttgaagcttagtttgactggatatgaaatttttggttggaattccttttcttaaagaatgttgcatataggccctcagtctcttctggcttgtagggtttctgctgataggtacactattattctgatgggcttctctttttaggtgacctgtcctttctctctagctgcttttaacattttttctttcattttgaacttggaaaatttgatgattatgtgtcttgggggtgatcttgaagtatcttgtggtggttctccacatttcctgaatttgagtgttggactctctagctaggttgaggaaattctcatggatgatatcctgaaatatgtttttcaacttgttttctttcttcccatttctttcaggtatgccagagagtcatagatttggtcttttacacaattccatatttctcagaggttttattcattcctttttgttctgttttcttcctgtctgactgtattatttcagaaagccagtcttcaatctctgagattcttttctccacttgttctattctgctgttaatatttgtggttgcattatgaaattcttgtagtgtgtttttcagctctatcagattggttgtattattttctatatgagctattttgactttcatctcctgtattgttttattgtgattcttagcttccttggattgggtttcaacattcttctgaatcttgatgatcttcattcctatccacattctgaattctgtttctgtcatttcagccatctcaacccagttaataacccttaactggagaactagtgtggttgtttggaagaaagaaggcacttcagctttttccattgtaagagttcttgtactggttctttctcatttgtgtgggctgatattccttcagtttttgaagttgatgtcttctggatggattgttttgctttttttttatttgatgcccttgggggtttgattgtggtataaggtgggtttggttgtctggcttcaattctagtctgctcctgggtcttgcaggaggccccagttattactgcctttgtgtctgcatttcttttgttggttattctggtccaaggggctccctcagactggggctgcagttgagtgacaagccctatcctagccaagttgccctaatctactatctgtgtgcttcctggggggacatgggagttgcctctgcaaaacatctgagtggctcactgcctcaatctagaagtatgttggggaattgtggggaagccaggttgattctctccttctcagtcttgcatgggtccatgtggtaagggtgagtccccctgggggctgtcactcactcaccctttcccgtgttgaagaggttttcctggctctgcactgagccccgacagactggtgcccagctttgcccctctttgttctctgtgttcccctgctgccttgatgtatctcatcatggtttctcagatgatcagcctgcagaacccgtgttcactagcacttttgttttctccccctgggagtggcacacatgaactacttccagtctaccatcttagccctgcccccagatatccaaaaacttagtttcttaaaaacaatgatttatctcatcattaagaaatagaggctaaaaagaaaaagggaaaaatgatgtattatttttcacaattctgtgggttatcaattgatgattcttctgtgctatgccttgcttgagtcattcatgtggcttcattcatctgggagctgtactggagctggagtgtacaagactgaatctcattctcaaaagactctttccatgtggcctctcatcattcagtagtatagcctgagcttctttaccggatggtttctggcttctaagagtaacattccaagataatcctcaatggaaaagtgctcatcatgtctctgtttgcatcacagctaaggaaagtcacatggccaggtccagagtcagtataggaggagactctacaagcacatgaataccaggaattatggttcactggaccaccaatgtatcattctacctcaagtggtataaggcatcttaagtccttcatgtggttgggacgtgagactagaacctgaaccagtagtattgtgacactaagatgctagatagtgcttctcaaactttagtgtgcaacagaaccacttggggagactgtttaaaattcttattcatggaccctaattttagaatcttttttcagtatatctggagtagagcccaagaatatgcatttttaaaagaatccctgggttttcctgataaacacccagtacaagagccacttatgagaaattctgggcagggaccatcttgcatttcctttagtaatctgccatcatcagagtcaagccttataaaagttgatacatgattgaagattcctagtttgttcactatggcaggtcaatagcaaccaaggagatggttagggaagagtcaccttttgattttcagctgttcttataactcagatccctgtgctggattttaggttggtgagaattttttggagtaatggaaaatgtgagtagttgggacactctgctttacacaagtagcttctctaatgcacgtttacttctttatagcagttgtttaatgaaaataacggtaaatcttgatctgttgctagacagtgcttagattgatctttctctagtgagattggaatgaaacccagtttcatggaaagaaatagcactggcaaaaatgtaacatggggttttctcaaaagtcatagcacagttttaagctttaataacttcagaactataaataccacaaacaataaatatcacttataagcttaattatctaagtttctttataccttttcagttttttattttgaataatatttaatttcagtgttttgtttcagtaaacatttataaaagaaatttagataattcctgtttttcacttttttttttctattttaagattcagagtcacggtgattcagggaatgatgttattgaggcaacctgacacacatgcctttggaatattcatttgttgacccagtaggttctatgtatgcacagatacttctaggaagaacaacattaatgtaagctttatgcagaattttgatgacagtgccactcctcttgcctgtttttcattcacttgtctgttagaggaccatgccattttagaactcatggtaactaatgctgagcatagctacacatgatttagacctgaggaaaacatatcttaaaaaagagtttgtagcaaagatagaatgtgcccactcctctgctttggaggatcctctagtactggttttctatgtatcctcctaaccctttcctctgcagattaaacatctgcgtaattgcacaatgacaaaaggaagacaagagtttcctcctaccatgctgtggttctgcttttcaggcttttttttttttcttctacccaagagctgggctaatctttatgaatctgtgatccaggattcagaacacatgatgttactttatcaagatatgttttaaaacatgaaaacccaaagtagcatgatctcattttataagacttgaaaaaatgattcaagttacatggcagattataaatgctgacattctggcaagataattataattgattcttaggaggaagaaagagggacgatttctaaagaaaaggtagtatctttcagaaaagtctatgaaaagcttgggtttccaaataataagttaaaacatgggaggagttgacatgaaaaatattgaagggacatggtcagtgtaattgatttttgaatggattaataaatggtacccttctttgcttttctatatattcacacatcttacttactctagaaaacctatggttcaaagttctaacttattttagttattagttcttttctaacctatcaccaacttacatctactatgtctcttttaacacttagcatacgtactgtgacttctatgtgtgcaaaataggaagtgagttactcatcccagttatttcaccagagcagtttcatggtggttattgaagaacagccttgttatcaaagggagggtagtcttctaggataatattaaggatttcaatttaagcagattggaaggaactaaagtgactctagtgtgcttaaaaatgactcttgaaattgtggttacaggtctgtgccacagactttcttctccgtttttaaaagttattcttcagaatatcctgaatttgaggtcagaaaatctttaagccaaatcttatttaagtattgggctgaatcagaatatgaagtttcatatatgaaatgaaagtttaataaatgaaacaaggtttggctttgcatcatagatttttatttaatctgttaatgtgattcaaaacatgcacctcaaattatttgatacagaggtgggaaatgctaagttttactcaggaattcatcttagtagaaaaatttagaaatacagacaaatgtctattttaaaaatcacttactcctaccatccagagattctaactgtttacattgttgcattttcttccttccctttcaaatagaaggaaacacaacaaaatgaatgaatttcatagtaatgaacttgagcaaaataagaaagacatgaagcatatatgctgtattactctaatcacaaaaagttcaaatataggcaaaaatcaaccacatatttcaagaattcatatgtaggtggtaaactataaagaaaagtttattccaaagtcaggtaggtgtctcccctaagaggagaaagggtcatgattgggaggcatatatagagggcttcgagggtgggcttttgatgtgggtgatgataactgtagatgttcactttaaaattatttaatctgagcatatctgttatatattttaccataaaagtatattttatattttacaatgtaaaatgtattcaatattttacaatttaaaatataaaaattttcagctatatcaccttttccatggccaaaggagtagttgtgatgctttgttgttctcagagaccttactcgcagtaatggttctgaaacgttagtgtgcatcaggatcacttggattaaatatagattcctgggccctgactccaaagtatctgatttggaatatctggtttagagcccaagaatctgcatttgtaataagttcccaggtcatgctaaagatatttttgcatggaccacactttgagaatcaccagatagcaaagctgtacctatctatagaaccatgctggggaataacagaagaaaatggaggcccatattcagtgtatatagtatatgcttacaacagaaaaggagcaagaattatataccttgtgatccgtgttgtggtattagtctatttttaagtctatctatgaatggcaatataagccttgccagtgctgagggaatcagagccatttaaaacaaacaaaagaaacagtgttcttataataagatgtctaaatttgtgaatttccttaactgtgactttggaaagttagaataagtaaaaatcaacgtacctgtttattaaaaaaaatgttgtgcaaaggctaactttgagaatgagaagatatatgtgtgtgtgtatgtgtgtgtgtgtgtgtgtatatatatatatatatatatatatatatatgttttattttattttattttattttttttgagacaaggtcttactctgtcatccaggctgagtgcagtgacctgatcatagctcactggaacctcaaccacaacctcctgcagtcaagtgatccttccacctcagcctcccaagcagagcagctggcactacagacacgtgccacaacacctagctaatttcttattttttgtagagacagggtctcactatggttcccaggctggccacaaactcctggactcaaggagtcctcctgacttggcccctcaaagtgttggaattataggtatgagccactgtgccaggcctatgtctttttaaaatagaaacaaacactcaaactaattataggtaaggaacaacatttatttactttgtgttgttcatgttaaagttaatggatccatggtcttgaattatcatttcagtcttctttcattgtgtttgcttgaaaaactaagagatttcctcagcagaaaccttttaagccagaagggattggagttttatctttagccttcttaaagagaataactgtcagtcaagaattttgtatccagaacaaaactaagttttgtaaatgaaggagaattaaagtcattttcagacaaacaaatgctgagagaatttgttactactagaccagctctattgaaaatgctaaaaggagttttaaactttaaaagaaaaaggcaattatgaaccagaatagaacctcttgaaagcataaaactaatggggcctataaaacaataacaataaagaaaccagagggggaggagccaagatggccgaataggaacagctccggtctacagctcccagcgtgagcgacgcagaagacgggtgatttctgcatttacatctgaggtactgggttcatctcactagggagtgccagacagtgggcgcaggtcagtgggtgcgcgtaccgttcgcaagccgaagcagggcgaggcattgcctcacttgggaagcgcaaggggtcagggagttccctttctgagtcaaagaaagggatgccggacagcacctggaaaatcgggtcactcccaaccaaatactgcgcttttctgacaggcttaaaaaatggcgcaccacgagattatatcccgcacctggcttggagggtcctatgcccacggagtctcgccgattgccagcacagcagtctgagatcaaactgcaaggtggcagcgaggctgggggaggggcgcccgccattgctcaggcttgattaggtaaacaaagcagccagggaagctccacctgggcggagcccaccacagctcaaggaggcctgcctgcctctgtaggctccacctctgggggcagggcacagacaaacaaaaagacagcagtaacctctgcagacttaaatgtcgctgtctgacagctttgaagagagcagtggttctcccagcatgcagctggagatctgagaatgggcagactgcctcctcaagtgggtccctgacccctgacccccaagcagcctaactgggaggcaccccccagcaagagcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacgcagttcctcaccggcaacggaacaaagctggatggagaatgactttgacgagctgagagaagaaggcttcagacgatcaaattactctgagctactggagggcattcaaaccaaaggcaaagaagttgaaaactttgaaaaagatttagaagaatgtataactagaataaccaatacagagaagtgcttaaaggagctgatggagctgaaaaccaaggctcgagaactacgtgaagaacgcagaagcctcaggagtcgatgcgatcaactggaagaaagggtttcagtgatggaagatgaaatgaatgaaatgaagcgagaaggaaagtttagagaaaaaagaatacaaagaaatgagtaaagcctccaagaaatatgggactatgtgaaaagaccaaatctacgtctgattggtgtacctgaaagtgatggggagaatggaaccaagttggaaaacactctgtaggatattatccaggagaacttccccaatctagcaaggcaggccaacattcagattcaggaaatacagagaatgccacaaagatactcctcgagaagagcaactccaagacacataatggtcagattcaccaaagttgaaatgaaggtaaaaatgttaagggcagccagagagaaaggtcgggttaccctcaaaggaaagcccatcagactaacagtggatctctcggcagaaaccctacaagccagaagagagtgggggccaatattcaccattcttaaagaaaagaattttcaacccagaatttcatatccagccaaactaagcttcataagcgaaggagaaataaaatactttacagacaagcaaatgctgagagattttgtcaccaccaggcctgccctaaaagagctcctgaaggaagcgctaaacatggaaaggagcaaccggtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaattctgcaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatattgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaacttagctctgcaccaagcggacctaatagacatctacagaactctccaccccaaatcaacagaatatacatttttttcagcaccacaccacacctattccaaaattgaccgcatagttggaagtaaagctctcctcagcaaatgtaaaagaacagaaattataacaaactatctctcacaccacagtgcaatcaaactagaactcaggattaagaatctcactcaaaaccgctcaactacatggaaactgaacaacctgctcctgaatgactactgggtacatagcgaaatgaaggcagaaataaagatgttctttgaaaccaacgagaacaaagacacaacataccagaatctctgggacacattcgaagcagtgtgtagagggaaatttatagcactaaatggccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagatacaaaaaacccttcaaaaaattaatgaatccaggagctggttttttgaaaggatcaacaaaattgatagaccactagcaagactaataaagaaaaaaagagagaagaatctaatagacgcaataaaaactgataaaggggatatcaccaccaatcccacagaaatacaaactaccatcagagaatactacaaacacctctacgcaaataaactagaaaatcgagaagaaatggataaattcctcgacacatacactctcccaagactaaaccaggaagaagttgaatctctgaatagaacaataacaggatctgaaattgtggcaagaatcaatagcttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatcgttgatgaacattgatgcaaaaatcctcaataaaatactggcaaaaggaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaaccctttatgctaaaaactctcaataaattaggtattgatgggacgtatttcaaaataataagagctatctatgacaaacccacagccagtatcatactgaatgggcaaaaactagaagcattccgtttgaaaactggcacaagacagggatgccctctctcaccactcctattcaacatagtgtttgaaattctggcccgggcaattaggcaggagaaggaaataaagggtattcaattaggaaaagaggaagtcaaattgtccctgtttgcaggcgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagaatcaatgccatccccatcaagctaccaatgcctttcttcacagaattggaaaaatctactttaaagttcatatggaaccaaaaaagagcccgcatcgccaagtcaatcctaagccaaaagaacaaagctggaagcatcacactacctgacttcaaactatactacaaggctacagtaaccaaaacagcatggtactggtaccaaaacagagatatagatcaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctagggattaccattcaggacataggcataggcgacgacttcatgtctaaaacaccaaaaacaatggcagcaaaagacaaaatcgacaaatgggatctaattaaactaaagagcttctgcacagcaaaagaaactaccatcagagtgaacaggcaacctacaaaatgggagaaaattttcgcaacctactcttctgacaaagggctaatatccagaatctacaatgaactcaaacaaatttttaagaaaaaaacaaacaaccccatcaaaaagtgggtgaaggacatgaacagacacttctcaaaaggagacatttatgctgccaaaaaacacatgaaaaaatgctcatcatcactggccatcagagaaatgcaaatcaaaaccacaatgagataccatctcacaccagttagaatggcaatcattaaaaagtcaggaaacaacaggtgctggaggggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcaccatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaacatcattctcagtaaactgttgcaagaacaaaaaaccaaacactgcatattctcactcataggtgggaattgaacaatgagatcacatggacacaggaaggggaatatcacactctggggactgttgtggggtggggggaggggggagggatagcattgggagatatacctaatgctagatgatgagttagtgggtgcagtgcaccagcatggcacatgtatacatatgtaactaacctgcacaatgtgcacatgtaccctaaaacttaaagtataataaaaaaaaaaagaaaaaaaaaaaaaagaaaccagagtatgtaggtaacaagtaacaggataactggaacagtacctcacatctcaatattaacattggatataaattgcttaaattctccacttaaatgatacagattggcagaatggattttaaaaatcacaaaccaaatatatactgtcttcaagagactcacctaatacataaagattcatataaacttagggtataggagtgcaaaaagatattccactccaaatggaaaccaaaagtgagcaggagtaggtagtcttatatcagataaaacagattttaaagcaacaacagtaaaaaaagacaaagaaggtcattatatgatgataaaaggatcaatccaacaagaagatattatattcctaaatttatatacacttaacactggagctcccagattcataaaacaattactattagacctaagacatgagatagacatgaaataataatagtatgagactgcaacagtccaccgacaacactagacagatcatcaagacagaaagtcaacaaagaaataatggacctaaagtgcactctagaacaaatggacctgacaaatatttgccgaacattctacctaataacttcagattgtacattcttttaatcagcacacagaacattctccacaatagaccatatgctaggccacaaaacaagtctctataaatttttaaaaatcgaaatgttatcaggtatcttctcagaccacagtggaataaaactacaaatcaactccaaaagtaaccctcaaaactatacaaatacatagaaattaaacaatctgctcctggatgatttttgagttaacagtgaaatcaagatggaattttaaaaattctttgaaaggaatgataatattgacacaagttatcaaaatctctggaatatagtaaaagcagtactaaaaggaaaatttatagtgctaaatacctacattaaaaaatctgaaagatgataaattgacaacctaacatcatacctcaaggagctagagaaagaacaaactaaacccaaagctagcagaagaaaagaaataacaaagatcagagcagatctaaatgaatttgaaacagcagcaacaacaacaacaaaaataccaaagatcaatgacactaaaagttggtttttcaaaaagataaacaaagttgatagaccattagctagattaaccaggagaggttaaagtaagttcaattagaaatgaaactggagactttacaaccaaccccacagaaataaaaaagatcatttgagaccactgtgaacacctctatgcacacaaactaaaaaatctagaggaaatggataaattccaggaaacataaacactcctagattaagccaggaagaaatagaaaccccgaacagaccaagaacaagcagtgcgattgaatcactaatcaaaacaattgccaagaaaaaaaaatagcttggggccacatggattcacaactgaatcctaccagacattcagagaactgggaccaatcctactgaaactattccaaaagattaagaaagagggatcctccctaactcattctatgaagccagtatcattctgataccacaaccaggaaaagacataagaaaaaaagaaaactacagaccaatacccctgatgaacatagatgcaaaaatcctcaacaaaatactagctaattcaagcagcacatcaaaaagataatacaccatgaccaagtaggtttcattccagggatgcagggatggtttaaaatatgcaagtcaataaatgggatacatctgataaaaggaattaaaaagaaaaactctatgatcatctgaatagatgcagaaaaagcatttcataaaatccagcatccccgtataaaaaaactcaacaaacagatataaaaggaactttacctaaaactaatgaaagccatatatgacagacccacagctaacatcataataaatggggaaaagttgaaagtattccccttgagaactggaacaagacaaggatgccactttcaccacttctattcagcatagtgctggaagtcctaaccagagcaatcaggcaaggataagaaacaaagggcatccaaattgaaaaagaggacatcaagctattgctgttcatgaataatatgactgtatacctagaaaaccctaaatactcctccaaaagactcctggatttgacaaatgaattccgtagtctcaggtcacaaaatcaatatacacaaatcagtagcagtgctatacaccaacaatgaccatgctgagaatcagatcaagaactcagtccttttcacaacagctggaaaaaaataaattacctaggaatatatttaaccaaggaggtaaaagatctctacaaggagaactacaaaacactgctgatagaaatcatagatgacacaaacaaatggaaacacatcccatgctcatggattggaataatcaatatcatgaaaatgaccatactacccaaagcaatccactgattcagtgcaattcctatcaaaataccaacatcatttttcacagaattagaaaaaacaattctaaaattcatatgaaaccagaaaaagaacctgaatagccaaagcaatcctatgcaaaaaaacaaacaaacaagaaaacagacgtagaggcatcacattatcagatgtttgccacaaggctgtagttacaaaaatagtgctggtataaaagtaggcacatagagcagtggaacagaatagagaacccagaaataaagccaaatacttacaaccaactgatcttcaacaaagcatagagaaacacaggctgaggaaaggacaccttatttaataaataatgctgggaaaactggataaccacatgtagaagaatgaaactggatgcttatcccttaccttatacaaaaatcatctcaagatggttcaaagatgtaaatctaagacatgaaactataaaaattatagaagataacctaggaaaaactattctggacattggcttaggcaaataattcgtgagtaggaccccaaaagcaaatgcaactaaaataaaaataaataaataggacctaattaaataaaagaaacttcagtacattaaaagaaataactatcagaataaatagacaacccacagagtgggagaaaatatctgcaaactatacatctagcaaaggactaatatctagaatctacaatgaactcaagtacatcaacaagaaaaaaaaatcccatcaaaatgtgggcaaataacatgaatagacatttctcaaaagaggatataagaatggtaaagaacatatgaaaaatgctaaacatcactgatcatcaggaatatgcaaattaaaaatacaatgagatactgccttactcctgcaaaaatagccattattaaaaagtcaaaaaataatagatgttggcatagatgtggtgaaaagggaacacctatacactgctggtaggaatgtaaattagtacaaactgtataaaaaacaatatggagatttcttaaagaactaaaagtagatctgtcatttgattcagcaatcccactactcagtatctacccaaaggaaaataagtgattatattaaagacacttgcacgcatatgtttattgcaacacaattcacagttgcaaacgtatggaaccaatctaagtgtccattaacgaatgagtggataaagaaaatgtgatatatatacaccatggaatactactcagccataaaaataatgaaataatgtgttttgcagtaacttggatggagctagaagccattattctaagtgaagtactcaggaatggaaaaaccaaaaaccgtatgttctcacttataagtgggaaccaagatatgggtatgcaaaggcatacagaattctatgatggactttggcgactcagaagagggagggttgaggggggtgagggattaaaaaactacttattgggtacaatgtacactacttggatgatgggtgcactaaaatctcagacttcaccactatataattcatccgtgtgaccaaaaccacttgtaccccaaaaactattgaaataaaaaaattttaaaaactgagattttcatataatgagaatagcccctgcataataacattcatgaaaatctcctagaaacatggatttggcttctaatgggacatttgcttactccaaccacatagagactggcctcttaagattaggaagcagctcactctatccatagctggcagtaccctgtgctgtagaaacttaattttactttgtgattgtgtggttaacttttctgtattaacctgactttgactttagacttcatatgacctatttacccaatcttacacagttttcagtttccagcctatctactcagtaccctactttattttgtttttcttagactgtccttgttttaaaactgtgatcttatttcaaccaaggtatagctgttcttagcttcctttgcatgctgagcctgtctttcttcacagtgaggaggaacccctgactactctttcctggaaatcttcattcccataggtcttctctgctgtccctatgatggtatggagcctgtttttattattttctactcacttaattgcatcttgatgaatttcagtacacaaagtcaccatattgtaggtatatctacaaaggtgttgttatactggaccagatgcagtggcttatgcctgtaatcccagcactttgggaggctcaggtgggaagatcacttcaggccaggagtttgataccagtctgggcaacagtgagaccctgtctctacaaataatttttaataattagctgggcatggtggcacatgcctgtagtcctagctgcttgggaggctgaggtagttgaatcacttaagcccaggagttcaagtccagcttgagtaacatagcaaggccccacctctaaaaaaaaatacaaataaaataaagttctattggttactctttttactaccttgtaaggaatgtacagcttgttcttgttaggaaattggtaaggaaaaatgtgaatttcagatttgggtatgtggtgttagtggaggatcagaaatctattggatgaattaaatctgtcttttaaaagctactttctactaatgtgggttttatgatcacctgatggattaatttgagatccattaagacctaagtgccttactggttcccaatttaacaattctgtggaatccaaactcttatttattttgatttgtttttacttttttgagacacggtctcgctctgtcacccaggctggattgcagttgtgccatctcagctcactgcaaccttggcctcctgagccctagtgatcctcccaccttagcctcctgagtatctgggactacaggcacacaccatcatacctggctaattttttttttcatattttttgtagacatgaagttttaccatgttgcccaggatggtctggaatccagactcttgtctgcaattgatttaatataattctacaatatttttccttattgcaaggcagaaaaccatagacatttgtagcttaaaccaatctgagtgcttccattaaaaattacaggaagattatcagtgaagtggtattgcctagtaacatattgctctctaggagacagaaagcttttccacctggtttttatgcctaaggttatttgttatgcatgtttgccaagattagtattaaattccttctgttgactttagtaacacttgtgatttcttttatatgttagcattgaacattaaactctcataatctctagttttttgatttgtctttacactaatcatgttttaaagatacacgtctattttttagttaaaatggctttgaattttatttcactagatttaaattttaaaggaaatcatatccttccaatttgatttaaattggttatggttattaatattaaacatgtctattttaggcaccagttttattagttcgtgtactcttggctacatcacgattaaaacttttctttcagtttctttccaaaataaactgcaagatttccttgttgacattttttcatttttaaaaatcgtttcgttttatttcccaccacccctgtttattatatggattgtgaagcaaagcatacaggtgatagtgaattatcttgtacaacagcctggtcgcttctttaaatttcagttttgtaagttgttttgctcaccaaagtgtccttttcatgggctctcatgctcgtgagtagggttttgttgtcatctgtatcttgctgttacatccagtaagtttaacattcatggtaacgatatttttcaagtgtttctacagtgtaaggggctcattggctgcaagattgctgtgaggtatattatagatgatagatactatgattttctgtttatttgttttatttttgttgttgttgttctgagacagaatcttgttctgtcacccaggctggaggacagtggcataatcttggctcactgtaagctctgcctcctgggttcaagcgattcttgtgcctcagcctcccaggtagctgggattacaggcatgtggcactacgtctggctaatttttgtatttttagtagagatagggtttctccatgttggccaggctgggcttgaactcaggacctcaagtgatccacccaccttgtcctcccaaagtgctaggattacaggcatgagccaccgcacccaggtggtagatattgtgatatcaagggaaaatattgatgccaggaaagaccttaacatcagaataagttattttcacaagaaatatttttgatatagatacatgtggcaaaataaaactattagattattaactatgaaaaccaattttgttagaattttgaagaatactatgcatctactttttaacaacttaatttttttttttttttttttttgagatggagtctcggtctgtggtccaggctggagtgcagtggtgcaatctcggctcactgaaagctccgcctcccaggttcacgccatcctccttcctcagcctcccgagtagctgggactactggcacccaccaccatgcccagctaattttttgtattttgtttagtagagatgaggtttcaccgtgttagccaggatggtctcgatctcctgatctcatcatcctcccacctttggcctcccaaagtgctgggattacaggcgtgagccaccgcacctggccaacaacttaatttttaatgatgttctctctattaagcagttttctagaactattaataaacaataaagtgatctttttttcctcctttttctgccaaattgataagaatcagaatggtaagaaggaaagaaatcttaaagtctgaataatcagtaagttaagtgatgatcctctgaacaattcagaatttactacatatacattctataaccatctctgttaaagattttatagtatatattcagaagatcaaacagatgtttcatagctgtatatacacatatatacacatatgtatatttttgcatatacataaattatttaattgaggtacatacatatgccaactaaatattttgattatttattttattataatataatcttaggctctggggcaagcaaaactgggtttgaaattcagttctatcacttactagttattaaggcatattgtttaatccttgaatatagatactcaacatctataaaatgaagattatactagtactttcctcataggcattatcttagttcatttgagctgctacaatataaataccatagactggatgtcttaaacaacaaacatgtatttcccacagttctccatagtgggaagtccaagatcaggtcctgcaggttcagtttcaggtcagggcccatggttttcttcatagatgacaccttctcactgtgcctttacatggtgaaagaggcaagagaactctctggagcttcttttataagggcactaatgccattcacatgggctttgttcttgctatctaatcacctcttccccacaaaggccctacctttatcacattgggagttaggatcttaatttcagagggtcacaaatattcagtccatagcagcgttgtgaggattatgtgtaataatatgtgactagcttacaccatgtatagatgagaaaaaactagctgtttccccaaatttgtgttatcctttcattgtgtagacttccttctgggaagtaactcttttttcttggagactttatttcctaactttactgagtttgttgaaaagttatctctctaatttgaattgcttttgcacttttgtaaaaaatcagttggacatatttgtgtggttctattttgggatttttttgttctgttccattgatctctatcactgacaatactacaccatctttcggttattgcagttaataatgaaccatgaaattgagtagactgattacctcacatttttcttttttgaaattgttttagttattctagttcctttatcttaccatataattttagaataatcttatctattgctacaaaaaaaacttgctggtattttgataacaattttgttaaacttatttgtcaatttagggagaattgacatctttattgtgtgaagtattccctgaacactgtatgctcttcatttatttagctctttcatccagcattttgtagttttcatacacaagttctatacatttttggttagattcacacccaattttattttctttttgagtgattataaatgctattatagttttagtttcagtgttcaagtatttattgccagtgtgtagaaatacaactgatctagtatgtttaccttgtatctttcaaccttgctgaaataattagttctagatttttttttaggctatttgggattttctatatagacagtcatgtcatatacaaatagagacagttatatttctgcctttcttgtctgtatactttttatctccttttcttgtctggttgcactgacttgaattttccagcaccatgttgaatcagagcaatgagaatggacattcttgccttgtttactgtcttgcatggaaagcattcagtctttcactattatgttagttgtaggtttctgtagatgctgtttatgaagatggggaagttgccttctatttctatttttttcttacagtttttttgatttatgagtgctgtatattttcaaatgtttttttctgtatcaatatatgcagatatatatctatagatagatatgtgatcaacatatattgatgtgttcatgtgatttttcttccttagcctgttaatatattggttgatagtttgaataatgtaccaggcttgcatatctgaaattaacgtctcttggtcatggtgtataattctttgtatatgttgctaaatttataaaatttaaaatttattggaaattataaaatttctaaaattttaacatttggaaataatttttatgtttagccagatacagtggtatgtgcctgtaatcccagatatttaggagcctgaggcaggaatattgtttgagcctaggagttcaagaccaggctagtcaacatagtaagaccctttctcatattaagtaaataaattattgttttaaaattttttaaaaagtatttttatatttatatttataagggctattggagtgtagtttcgttttttgtactgtcttcatatgatttcaatatcaggataatactagttttataaagtgaattgggaattatcctatgtatacaattttgaattgcactaacattgtactttgaatttttttctatgcaattaaataatatttgaaaatgtgatttttaaagtctgagtaaaaagttagttgtaggaacttattcttctttatctaactttttcctgttttttattatttagaacttaaaatttttttattactaataattctatggtgagcatcttcctatatatcgtgtgaacttgtcctatttattcttagaatttgtaatagatatagattataaatttcttttcatattgattgaagcatagtgtttaatatttagattagattaaatttcatatttagattagggttaatatgtaatcatttttttattatcattaatgagacccttttatggatctgcaagaccaaagctgatttcatacttaattgccttttttaatgtgttgtcatttgcactgatggtgcaaaagcgatggtgaacaaaactgccactgccttagaacgaatcaaggcagtggcaccaaactgtgctagtagttactgtatttttaaccatcatgcatctgcagggggaaaaaaaagccatacttagttaagaatatcttagatgcagtaaaaataattttattactttttgatcctcaaatataggtctttttaatactctgtgtgaagtaatgtgaagtacacataaagctccatataatggttttaaggaaaagcatttgtgagtaatcctattcacaattgtttgcactgtcagctcaattagatgctttttcttttatggaataccatttttacttgaaagaatgactgacagacaaattgtgcttattcagacttgggtatttggcaggcgttgtctttcaaattaagtaagcctatcatatcaaagaaaacaactgacaatagcctttgccaaagataaaatccaagtgaagataaactacaaaggaaaactaaacttagaaccttggaaaactgtattcaccactttcagtttgacaacttcccaatacattgtataacagaatagaaagactattctgatgaaattggtgatgatattaacaaatttttaattgatttttgacgtataatgaaatgaatcagcatttggaaaatctgcataactcagtgagctggtatttgccaaatgattaatgtgtgatgttaaaaatcatgtctgagtcatatcatagtttcattcgaagtacatacaagatagaccagtggattttaatgtaacagggtaaaaaaaagtttattgataaaggttttagattatacattgcaacaaacttttaagaagctaccacttatcaagtaaaggaaaatatacacagttattgtaaaagattattaaaatattccactatttttcaactaaatatactccaaccaaaacaacatatggcaacagattgaaagctgaagtaaatgtgagagtccagctgccttttattaaatgagacattaaagagatttttaaaaaatgtaaaacaatatctctcttctcactaattaaaaaaaatactataatctcttcctggccttttggcttagatcacatttttaaaaaattataattttcctcacaaaatgttatttatgttaacatttaaaggatttttgttatatttaaatattttaaaattttgttttaactcatatcataataaatatggatagagataacctatataaaggctaagaaactaccacttgtcaagtaaaggagaataagcacactttaacttatattataataaatattgatagagataacctatataaaggtcttcagtactatctaagagctaaagggtctatgtgaccaaaatgtttgagaacttctggcctacaggataaaatccaaacctctgtatatggtccataagtccttctatcatggcttctgccacctctgctcccttctcttctgtctcatttcctttccactctattattcagtaagatgaagatacttttattccagaactatggtgttttacatctccttacctttgcttaatgttccttttgccttgaatatgtattcttctccagctctttatataaagtactgtctccaaatgcctcttggcatcatttcagttctaacctctctgtacctcttattctgtctttataactctatctgttggtatgcaatcccatgtcactaattttgtgcagggagtttattttactcattcagccattggatatgctgcatcctcaagatctgatcagtttcctactctataaatgctatttagtatgttttgggtttctatgtccaaaataattcagtgtctttccccttattaatttggtttcatcattatttgttttcttcttaaaagtattgtcattcttccattcacttggattcaaaatcttgaaatcatcttttatccttctttcatcttcatactctgtatccagtttaatcccattgcttcttgtgtgaaaatatcttatattcactacctcctttctctactgctgccatccacgctttgaagctcaaaataagagagaaaatatttaaatatatcatggcctatttttttccaatcagcattctaaatgatttcaaaagcttttgctattctttccactacttattcttttcttcagaccagcttgctcatcactattgcattagtgaccttcctaaaatactactttagttttgtattttctcactcaacatttttgttgacttctcatttcttttggcagtgtttctttttgaaggaaaactattctcatggacgctcagtgttgacataaattattttaatttttagtaatacaacttaaatatgtccaaatataaaactaaatacaaacttttgcacatacaagtgcatggctaaaataatttgcaaattcgtagcaaggaaaatataaaacagaatttaacataatagcattaatgtgacagaagatgttatttgccataaaaacaagcttaacgtgaatatagtacagactctgagttaggcatgagcctgttctactgtgatgactcagttaatccaccacttttctgtctttgagcttctgagaacctttgtttctacagcatgctatgatatcatttggccttcatttggtacagatgtatcatttgagaaacagatccacctctggctttttctcacccctcagcctgctacaattaaaatagcactacttggctatggtaagatagtaaatacgaatgcacattcagacactaatagtacatggtgatttagggtcactcggtaagatccagatgatccagaatatggtgtgtgtgtgtgtgtgtgtgtatgtgtgtgtgtgtgtgtgcctttgtgcatgtatgtgtaagagacagagttttagttgacttgaaaaaaagaaacttagacttttataggaaacaaatggaatctcaaagtcagccccatttgcccagagactatagactccaatatagaaaccactcatctgtaggataaagactatattcctcatgttggtatccaaggcctttatcgatttgaattcaatctcttttccttttttatttgtttttcttttctgtcttcttactgtcttttaaatatgctcatactttcccagatgtgtgccttctctcctatccctgtataagcccatctgtccacagcctttaaggaccattcatgcttttcatttccccgtgaagcttcttcctatctcttcagttacaatttgatttttctccttctttgaactcttgtttgaattccttctgtatctggtactttggcatttcgtttctttgtattaaataatgccatttataattgtttgatttttatgttctctatatcacctagacttcaggggctttaaaggcaaaatattatcttaaaagttttttgcataaacctcagaaccattgttgatattcttgaagcacttacaaaggaaatcaaatgattagatttaatgctcagtattagggatttaatttagtttctcttgcaaaatatgtgtttttttaaatatagagtataaacaaaaagtactttgctataaaaaatttgcatttctaagaaactaaaatgtcttaaaattttgtattttttcactcattgtccttcattttcaggactgttgggaaagatcctgatggctatccgagatgcaggttttgaaatctcagctatgcagatggtaggtagtttacaatgaaccataatatttgtgaggatttttttcaaaaatagttataaaatgctttacattgaatgttccctgtgtactcatgaaccacattaaaaataaaagacatacttactgaactcagtaaccttcctgtagtcaaaaaatggtttttgaaatgatttttcccatataatattttactgagagaagtaatattcaatgatacacctaatttaagcttataaggtaagtttatacaattctggaaactttagttgcaaaataaataaggaccaaaaactgtattttgttcttataaacaaaaagtagaatcaaagtgagaaattgtgatgagttttctgtcttctggattcttcactaaacaaataatgaaggaagagaatcagttcagattttttttccctaaccagtgccttttgctggtttttggactttctctcaagactgtctttggagttagtgtattctagcaactctgttggcacttgtaccgctgcaccttcagagcccacgcttgttcaaaattgcgttgttcatacactcctaggaaacctttcagtgagaaacaacacccactttggtagaggtcatacctttgtgctgtactcatcggtacatttgactagaaattgggcaacagattattatataaatcagataaacaatttggtttttacagtgtttgaagcccagcaagtttgtgcttttttgatagtgaaataccaaaatagccattttgaagctgagaattttcttactggtattatttgtattttattttctgaaaagaaacagctttctaaagtcttaagattacccaaaatcaaggaccaggacacaaactggagttctattttgtgccaataagccaaaaaagaaaaaaaaaaaaagggaaatagtttacaaagtcattgagcaaaacttaaagactaatgagaaaactgatatttgaagaatcttacctagaattataaagtaattgtcagccaaaactttctaaaagtattagcttggtgatatattaacaagattgtaggatgacatgtaagcctatttaaaaaaatatagaaatgttagttttaaacactgacctaattctagatctacagtttagcatagtgattggtgattgggtatagtttgtactgatgaaaaaaataattttaaaaatgattaattgagcctataggtaaggcatggtagtgtagtagcaaacacagtcgtggacttgtggagtcagaaagatctatttctgaatcttgggtcagctgttttctaggcatgtggccttggccaaatgtcaagcattcttattctcagttttctcatctaggcaatgaaagcattagtatctgcctaaatgggttactcagcagattaaataaaataatcatttctggctcaaattctaagtatttaataaatgatatcttctattagtattttgttgcatttagcaaaacatatgtgaatgttggataaaacactgaaatccaacagaatttcctccctatggtagtaatgttgcccataaaaataaatcctcctagcttaaatgattgtccatattggcagaaatttctcagtgggtcttcaatcctggcaacaataaacaagcaaaatggagggaaaataaaactgggaattctgaggctactttttaaaaaaaataaggtcttagtttttgagaaccttagaatttaacgaaattttattcctaactaaatttaaattcagccttgataagaataagtccctctagacttactttgtaagcacacttttacagttctttttgaagagtagcaggaagtccacatgacttgtataaatgctttaacacaaaccagactaactagggatttttccgaatgcttgggaggaaaatggtattgttttctgtttcctctaaaagtctgaactacttttctttagtaatatttctttcttgtgccactaatctatcaatagtataattaatattgcatataaatcttcttttgtatcaagaatgaggttttattcagagagaggtgtagtgtagtaggtaaaagtattatcaatggggtcagactgcttgagataggatgccagtttgaggaagttgtatgactcctctgagtcttagtagtctcatctgtaagttggagccattaatactacctatgcagtaaggtggttgtgagggctaaatgagatgatgcacgtatagaacctagagtgatgctgttatccattattattcttgatgagttgatgtttaataacactttttcttcaaagagtaatctatgtaaagtttatgttttagagtaaagaagagattacaagtgttaagtgctaagtgtggcttatttatttcccttttgttggttggtttatggttttgttttgttttattttttaatatagttcaatatggatcgggttaatgttgaggaattctatgaagtttataaaggagtagtgaccgaatatcatgtaagtataaaagtaaatgtaaaacatttgtactgttaagtgaaaagtataggatgcagtgttttggactaagctcctgtactaggtcccaaatggccagactgaaaatcaatacagagtcattcatactaaagttctgtgtcaacgacctaggttgttatctgaccttctgagaaatcaggagagagcgagccaaatttcccaaacaggctaattttgtttggtataataatgaagttttctctgtctttcatccatacaacaaaaagtaacctgaggtaacctgatgttaaccagtcagttatttccacattacattcttcaaactgtatacctttcatatctcccaaaattcattgcaaccagcctgcagcttcctaaattcagttctcttcttttttcttccccctctgtagagtcagatgctaggttcagatcttaaatcttctagttatatgaccatcgacaatttatttaccttctttaaaccttgattaacccatttataaaatgggaataatgctattacctaccttatgagattgttgtgggaattaaatgaaataaattatgtaaaactgtctcacatattaaaagtactcagtaaatattacctgctattattgttgtttttattattatttagtctgatataattctttggtagtagattccatgttgattatttacacctgtattttctgcttcaacatgtacagtcataaaaaggtgataattcctatctcatgctgttactatgatccacacttattatatatattgagtatctgctataagccaaataatcagtgatgaacaaaaaacatactgcctgcatttatggagcttatgctctggagaagatagacatgaaatcaaatgatcctacacatagctacctaaggacagcagtcaaaaggctgtaaaggaaacagaaaggttgtttttttgtttaaaaaatttgtgacttaattaaaaactagggtgacttaaaaattctgagtcaatttttgaaggaacatgttatgcttttgatgaagttctttgtttaacatgttttttctttccattttatacattttgacagccttgtatgtctattttcagtggtatctgtaatcaacactgaaagagaatgagtgagagagacaaagaaagaaaaaaggaaggagggagagagaaaaagaagaaagaaagaaacaaaggaaaaaaaggagggagaggaaaaggaaggaaacaaggaagggagggagaagagcagacaaaatttactcttctgtttttggaaaacttgttcatgccttctgctccttctgaaaatttggctttgacatttgtgtgtaggcagtacttcaatatcagaggcagaaaatcagactcaatataattatccataaaaaatcaattacatatgacctttgtgaaatagcaaaatggctttgggggatacactcaggaactctaatgagtagagttatgagtaccatataaattttgaagtccttttcctcctcttttagcttctgtagtttgtattagctgagatgactgcttttggatcaatattcaaatatattctgtaataaattattttactttgatgttgtgtatcgtaaatcctcaaagtcatgaaaatggtttacatgaccctgcatggtctggcctcatctcttactactttcccgtagtctcactcagctcctagcctctaagctgatcttcatatatccctactgtacttctgcctcaaagtctttatatccattttcacttctgcctaaagtattctttcctattcaagagggtgaaaaaaattatttttgagtgttctagacactatgagaggcatttttcttggatcatgtttttcattatacagctttatatagagagctaagaatcttaaaacagtatacttatatttttcccctattattctgtgtgctgttgttctcatacattttacatctatatatgctataaacccaacaatacactgcatttgctttgaacaattatgtttgaaagcaactgaaaatacaaaaattagctagatgtggtggtgggtgcctgtagtcccagctactcaggaggctgaggcgtgagaatagcttgaaccctggaggctgaggttgcagtgagccaagatcgtgccactgtgctccagctgggcaacagagcaaaactctgtctcaaaaaaaaaaaaaaaaaaaaaaaagaaaagaaaacaacagaaaggaaaaaaaagaaaaataaagcaactaaaaaataaaaatgcattttatgtttatacttgacatgtttactgttgctttgtatagatttatatttttgtctggcatttttttccttctgcctaaagaacttcctttaatatttcttattatataatgcttctgatggtgaattgtatcaggtcttttttgtcttaaaacgtcttccttttttcttcatttttgaaaaatattttcccacctgggtatagaatacagatttacattttttggtcatcattgttgtcatccttatctttttcccactgttatataatgttctttcccctgccccccccccaacaccctggctgcttataaagctttttgtttttgtttttagctaattttattattttgcatcctagtgtacttctctttacatttattatccttgggttctgttggatctataggtttatgggtttcagcaaatttggaaagtttttagcacttattttaaaaaatatatttatgtttatcaccttttcttctcttctgagattctaattacacatataatagacagcttgacatggttgcacagcagggcttttttcttcttcttcatttttctttctctccatgcttatttttgaatagtttctattgaatgtcttcaaatttattgctcttctgcagtgtcgtatcctgttcaccccattcagtgtatttttaaatttagatgtcttagattatatctctagacgttgtatttggatcttttaaatattttttattttctcctcaccaagtttatatttccttgtataatttgagaatgtggagcttataatagctgtttggatatcctttttatgtcatttatttaattgctgggtctatttattgagttttcttctggtaatggttagtattttcctacatatttgcctgcctggtaatttttttactggatactgtatattgtaaaatttacattgttacatggtagatttgtaaagagtgctcaattttggtctggcacctagttaaatcacttggaatcaatttgaaacttttgagtcttgcttttaatctttgtaggatgggtatagagcatcttacaatctagggctaatttaggccaactgctatggtgcagtacccttctgaggactctccttgatgctccatatatcatataaaaaggcctttcactctggctggtagaaacataaactcttctcagccttgtgctgtctctgagttgtttggtctactttctggcaattctttccccagcctcaagtagtttgctgtacacatgtgacagattagtagccaaagactcatgggaactcctctgcagatcctgtagcttattttctgcatactcccctcatctctccagtattctttcctgaaaataaggctacattggcctccccgaagtgcaatctttgtcttttcaactcagagaacgttgggctctgttgtgtttcctctacctggtctactggtctggaaactgcctctagacagtaagacagagcaattctacagctcacctaatctgtttccatactttcaggggtcatagacctgtgctgcccatcacccagtgtatgaaaactattgtttcgtatattttatctagtttctagatgtttaatatgggagaataaatctggtcctattatttcttgttgctagaatgcattatgatttttaaaaggttttttaggataaaacctttgaaatttatatatatatatttagtaatgtgaattcaacaacattgtattcaagaaggcctttgcaaggaagatatactagaagatcattccaaataatgaaagtgtcggatgataaagcattatattaaaatgtgataggaatggagaagagagagcatatctaaaaaatattcttcaaggaaaaatggacagaatttgggaactgcttgatatgtgggatataagtggggaagaagtcacagatgactttaaggacattagtggaacagtgaaacaattaaaagaggagagttaaaaattgttaaattcttttcattcttttatattacatatcataggacatggtgacagaaatgtattctggcccttgtgtagcaatggagattcaacagaataatgctacaaagacatttcgagaattttgtggacctgctgatcctgtaagttattgtttaaaatattatcctagtttgtgttatctattcactattttaacaggtttaaaatttttcgtttgttcctttaagtaaataatgtaaaaatgaatataatatacaaagttttaattcaaaatggcacttcataaaatttatttttacataacattccaagaaagataattttttttgttaacttagtgacaatatagaataggcagaagcatttactatcgcattttctttttttctttcttcttgctaaattgtccaggtaaatacattttgcaagcttcataatagaaattatctaaggtattatatatcctttgacataggggggccataaataaagcttttataatacagtggcaacataccaatacataaataaatatgggcaataagacttatgtgaaatttggtattcactagtatacctttcagtttgctttgggttttcttcctaaagcaaactactttttcttggacatttaacagtgcatgtatgtatgtgtgtataggtgtaggggagtgacaagtagaagtagcattagaacgctatgataaagctctatgcaaatattagaaacttgataggattatgggaagtattaatgatttaaacactaaccttaatgtaaatgtactgtttcctgtattttactattatttataagtagtttattgaagatgagcagccaattcaatttaattttattcagggcattgtttattatttttaattttttttttttttagatggagtctcactctgttgcccagtgtagagtgcagcggtgcaatctcggctcactgcaacctccacctcccgggctctagtgattctcctgcctcagccatctgagtagctgggactacaggtgtgtgccaccccgcctggctaatcttttgtatttttagtagagacagggttttatcctgttggccaggctggtcttgaactcctgacctcaggtgatcagcctgtctcggcctcccaaagtgttgagattacaggcatgagccgctatgcccggccatttattgaacacccttagatgtaagacaataaatccacagcatctattaagaaatcatcttgtgtcaaagtgctgctagattaagcccagtaggggagaacaacactcctgttgtcagtgatctaaaagtatatacataaagatcttttagaacatttacagtgccacatgcaaataaggatattgttatttcagtaaaatccaaatgttggattgtgtagcaacagagcagttaatatgacctgaaagtagttaagaaaacttaaaggaagagagatataagcaggggtatgaaagacaaattagggcacaaagagaatgagaaaagatctaaagcatgtgcaaaaacaccaatgaaggaatttgcaaatttactgtggtatacagcaagaatattttcttgacttcagtgggaaatacatagctggaagcacaaggaaatacattttcttagatagaggaaatatggtagagaattctggtagagatgggtgtgattttagccttagaagccaggataaaaattgtaattctatttaatttgaatcccatatcataggaaattggaattccttgtatgcagcttaattttgactatactgaattgttactttgatgcaactaggtcaaactaaattggaagagattaaagtcagaggctctagaaatagaaagagacagacctgatgacatcaatagagaaagtcggcaggacctcctttatatcttttcagggagaaagaatagatacttaaataacacatgtggttgtgatagagtaatgattacaaggtgactctgttgcaaaggccattgagagaaattggtaatgatgctgtttattgaaaattaattataataaattaggaagggattgctttttggctagatgagtaaaggtaacagtttttgccatttttaacattttaaatttctgatttctgtttgatgggcaagaggggtttttgtactttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctgtacttttttttaaggtaagtaaaactgtgagtgatcagcttgacctaacaaacagaagtaaattaaagagataaaaactaaaacaaaaaaggaaagaaataagatgattcattcttttgttctctcatttattcaataaatatttattgagcccatgtcagtatttgtgaatatatagaagcccaggctgggcatggtagcacacacctgtaatcccagcattttgggaggataaggcaggaagattgcttgaggccaggagttggagacctgccttggcaatatagtgagaccctattgctataaaattacacgtatatatgtgtgtgtgtgtgtgtgtgtgtgtgtgtgtatacacacataattatatatttttttctatctttatttttgttatatatatatattatgtaataaagttgatataatataagcctcaaagatcttagcctgtgagtaaacaactgtaagtggctaatttccatgcaatatggcaattgcattgttagatatttgcgggtactctaggaacccagaaatatagcacttagctcagcctgggaatgtgtgacacagtggtttgaatgtgtccacgaaaagttcatgtgttggaaacttaatccccatgtgtatatgttgatggtatttggaagtggggcctttgggaggtaataggattagataaggtcatcatggtgaggcccacatggtgagactagtggctttatgagaagaggaagggagacctgagctgacatgcacactcttgccctatcaccatgtgatatcatgcatcatgttatgacacagtaaggtcttcaccaaatgctagtgccgtgctctcagaccttccagccttcagaacttagttatttcttacagaaataacttttaaaaaatattttcaaatgctctcacccagcagaaatacatttattttctccataaattgcctagtctcagatattgtagcaaaagaaaatggactaagatatgtgacaaatgtcaggggagacatggcttctgagctgaattgtaaggaattagaacttatcttagtgatgaaggtggcaaatgatatggttaaagttttgaatgcctaaaacaacaacactttggggctacagcaagctctttattactgctggaactaatgttcagcgcaaggaatgataaaggatggggtcattcgggaggagctggggagtgagcaggttcacgatcatagaaagaagagtctcgaaaagaaaacaatgctgattcccattttttttctaagtatttattcaaggaacatttactgagtgaatagtatgtgcaaggctcactcctgggtcctattgctggggcataaaaaagatgactagaatacgttatatttccttaaggacctcgtaacctcatgatagctcaatcttgaaactctttcagggccctgaatcttgtctcattaagtatggatggcattactctactgtgtttttttggttcattttagttgtctataagttcctcatagcattatagaaagttgcaccacagggattttaaaatttggaactgatttaacgtgtaaaatgttaacagtggttatctttaggaggtggaaatatgataatgtttcagttctgttttcctatattttgcaaaatttctttaaagtacttatattacttttataataacaaaaatactttttatcttaaaacctgaaagttaatgaacttttgaatgaggaggcatatacttctaagaactgattatcttgtgtctcagactcctgagttacattctgtttctaagtggagatccaggatgtcaggcaggactgtatgcctttgatgggggttttcaaatcagaagaaatactatagtagttacaatcaagctatgttttgaggacaataaaatggctctttccctttggtctcagaatttcaaaatccatttgattccttttctccattcttttctttcccccttttctctccacctcgccaacaaatggatattgaatgcttactgcatgccagtaactgctaggtgctactaagtttatattaatgatcaaaccaatacaggtttgttttttgaagaatgtatgatctagctctaggaagagatagaattgataattaaatagtaatctcaccttaaagtgcagatgtgccagtctattcatgtattatattatcttaaaataatttagaaattcatttcttcattgcctagtcactcccatatctaaagaaagacccttggtgatgagatgtgcaaatataattagtgcttggaagatggccaggtacctaatggccatgcaataaatatttgatgaactaatgaataaactggctatattatatatatatacctaacacctggtactaacttattatttaaatattttttctatcgaaatgggtcctgcttcttacaaattattttctaagatatagagctattttataaagtgattcacaagaaagttcagcctaacagtgaccattaaatcagtttgtaactatatatgttgcagattgacatgatttcatcattgatgtctgtgcttttggcatattcttccccttccagttcttatagctggaaggaatgctcattatgtattaacaaaatttttttcggtctctctagaagtggtgtccaaagaggagagggtgcacaagacaattcattagggaggggggaaatattagacttgcaatttctatttactatctacaaagtaataatgagattaagttttaataaaatataatgtgtggactgataagactgcatttctataatttatttaaaatatctgcttaaagccctgcagtggctccctattaccttccataggaaggctttcaaagtcctccatgaaacagccattcctacttctagcctcatttcttgctgcattttgtgcctttcctctgtcctctgcatttgcactttaccctccactaacgtcaaactggaccgagcagggtggttccacctgttatcccagcactttggaaggctgaggtaggcagatcacttgaggtcaggagttcaagatcagcctggccaacatggcgaaaccccatctctgctaaaagcataaaaattagccaggcatggtggcgggcacctgtaatcctaactactcaggaggcagaggcaggagaattgcttgaacccgggaggtggaggttgcagtgagctgagattgcaccactgcactccagcttggacaaaaaagtgatactctctctgtctaaagaaaaaaaaattatatattatatcacactatttattcttccttaataaaccagtgtctttcttctttcttctgtttctatatccttctcttattgtcttattgacagagaaacttcctcagctattgaaactttgcccaagcacctgagaattaaatattggtcccaccaccctcagacagaatggctacttcctcttttgtggccttattttaccctatatatactatttttatatcacctgttaaattttactgtacttatttatttaccgtctgtctacttcctgaaattgttccccaagatcatgttttattcatcttagtatttctagcatgtagcagagtacctcgaatgtggaaaacacttgataaatagttgatggtggaacaaatgaatggaagaatacatctagagtcatgtactggacaaatgaatagatttttcgaaatagaatatggtcctattaaagaaaaaaagtccaggatttcccccagacttttgaatttgccttgttttcaccactcatattgtagtatgacatgatatgtaaaatattacagatctgttaaatatatatgtataaatgtgtgtatatatgtatatattcatatatatacatatatgaatatccaaaatctattaaacaggaaatctcagaagaagagagcatccacacctgaagacagcttagcgtaagatgaggaaggttcagacttggaaagacaacctagtatggggttttagagcccaggtggggtaagcatggtttccctgtagaaggaatggcctggcatagggtgcccgatcttatgcacagagaggagggcctgtgatcctggggagcagcctggcatggggagtcagaacctgagtgaggtgaagagagcattcacacttggaggcagcccagtgccagatgggcattgatacagaagggagatctggcctggtgtgtcagagcctgattggcatgaccaaggcatccaggtgagaggcatcgcctgggtcaggatattgaagcctgtgtgagatgagaagagcatcttcatggggaatagatgatgacagatatgggaggttggttatatgtggtagaattcatcaaataactagataaattaaagacaataggagccagatttctctcagaggagagatatacaaatacagaaaatgagaaaactgcaatgaactttgtgttcgaattgaaattggagatatgatatgaaggcatggctttcaatatacacagattaaatgtagaaataaaagatataaatgtgtgtatgtgtacacactcagaaaaatacatctctctctctctctctctatatatatatatatgcatgtattcccatacacatattccatagcaaagaacatacctagtttccagatcttgacttctaaataccattcttcactctacgaaatgaagatcctcagagaagtgaaatggcaaattccagaactaggggaagcaaaatacaatatgatcttggaaaatctttttatgccaaagtaatggtgacatatcaataggacacagaagccagcttgaaggggttccactagttgaatcgaaaccaatttgagcatctaagtaaatcatgatagcaacacgttataatctattcattgttactaaaataggaaaccaagactttagacaaatagtaattaattaatcaaaattttgtttaaaatgggatatatatagtttcaaaatcccttcccacaaaatatttattaattaaaaaaaaacccttaacattatagttaataatgttaacataggctggcagacaataagaaatattaaaaaaatgtagtgataaaagtgaatatcatagattggaggaaaattaaatcatataccacaagataggatgaaataaaaagaatgtaacattatttctgtgatattcctgccaaatatttataactgaattcaattatacagaaatatgacatgcccatggcctctaatctttagaaatataaaggtcacaaagttgaataaagactgaggaactgttcaggactgaaaaacactgaagagacatgatatctaaatgcagcatgtgattccaagtcaggatactttggccataaatgacattattgagataattagtgaaacctcaccagggtctaagtatgaagactgtattgtggttatataggaggctgtagttgttggtaagaaatataaactaaaatatttggaggtagtggagcatcagattagcaacttatttttgaacgattcatagcaaaaacaaattatctgtagtctattagtaacttttctataaatttacagttctttcaaaataaaacttaaaatgtcaagtttttacaactcaaaaataagtaaataaataaaatgtcattgtctgtgaagtcaaggccagctccactgaaaatgtgaaagaaatagattatattgtttagctccttcctctcctcgccatagtcctgaggtctcagccctgggttcctctattgtcttaacagaacaaagtctctaagcaggtctggtcaatttggtcacactgagacacaaattactattcagaatcaatatattaccatttccttggggttttttccttttcctttactttttaaacagatttcattatttttattttaaaagaaaatttcaactttggaattttagtttccaggaagctaagaaaagctgacttacaggacttcatagttgcccttcaatcattcatgcattcataaatgtttgagtgcctactgtgtgccaggcagtattctaggcaccaaggatacaccagtgaacaaaacaaatgagaaagtgagagagacagagagataaaatctcctcacagggcaccaagcttacattctagttggagacagataataaacaaataaaaaatagaatacatagtatttcatatgatggaaaatgaagaaaggaagcaacctgagttaaggaagtgtagataggatttgattataagttggagtcatcagagaagggctcactaagaaagtgatatttaagaaaacatttagctagggacagtggctcatgcttgtaatcccagcactttggaaggttgaggtgggaggattgtttgagggcaggagttcaagactagcctggtcaatatagcaagaccctgtctctatttaaaaacaaacaaacaaacaaaaataaaacaaacaaacaacaacaacagaccagactgggcaacaaggtaaaacctcatctctacaaaaaatacaaaagttgccaggcatggtggcacatgcctgtaataggttaaggctgcagtgagccatgatcgcaccactgcactccagcctgactgacagagtgagactctgtctcaaaaaaatttgggtgtgtgcacatgtgtgttcaagtttatgtgtatataaatatatataaatatatttatatattctactggcacatatactacctggcacacagtatataggtatacaaatatatttccatatatttgtatgcatataaagacttgaatatgtataaatatatgtaaacatatatacatataaagctcttgaaaaagccagccatgctgatttctcagtgaagagcatcctaggcagaaggaacagccagtgcaaaggccttgggagaggagcttgcttgaggtaatctagaaacaccatgtaatgagcaaggtggaagataaggtcagagagatgagggacagggcagatctcataggtccttataatgactttagcttttactctaactgggaccgtaagttattgaagagtttggagagaagagtgacataatttgattttaaaagaatcattgttactagtgtattgagaatagtctaaagacaagagtggaagttataatccaggtacaagatgatggtgagttggaccaggatggtggtaatagacatggtgagaaatagtcgggtgttatttaccatgtgtttaccttttttctctttatcttaagtggatgagtagatgaaggttaaattgatgaaatagaaaaagggaaatggaagaatccttagttctacggagtagaaatggaataaaacagagttctctctactctattatgattttatctcactctattgatgagaaaatggaaggtgaattcatattcctgcctgtcaatttagtacataacaacgcttagagaaggcatttatacctaaccagagataacaggcatatccacagattaacatgtgccaagcatttctattactagtttatagtaaaagaaacatttttcttaggtaatcaacttaatttattttataagcattttgttaactttagcaaatgtaaaaataatttaaaaatacattttcaggaaagtattaagtggtttaaatgcattttaacataagaaaattgaaagtaatccaagtacagtgagtatatataaaaaaagttatgtgttagtaatttattttctttgaagtgatttgcatgcaataacttgtaatacctattaagtgattcagtgattacaaaataatcctggagaaaatgatcatgtgtttaatgaagaaacatttgtctaaccgagaaaaagaaagaaaaccctcatctcaatgtcgtatattagttggatgaccaacaccgttcccaatttggccaggactgtcacaggtttcacactgaaagaccagcatcctgagaaatcccccaatcccaggaaaagtgggatggttaatcactctaaataatttaccttttaattgtatacctcttaaaattgaactgtaataaagtttatttatattcacttataatttttaaatagatgttatattaagttataaaagcttagaagtacagttaaactacttccacccacatccacaaaaggtcaattagatttattttttaattaacttttcatttgctttataagttatcctttcattggaattatttacaggtagaggtattaagtacaggcccacttctcaaaacaacatatgggttgaaagctaaagtatagaggttggggaaaacatgcgtaactgaaatgtaagtccgtgttcaaactcatgatttgtgaaaatctttcatgaaggaggcaaaccaaaatgataaaaaaatgaggaaaaagctgtcttggaaggtctccttagccttccttccatcaagtttctgtagcttcttcatcatataaggtatattggaacgcatttcagaataggagatttagagtaaatatttatttatttcaactgtcattatctattcataaattcaggcatttattaaacacttgctatgaacctgatatcatgtttatttattggggattcaaagaggagttgagacccttaagaagctctcagtatactgggagaatcagacaaataaattgcaataatgtattgtaggctgggtacagtgacacatacctatagtcccagctactttagatgctgaggtgtaaggatcacttgagctcaggagctcgagactagcctgggcaacacagtgagatcctatctcaagtcataataattataataagatatgataaaggttatcttagtgagaagtacagaatgctcaggaaatacagccatcctctggtatcttgggggcttggttccagtaccccctcagacaccaaaatctgcgcatagttaagtcccttatataaaatggtatagtatttgcgtggaacctattcacatccagattactattactacttaatacaatgcctacacatcacttaatttgtgtggattcaatgtagtacttagcacatggcaaattcaagttttgctttttgcaactttgtacaatttttttatttttccaaatatttttgatccgtggttggttgactttgcagatgcattaactcatggatatggaggactgattttactctgaaggaacccaacccagtctgtgttgagtggggtggggctgaggcctagggaataggctattcagaaaaggcttccctgaggaaatgatgcctggagctataatttaaagaaggagttaaatttggcttggcaaagaaggaaagttccagagaaatgaagagctcctacttataggaaattaaagctcctcccatctgccttcaagtttccctaaggaaagtctggatcttcagcaagaagtttcacccttataggagaaaaagttgtatttaagatccagggcatttatcttaaggatggagttgcattcaaaagtggtatctcacgtcatctgaaatcttagtctcttatttttgtgttttttcctacttccagtggaattaatgataaacactgagattacttctaatgggaatgggtattctctgcaaaggatttttcctctttcccagggctactgtagatgaagacttttggcaggctgcattgattggcattgggctatattactaaaaaaaaaaaaaaaaaaaaaaaattcaaaattggaaaaattttttaaatgccttaacaggaaatactattattttttctttgctttgctttgtttgtttgtttttctgtttttctgagacagggttttggtctatcacccaggctggactgcagtggcagcctgaatctccccatctcaagcaatcctcccatctcagcatcccgagtagctgggactataggcatgtgctacatggctggctaagttttaaaatattttgtagagaggaggtaccaccatgttgcccaggctggtctcctgagttcaagtgatcctcctgcctcagtatccggtgtgctaggattacaagcatgagtcactgcacctggtccagtagttcttttcaagcaggaaaagttttgtatagagaaatgtaggcaaagtcatttaggatacagagggaagtaggtgaggctctaggggaataagttgtactacggtaagaaactaaaagtgtagctaaactgttctacataagaaataaaagggaaaaaagcagttaagccaccagcagaggctgagcctggggaaagagaatttagcatctgggtgggtgaaggaattttcagaacataatttctaaaatttaagtctgagatatttgtgtttctggggcataaatcctctatatcccaaaacttaaggaaatttagtacatattaaagctttgggtggtggtggtgtgggtagaaaagggaagtataaatgtgtaacacatttaccactactgctggtgcctagaggaaggagtggcatcatattgaaaagcatagtgcagcttatagtgctgctttaagctgtggcaggtgaggaagtaaacagtgaagccgcaaccagcacaaaaaggctacaccatgcaattgattcaaatgtacgtaacagtcttgttttcctaaatatatcaaaggggagaaggcaatggggtaaatacttttcctttctttgacgtttttcttatatgactttttatcctactgttgtgttaagttctgagactaaaggaatacaatggaaggggggctgcaaatagaacagattttacaatttggatagttttcagtcagcactatccaatacgaatgtaatacaagctacatataatgtaatacatttgaaattttctagtagccacatcaaagagaaacagatggcattaattttaacaatatagttaatttaatatatccaaaatattttaaggatataatcaatacaaaaattattaatggaatattttataatctttttccttttttgcactaaacctttgaagtctgtcatgcattttacacttggagtgcatcccaattctaactagccaaatatcaaatgcttaatagccacatgtggctaccatattggacagtgaaagtcgagaccatttcaacagacattgcttaggaatatagaagtcttctccattatttgttattattggagtgctatacttgggtttgttgtcagaataaacaataaagtataatattgcttagttttgatttctttgcatatatttctctctggtttattattttcaactttattgacaaaattgacaaatataactataaaaatttaaggtgtacaaatgatgatttgatatacatatattgtgaaatggttatcacagtcaagttatttagtacatccatcacctcacagttacaacttttgtgtatgtggtgaggacattgaagagctactctctacaaaaacaaaaacaaaaaaaatctgttattcttctgcttttatatcacaacagtcaacagaaaagacctctgtgacttttggtcaccaagaagtgtgtggggatttttccctaccaacaaccaatcaattctgtagcggattcttcaacagacactagctagttgccctctaattcaattcaattcttacattatctacctagagatcccataggttgagggttcaattccacaagactgcccccacttcctgtgctaattgcaattcccagattgttttgcttgtgcttttactgacttgctataaataaattggagtttccacaacccccactttgagtttgattaatttgctagagcaactcacagaactaagggaaacacgtttactgctttattataaaggatattacaaaggatataaagatgcaaaggaaatgtataagaaggggtgtggagtttccatgctgtctctgggtgcaccaccctttagggactttcatttgctcagctatctggaagctctctgaaccctgtccttttgtatttttatgaaagtctcatttcatagtcatggttggttaaattattggccactgatgattggctttaaccttcagcttctcttccctcccgaaaagttaggaagtagagctgaaagtcccttctgatcatacattgatctttctggtgaacagctctcattctgaagctacctgggtggtgtcagccatcagtcaactcattagcatacaaaaaggtacttatcactttgaagattccaaagattctaggagttgtatcccaggactaagaccaaatgtgtttagacaaagatcaaatgtatatttcacaatatcacaactcttttagcaaatttcaggtacagtatgtatgctctactttagattcccagaagttagaacttttttatcttatacctgaaagtttatacccttgaccatcatctctccatttcttccatctgccaagccctggcaactactattctactctcaatttctatgaatttgacttgtttagattgcacacataggtgagatcatttagtacttgtctttctctgacttatttcacttagcatagtgtcctccatgttcatattgtcacaaatggcaggatttccttctttttatgatttaataatattctcttgtatatgtataccacattttctttaaccattcatcacttatccattcatctgccttagcctacctttaaaactaactgttttctggcttcccaggtgggccttgctttctaaagctcaaataagatgctaagctagtatttagcaaccttgaaaaaatgagtcacctctccttttttttttgtttcattttgacattagtacctgtcacttctctttacaacaaaataaataataatagaggtaggaggcagagaaactctaggcagacaggggtgagtccctggtgaagcctcaccttcaagccaaaaaacctgaaacccgtggcccaaagtgagaacttctatccctatttgcctggtctttcctgattggttctttctgaataatgtctttttacaaattgaatgttgcctttttcaaaactacctatggcttaccctgccccccatcctgtgcctataaagaccccagactcagccagtagaggggagaagcagctggatatctagaagaggtgagttgacttcagagatgatggctggatgtcagaaggaggcagcttgacttcaaggagagagggagagaggcaacctgacttcaggggagagatctgcccttcccttcccctccagctcccctttccactgagagctactttcattgctcagtgaaattatccgcattcaccatccttcaattcatttgtgtgacttcattcttcttgggcaccagacaagaattcggggcccaccaagtgtgaatacccaaaaaggctgtcacactggccctttgccctcactggcggagggcagctgccccacataaggcaaagggcccactgagctggtaacacactgctgtccacaggtggtggagctaagagagcattgtaacacaccctctggggtcttggcattgcaggcacccccacttggatgctgccacagggcctgcatggagtttgcttctgccggtgccaaagtggccagctggttcctgcatttgctcacctacgcatgccctcccacaaggcattgagcatggcaggctgagtaaatggggcaccgctgtcatgggtctcatgaagggatcaagaaaatatcctgcattatcaatacctttgtttcttgacatggtcctggagaaagttacaaagcctttttcttttctctttcctctctttttaaataaagttatcctaagaagcaaattataccagatgtttagtgtcttctagtcagaaaatgtttgatgttcttatgagaatttaacaataacttggacctattatcattttttgaaatggcaaaaattcaaacaaaagccttcatggttttgaaatcaataaaggaactcaggggactcagaagagccacacgggttctatagtcatgtttcaaacaaggctgttcccttcttttcttcagcaggctcagagagcaggttaggaaaggaaagaccagtcttttcaaaggggctaacaatggagatcaatattgagacttttttcttggatgtctactcatctaattttaatccatgatataagctccctttccaaaccacttgcttctaacatgtcttcctacgttttatcttgaagagcactttctcattctttatacttggtttgtcccctaaactacaaagcctgaagaggactaaggttttcctttctcataattcacttttgaaattccaagatcagtataattaactgtatagatcttcaaaagatatgcttgtacatactagaaagcttactgctgtggacatctgtgggctcattaccaccaatcaatatgtattacaaagagaatgaatgtatagcactgggtaatctggagcacctattaactggaaattagcttaacaagcttacaccctgtatgtgtgtgtatgtttgtgtgtatatatatatatatttatttatttattttatttttatattttttcccaagattattgtttttatgagacagctcaactgctgtctgaccaggatgggtctcttttggccagagctaaacactgacccaaatctctttggacaatcaaccagctaaagaccaggaaaatttttcagttcttgttctcttccttcctttagcatttggcatgtttaaagattagttggttataattctgtacttaagaaagacaaaaaagagaaaaaattaatggggagtgatacacaggaaagatgcctatttcatatatgttcagccttattgatcagggaaatgcatattaaaggggaataatacaactttttaaaccagtgaggttggcaaaatttaaaaaaatagataaaatccagcattggcaaccatgtggtggaagaggtactcgaggctgtagtactatgggtgagatttttttttttactcctgtgcagttcattctcattatttacagtagttaagttctataaagttaccatgaacactgacttggtgaatactgaactattgttcctaggagaaatacagagttaggttcctgtgagcctgtggtcacaacaaatatattaatgatcaatatataaccttgttttgtgtgtatttctgtttaaagacactaaataaatatcgttgatctagtaacattgaactcatggccagcatgactgtaactcatgcctgaatgatgcctgcattacatatatattttctttataaggcacatcacagcactgttatacttaggactcttgacagctcttcggcactatgctcaggaactgttttaaatagtaaagtcaccaacagaaaatacaaaaatgcaaaaaatgtaacaccaagtacactgcaaaaaggacacctatagccaggtatagtggctcacacctataatcccagcaacttgggaggatgaggtgggaggatcacttgaagccaggagtttgagaccaacttgtgtaacatagtgagaccctgtctctaaaaatatttaaaacgaaaacaaaaacaaaaaaaccttagctgggcatgatggcctgtgcctgtagtcctagctactcagtactcaagaggctaagatggaagaatcacttgagcccaggacttaaaggctgcagtgggccatgacagtaccactacactccagctagggcaacagagcaagaccttgacttaaaaaaaaaaaaaaaaaaaaggacatttgttttaaagtgtgaagtgtgagagttaaaataagaaggcagagagtgtcaccttgttcaccctcatttgggagtactcatgagtactcatttgagtgactcaaatttttgctgctctgcacatgtctaccaatggccatacatgtgctattaatattgattttggggttacaaataaatttcagtgagtaggtaaattcacaaacatggaatccacaaacagtggggattgactatattttctatgttttttaacaatgaatttaaatgacttttttaaaagtatttaatagcaatttattaaataatttattaagtaaagttattaagtaaaacaaatttattaagtaaatagcaaagtaaatagcaactaatttttaaaataaatattttcatttaataaaatattctggctaaagaaaagaatttctcttgaagaggaggtggctgaaaggggtttaatacaattagtaaaaattacatactagaaaatacttagatttcagaataactgtgtgtcttggatttcttttgctttggtgttaaataatgctcaatccccaaatttgttgaaaataattactctctctgtgaatataaaaagaagaaacattgcaacctagtaagagagtaacaaacagcagttgacattaaactactgtataaaacaatattgtatcatatttttctatgaaaattaaaattttattcaaatataatagtattgaatcaacggcaatcttttcctgaaaaagcagaagatgtaattcaaatttacaagtcagaggtttggaattttatatatccttttcttgtaatgcgtggattttttaactaaattttttaaatgaagatttttctcttttctggttgttcctgccattaagtatcataactgggattcaaatcttcacattgttgctctcaacttcatgcctttaaccattatatcatattgttttattacatgttcatgatcctatcacaatattaccagggcataaaacatgtgcaaatctaatgacttttgaaaattaaatagaaaagtattctctgttaagttttaaaagtagagattgcataatattttttccaggtgatttagctgtaagctgatccaaaagcaacaagatagatgacagtttttaccttatatttcctatatcatgattacttgtattatggatagaaagtcaaaacccagagaaacgttaactgattggattaaaggcaaaaagaactttatactatctcagcctcctaggtatgacatactgtaaatataggaacaaaataatgttttcccctataaaaccatttaaacagcatttttaacagatacatgataaatagtgctgtggtaaattattttacaaaaatgtttattatgtttccagatttattttaaatattacttcatcatatagttcaccaaatatggtaattgtatcctctcatacagtcttccaagcaaaacattatgctttgataaactggaatttaaaaaagaaagggaaaacatgagatatgttctttgatctgaaagaactaatgatctggagctgaactggagcttgcaaaagaaaaattaaaaaaaaaaagagcttatgatctatatgagggattcaatagactatggtaggaatatgatagtcccgtgacctggaatatacctaaaagtcttatttaatgtggcctgcaaacaaaggggaaggaagccccgatgaggccaggggaatgaagcagaaacgggagagaacgactggggcagggtagctgataattgttcagtgtgtgattctctagaggtattatattgcctctgattacagaacctcctccccatcccctgctttcttttttccccattttatttgtgattatgacgtaactggcaaatttgtagtaactgtcattttgtagtaacatattgttcttgttttggcacattgcatttacagtgtactcctttattctgatggagtgtgtgtgtgtgtgtgtatttaaatattatgaatgatttgttctagagcatctgaaactaccacagaaggactatctaaacaacaaacttagaacatagtttctagatgaataccaatgttccaacccccacggggcaccaacacatctgatacagaattattttgccacgataatgtttactattacctcacttaggaaccaagcattgggatgctctctaggttctaggttgacacatacatttctggaatggaggcttcagtctcaagcaataattggaataatatcaacaatactttcatatattcaggcatatcttctagtgtagtggagaatatagaaaagtcttaggaataaaactctcagagattccctatggtatacagacttgggtaaactagaaataaatttcactttaagggatttttgcccttttacctccatttttgttagattgagatttactcagttttatttgactaaaattattaaatacactgtgggtgttgggtattgaggactgagcatgatagacattggctctgtccacatggaatttatagtctagtgaggaatattgttattaaacaaatgattacatagttgtatatattacaactatgccaagtcttttagaagaatctgataattgtgcaagaaattatattaataacaggaggctctagcttagctgaagtagaggaattcctgaaagattttcatttattctgaagcctgtagaggccctaaatctggggagaacctagcatattctaggaattcaaggaagtctaatttggctctagcctacaatgcaaagaggaaagtagcctacaaggtaactaaagagattgcttaggccagagtatgaaggccacattaactagtttatatttactctgagtgcaacaggaagctccatggaaaatttaaataaagaattaatgacatctaggttgtatttttaaaaagctctgtggctatgatgtggaaaatttgttggaggaaaataaaggaaatcggactagaaataatgggaccttgggcttggatggtaacagtggaaggttttgaaatatattttggaaggagaactggaagaacttggtaatttggacatgggcacaagcaagtacatagtttatttactatagatgaagaaattcttgatagaaatgtttgttttattttggaatatatacagtaacagtaattaaaacaccaaagcctttattcattgtttcaatgtttctctggagcttttccagagatttaaatatcacgtacatataaatagcttttactctcaaaagcaggaggtagaaatagcaaaaatgcatgcaatcttgaatttaaactattttaactttggcatctattaggttttagtaaatttggaaccccctagtctttgatgaaaaaggtcttgagtatgtctggttttgttcttaaagtagtggtgtggcaataatgaggtcttatgctgctccttcagtgttaattttaattttgtagattttttaaaaactcaagttttgtaaaaacaaaaaatgctatatttcaccctactataaccagcagatgttgctttcttattagttctgctgtggagattcatgtgtggatggaattaattgactaaaatctaaaaacagatggactatggaaacacattctttataaccttacaggatcgaaatccaaccaatatatatgtatttttccaaacctgtaaatctatggatctttgtattactttattatcacccataaacttgatctaagtaattaaaggcaacatttagagactttttgggattatttccagttttggcctttaagccttcctactaattaattaacataatttacttctaggaattgtgacacttgctgagatgttacacttattactacacagaatgcaaatgaaatggctctttgaattattaacactataatctctactttcagagctacagaaatgattagaatagaaatatacctttcttctggaaagttttactattattttggtttaaacataagtatgtatgtagatttccactggggagttagctgttaacagccattttttctttgttatccttttcactgttaaacttacttcaaaaggcttctaaaggttcctgacatgttacagagataatatacacagtaaagttggcctgaagtatttttgtctctgatttattcatttattcagtcagccaacccaccaaccactaaccaaccaaacatttacagactttcaaagtgcatatgaagtattaatagttcttagtactagcaatgaaaacatgaacaagacacctttgctgagccagaggaatttatgtcctagttgaagaaaagaattgtattgtcaataattgcaataaagtcttataattgcaataatagacatatattaaatggaaaaaaatttacgatcaaataagattgagaaatactggtttaaatgaagttaagcagatttgtgtactaaaggactctagaacatgtcaaatgctgacatgcattgtgaatctccaaaagagggcatctggtatgaagtattttccaattttgttgccaaaagttacagatgacaaccaggataaggagaaattcctgaccataattcttgctaagctgctttcagggaccttgaagagaacataaagaactttgaaacatagcttttactttttagggaagagaaaaaagataaacaggactccataaatctagccttcattattttgttttctttatttccagactactcactccagcaccctcccttccccaccgcatcagatctttgcactgatttggaggcttctatgctttcctgcttttgaatttctcatcaatgttagaaagtaacattgtcctgttattaaagcttattcatactgatacaccaaaactcataaatacttgcatttttcagactattttctagttataaggtgaaaaagattgcctttagttaaaggaatttggaaaaaaatcattttgttttgtttttctttgttgtctctttttttccttctgcttctgtgatagtgaaggtgtagttaattttgatcctcttcccccttgggtgtaccctgagactaatcctagagcaaggttcttatcctgatgtctacagacccctatggcttttgggaatagaattcaggggtgctctagtttggtttgcttgactcccccaaatctcatattgaaatgtgattctcagcgttggaggtagggcctagtgggaggcatttgggtcctgggggcagatccctcatgaatggcttggtggcatcctcagggtaatgactgagttctcactgtgttagtttccttgagaactgtctgttaaaaagagcctggcatcgttcccttcttcctcttgcttccacccttaccctgtgatctctgcatgccacttccccttcaccttccaccatgagtagaaacagcctgaggccctcatcagaagcagatgctggtaccatgcttctggtatagcctgcagaaccatgagccaaataaacctcttttccttataaattacctatcctcagatgtttctttatagcaatgcaaacggactaagacaaggggtctgtgaacttggatgagaaaaaaagaatcgtgtttattttcactaatatctgactgaatattagaattccataaatataaacaactaatcactgttatagctatgtgttaatatagtagttaacttagcaaccaccagaaattgcaaacattttcacattgcattacaattgtacatatcttaaaacatcatttacagtcattgctattttaaaattataagagttattaaatcagctgctacattttaataaatatgtacattatatcacaaaatataaaatattctgataattttattttagagtaattaatttcctgcaattctatgtattttatgcatttaaaaacattgctttgagaagggttcataggctccatcaggctgccaaaagaggttcttaactttgtctttgcataagacaaaattatgaaccctagtcctaaaggaagatacacaaaggtcaaataagaatccctggagttgaagaccaagcattaacccaagacagcttcttcctttttattccttgtcctagtattaatcctccctaccctccgtgttccaggcctctgaggtattcctccttgtaagacttgtagccatccattctttttcagtctctcaacatcagctccaacttccatatagatatttgaattaattaattagttaattcatcaaatattttctggggacttactacatactaagtactattctagatacagtagaaatacagtggcaaaagaacaaacaataaaatctatcttcacagaggacgttctagttggggggaaacagatcaggagcggaataaataagtaaaatatataatatgatggtaagtgtgtaggggaaaataaagcaggggagggaaatagggttttccagaaaagggagggatttatagtttttaagtagaatggacagagaaggctgcatttaaaagttaacattggatacagacttgaaggagatgagggtgacagtcacctagcaatccaggctggaggaacagcaagtgccaaagctggagtatgcttagtatattggaagaagtcaggaggacagtgtggccagagtggagtgaatgtgtgaggtgaggtcaaagagatacaggatgggaaagaagatcacatagagcgtggaaagctgctgaaaatactttagcttttactctgagtaagaaggggaccattgcagagtttgagcagaggaccaacataacctaacatgttttaacacaataatgctggcttccatgtggtgaatagacaaagtggggccggagcagaagcaggaagaatgaataatgaatgccagtacttgacatgtggtgctttgcagtgggctctagagccaggccgcctgagattcttcatctgtaaaatataatctgtttcttcaccaataaaacggaaaaagaataagccggttgtgaggattatatcagctaatatgggcaaacttcttagaatattccataaatatggatttttcttacttttctcagagcctaggatacatgctgtgagggtaccacacaactatttgacacataatgggcaagatgggaagacttgaatgagttttgggcaaccttgttcctatgtcttgattttaggagagtaattgaggaaaggaagcaccagatgttgcctttagatctggaaccttattcttttcatacatatatgtgatgatggtgctaaagctcaaattacataagatcatgggaaaacaattgacactgactctgattatagaaagtagtgaattagtaaatgaaaaaactaaaagtgtggttataatagtaagtattgttttttaagtaaactgcaacattacattgtcagtttatcctaaagaacaataacataagcatactattttgctagactaattattagtgtgacaatagtaaatatatatttataggcttcctgctttggtcttatagaataatcttatagttgatcaaaaaattagatggaaaactgttttcagtatgagatgttgggccatccttgttttatgaccttcaagaaagaaaagaaacttccaatggaattacaccatctgtaaagatactaagcttgcccaaagaacacagatagcaaatttgagagctttgataagagttcaaaattgaataaaattgagtcaataattatttattgaaatgtagtggtagtcaaggcattactagattttgcttgcaaactgttgtaagaaaagataagtttacagacaatggcaaaataaatctgacagtaagataaatgctttaagagagatacaggttgtgaataagattttcaaggaaagtgcttacatctctggagtaagtgcgtaaggtttccgagagagtgcgacatctgaaagaaggtgaaccctgtggaatacttagaatttctataatctgaaatgggaatctgtacttttaaaatgagagattatgtcacataggcattgagattgcaaggctgagtaatttagtttgaagcattggatatagtataatagtagacaataaagctagagagatattagcatcataatgagtccaaggctgggaattttgttacttaataaacatgaaaaaccattgaaggttactgacaaagtagcactgtcatgtgatcaaagtaagagttatgtgacaatatctagtatggattgagtgaaagtttaggaggagaggcagccagtactgaggcatttgagaaataaaaataaaatcccaagctccctactgactgaacagatccctcacttggacaaggggaccccagagaaaccttaaaagctaaattccctggcctggtgtggtgactcactcctgcaatcccagcactttgggatgctaaggtgggaggactgcttgaagccaggagttcaagacaaaactgggcaacattgtgagatcttgtcttttcaaaaactaaaaaattaaccaggcatggtggtgcatacctgtagtcccagctacttgggagactgaggaaggaagatcacttgagtccaggaggtcaaggctgcactgagctttgatcaaactactgcactccagcctggttgacagagcaagaccctgtctcaaaaacaaaacacgaaaataaacgagttcccagccatgaggggatgcgggatcagacacatctcattatacctactcctttgctaaccatcattagccttccctaagggttaaagagaaactagccattttgaaaaacttgctccactgctgatatcaaccatataaaccattgctgccctcccttctgtagttttgacagggcaacccaccagcattccttcctgattagagaccaccaaccacagaatggttctggccattctacggagactgagcacagagggcttttatgtcctctgctttaccttttgatttataaggcctaattgtaatacattcaaatgttaaatcttcaccctagagtgaacatggtgttgcagtctcaccagtgcaccacagtgtagcagtctctcattgtgaggtatcacccagaattctttgtctcacaatcaagagaattaaggagcgtggacacaaagagtgaggttggagtgaaagtttaataagcacaagaagaaagctctctgacagggagagagggcccagaagagggttaccatttgtacagttgaatacaaagacttttataagaaaacattgagggctgggtgtctcatttgcataaggcatgaatttctggtagctccagctcatcctcctaatgtgcatacaggctttagcttgacttactccatatttctttgttccccttactgcacatgtgtcaggggatggaattttccattgcaagcctgactgggcaagtcacttgtgtagcctttcttatcagtggggctgtgggcatgtcttaggcaagccatcctgtgcagttcccttacctgtgcctgcaggctgttcttttgtttgaaaggattcaactgaggacccaccctccctgcccgcctgcctgaccagcttcttcctttctcttctctcaatgggacacatgtttcatacacattggcctactgtgcatacccatgccattacttcatgaatattcatagctcctcctataacccattgaatatttatacttagccaaactgctcagcataaatttctgttccctttacccctccctccaattgcatgtttctggcttctggccagagattatgcttcctagcctgttggtatggccacccttcagactacaacccttaatgagaaataagctctccttttcaaagttattaacctcatcattcttcaatggacacattatagcagtttaagaagccatgctttagagagattgcaaaggagaacaattttataggccttacttaacttctgtaggcctatgtcatcatctcttaaacctcactgagttactgtgttaggctgttcttacattactataaagaaatacgtgagactgggtaatttataaataagagatttaattggctcatggttttatagggaggcatcaggaagcttactgttatgtcaaaaggcaaagcaagagcaggcatgtcacatggcaaaagcaggagcaagcaaaggagttggtggtggggaggggggtgccatacactgttaaaccaccagatcgcctttgaactcagagtgagagctcacttatcaccaaagggatggcccaagccattcatgagggatctgaccccatgattcaaacacctcctaccagacctcacctccagcactggagattacaattcaatatgagatttgggcagggacaaatatccaaactatcagttactatgtgcagcaaatgaactatacatgtaaaacacatgacataatgtgggaaacatagtaatgctgaagaaatattagccatctggtgatgatggtgatgattatgccattgttgctgctgctgctgccagactccccagattatcttaccacatccattttcttttgcaaacaccatttccctacctgccttttaagttgtggtgtttcttggaattctgttttcaacctgaactttgatatttttctgcatgtcttcctttgataattctatccacttttatgaccttaaccaccaccagtaggctggtaactctcaaatcttgtttccagtctaagaacacctcctgagcaccagatccatgtttctaactggctattagtatctctacaagaacaatcctacaggcaagcagatcccattctccttccttgcaaacttgcttctgtgcttcttttcttatctccataaattcattaccagccacagtcagctaagccagaaaccttgaagtgtgtctttgcttttgcctttccccaacccattatagtcaatcaagtccttcaagataccttctcaccatctcgtaaatattcctttctgtccatttccagttcccctaccttaattgagattttcatcacttcccgactgttttataccataacctcctaattagtctccataccttcagaattacttcactgcaattctgtaaccacactgctgcctgagtaatctttttaaaatgtaaatctagtcatattatgcccctgcttaacactgttctgtggcttccaatgtctcctgagtagttaaaactcctcagacaacactttacatggtcttgcccctttctgtctatgtagcagaatttactgaatctttgttttatttatttatttatttattgagacagtctcgctctgtcacccaggctggagtgcagtgatattatcatagcttgctacagcctctacctcctagactcaagtgatcctcctgcctcagcctgccaagtagctgggactacaagtgcgtgccgccacacctggcccatgttttaaatttttgtagcgatagggtctctctatgttgcccaggctggtctcaaactcctgagttcgagggatcctcctgtctcagccttccaaagtgctgggattacagatgtgagccatggcacccaggcttgaatctttgtttataatgtcagttttattatcattcagggatggtgaggccaatgcatcagatgattgccattgaaaagatagctacaatccccaagaggacagtgcacactgcacatgcagggccacacagggaaacatgagggtgggtcagaaaacagaagaatagggggaaatatgggcaagagcttctattgtgatttccttgggaaggaatgggtgaggaagggctaacaagttcaggattggctagtttgaataatttcagtggactgtagggtgtacagggctgttctaagttgtctgaccctgtccctgaggaaattagggcaggggaatattgatccagattgtaagagcctgatagaggaggttggagtggatggggtctgacctggttggtttgcatatgaaaggcaatctcacaggggagccctttattatctctagaagatggctggccttgggagggacagtctcctcagggtcaataaggccccagatgttaaaacatcagaataaaaagatgtgcttaacacagtctcttaccgtcactggctatgctccaagcaattctaaatgacttgaatttccaaccactcaaggctaaattcctctaccctcttcctggagggaagatatcttcttggaaataattgcttatctcttaatttaatgatattcttggtaaagccctcccggatgtttccaacagaataactccctgccatgtttattgagtattgcttatcacgttatatagtgatatataaaataagaattcttattttacaccttttcccccacccccaccagtccacaccataagccccttgaagaatgggaccgtcatactcattttttactttctggagtttgtaacctagcagggtgcttggtgtgtagttgactttcagtatatatttgttgactgagatgaaaaataactaatgaataggtgaatgaattaataatgaattaataagttctatatcagtcatacctgtggaaaactcatcatcattgaatttcctttatttcctaaaacctgaagagttaggccaaagtctttcagttttatcatttgcactaagttgtcatcaaactaaatgatttatgcttctccttccaactctaaaattctgaattttggctgagtaaacttttagtacttttggtgaattataccttttccttttacctttatatggcttagagttataatgtgcagttttgaaagttgcagctctgggaaatgtggtacatgatttttatttttgtagacaataggaaccaacaagtatagcaaagtggttaagaccctgggtgctgttgggcatggtgaaatacactttagactcagctacttgggaggctgaggcgggaggatcacttgagcccaggagtttgagaccagcttgggcaacatagtgaggctccatctcaatttaaaaataataataataataataataataataataataataataataaagaccctgggttctgttatctatctaagttcaaatcctacctccaccactcagtagctttgctcttggcaagtgtggtatcctttgaaaactttagtttcttcatttgtaaaattgtaataataatgatatctacctcatggaattattattgtgaagaataagtgagataatttatgtaaactttctagaacatagtgaatacttaataagtgttagctaacattattgtcactcttgtaatagaggttattataattatcactatttaatgatactctgcactcttaaacagtatgatactggccaaggtttcaaggttcagtggccttatttgtgataaatgaaaaatagacataatatgatgtagacacatgtagctttaagtacgtttaagtattattattattattagtcacattttatgaaatcgaaatacaagtcaatgtaagaacatcttttttgttttataattacctaggtggcctgtctggtaatttaattctttcagagaagtctttttaaaaaggaaaataagaaaatctttgtgtaaaaattgagcaaggtctatacatgtgatttttaacagctttattgaggtgtaattcacataccaatatgattcacttgtttaaaaacatatagctcagtggtttccatcaccacaattttagaatattttcatcacttcaaaaacaagccctataccttttggctatcatttgcctacttcccacctcaccctcagccctaggcaatcactaatctactttctatctctatagattttcctgttctggacatttcatatgaatgagatcatataatatgtggtctttcatgactggcctttttcatgtagcataatatttttaaggttcatccacattgtatcatgcattcagtactttattcctttttatggctaaatcataatccattgtatggatataccagattttgtttattctttcatcaaatgatagacgtttgggttgtttctatcttttggctattatgactgatgctgctgtaaacactgtgtacaagtttttgtgggaatatatgttttcagttatcttgagtatattcttagtagtagtattgctgagttatatggtaactgtgtttaatcatttgaaaaactagtagagttttttccaaaatggctgcaccatttaccattttacattaccactagcagtatttgagggttctcacttctccatattctcacgagtatatgttagtatgactttttaattctagccatctcagtgggtgtgaagtgatgtctgattgtggttttaatttgcatttccctattgactagtgatatcgagtatctttttatgtgcttattggccatttgtatatcttccatggagaaatacctattcagttctttgcctatttttaaattaagtcatttttattattgacttgtaagagttatatgttatcaataaaagtcccttatcagagatataatttgcaaatattttctcccattctgtgggctgtctgttacttttcttgttggtgtcctttgaagcaggaagttttttaacttagattaagtctaatttatctattttttgcttttattgcttatacttttggtgtcatatctgagaatcctttgtcaaagccagcatcataaaggttttactcctatgttgtcttctaagagttctaaaattgtaggtcttgcttttaggccttttattcattttgagtgaatttttgtatatggtgtgaggtaaggattgaacttcatttttttgcacattgctatccagctgttgaaacattatttgttgaaaagattattatttcccccattggttggccttggcaactttgttgaaaatcagttgaaagtggatgtatatatttatttctgagctctcaattctattccattaatccatatgtctatctttgtgccatgtgtacatttgatctttaggtattttcttgttttgtcttatttttctcctagagaatgttgacatctaagaatacacacacacacacagagtagtttttaattaatacacagtttttagtcatgattatagagctaactagacatcagaaatgaatcatccagaattacacacttaaatatgaatatgaatagaaatttcataaataaatttcataaacctgaaatttttctaaataaaatctaaaagcatagtttttattttgacaagtattatatttttccaaaaatctttttcaatttataaagcagttaaatatagaacatttcattttggtcctaaggctaatatggtgaaatataggtactcttatttacttatattattgtaactccattttatctatgaaaaaacagaatcatgaaaacatgaagtgatctgtccaggtcactcactcagcttaagacaaatctgcacaaatttcctaaccccgttctgtactctggctactctatcaggctacctctatactgttagattaggaatcagcatcttattatataaaatattttctctaattataacaagtatatcaaaggcttttatatacaagaggactgcatcctgggatcttgaatctccagttttcataccattctagcaaataacttgctgcgtagccgtatgctcagtcgtcagtagagaatgacagagcctcatgttatgtgagcagcttggtaggatgcactcactagctgagtgatttgctcccactcaccagcctctgcagtattacaaattagtgcacatcacatacttttagaatttctcttaagtagttgaagttgcaaatattaaatctctaaatttcaagcctttattaattgtgaaagtatcctaatgattttctacactgtggttcttttctaaaactaattcttacttaccgcttttatttattcaaccatgtatcaagtgctttttatgtgtcagacaatgccaagcatgcggatactgcagtaatggcacaaaaaaatcccttttctcacaaagtttttgttctaatagaaagacagacaacaaatgagtaaaataagtactgtgagaataaggaagcaatatgagagatggggagtgctttgagaaggaagcctgtctgaagattgataaccttgaacatggcattaatgagtgctgctgctacatggtcaaaagaaatggttgcgctttaaacaaatactgttctgtgataggccaaagagaagttaagaatagcatgaagaatagaatatagttgtaagaatatttcaagataagattcttccagcaaatttagctttcttatgcctttggataacagtaacaacaatgaaacaccatccatatatcatccacaatttattcgcagaaatccaaattggtacttagttacctcagttatttgtgcttagtagtatttgtgcttgaatatctcattctcaaagagatcaaagcctaccttttcccacccacatttatagttgtaacagcctaacactcaattacttatcctactatatttggttttactttcttctgtaacaagtaagtattagctttaaacatactataccatttactattgaacacacttattttttgtttcctttcactagcatgcaagctcttggaaggaaaggatttttggtttttcactgatatattcagaaaagtgtctggtacatagtaagaactcagtatatatttttgagagaatgagtgttagtaaaagatgaattaaatgtccattctgtattgtttaaatacacatctcatgaactatttgttatgactgctatatccagttaatgacccagaaacttgataacgatttgctctaatcctcagttcccttcaaggtaaactttctgatgttcatcttatagttggagaaatgaggctcaaagaacctaattttaaaacctttttaaaaaagtatcttttgaccagacatagtggctcatgcctataatcccagtactttggaaggctgagatgggaggatcacttgaggccaggaattcaaaaccagctgggaaaaataaatataaaaataaataaataagtagataaataaataagccaggtgtggtggcacatgcctgtagtcccagcgactcaggaagctgaggtgggaggatcccttgagctcaggagtttgaggctgcagtgagctatgattgtgcctgggtgacagagcaagattgttgtctctaaaataaaattaaagaattttaaaagtatctttttattgtttccaaaagacatattcttattaaaaagccagcatcttaactctgttctacctggttccatcttgaattgtttgtgttttaaaatgtcaagaatatatttccaaattataattgcatataatgcaaaaaactgttttgaatgcccttaaagcatttaagaatataattctgctgctgagttagtctctggtctgttctccatgatttctgtctgtgataatagtactaatatatatgttgtagatgagagtggtaacagtctaaacaccaacctcaaaagattagttgtataatattccaattaacttcagtaaccaatcatgaaactgtcacccatggaattttaactctttgaggatatttgcctaagtatccttttgggttaggtactttttctgactctgcccctaacattttgaatttagttttgactttgcctgcttctctggccttagcatcttctattacagctaagaattgtcaaaagacaaaattacaacaaatttagtttaaagatcttaattgacttttatttgtgatactagaattgggcaacacctcattctgtaaaatagaatgagtgccccaataagctgagcagttggttttatagtcacaaaaggactgaggaaagcagaaacagaaaacaaaaagtgggttggttatttcaaaattaatttccttgtaaaggttaaagcagagaggattttcttatcatgccagctaaaacttgaagattttgctattatctctcactctcctgatctctcagaaagtcagataaactgagttttggcttggtaacatggaactttaccatctgtgactccattttggtttggtgtgttgggccttttgcaggaaggagttcagtccagaccagtgggctcctatcaatattatttaaacagaactatgtcgccctgtctacttccaaacccaccttcttgtcccttgccttccattccatgtgtgccaccttagcccccatagggattgagaaattttgatagctgtcttcttccatagtgtactttttctttttttaatctctatgtttttatttcattttggaattcaactggtttttgtttccccattccttaactcattttcatttccctactccttgtatcagtcttttttgcctcgctatttttcagtatgtttatctgaatgattctcataaaaagtgcctttcagttccttcattttttcttttttctttttaaaactattcttccctagtgatttttttttaactgctctttggctgcattcactatttttctttttttttaacaagtgatactgttttctttaagatctcagcttaacattttacctcttttatttctttccactctctttttattcttagaataaatatgttcgttgttctgaatatctttaaaaataaccctattccaatcagacatgtccctatcacagtcagaaggaggggctcaagtttccctaaaaagtgcacattaggaatggagcatagccaccagctggagctgctagcatttcaaaatctcaggaggctgcagcaacatgtgccaggccttatctctgtaatacacatgtgctgcttgtcagtttcaaatgttaaccctcagcagcattacttaaagtcagtaggctttgtgttgtgatggaaggaaaatatttttaaatcttcttgagaccctgggaaactaccgcttttggacatgaaagagcctgccaccttacaaatccatcaataagtaaaagccactgacaccagtgccatgtttcagttcagttaagttggcatgaatagtactgagccatggtgttctcaggatgtagttactaaggcgttttatttatatcccagtgaaacaatcctaccacttgcaaggacaaaaagagagactttgggggcccttaaatgtaatcagcagacatgtgccaccctttcacctttgtatgttgatttttgtttagtgacactgtagcaaaacaataaccattagctccatatagtaagtatgtacaagcatgatctttattattattattatttgtggagatggggtctcactgtattgcccaggctggtctcaaactcctggccttaagtgatcctcctgcctcagctcccaaaatgttgggattacaggtatgaactactgcacctggccaagcatgatctttttaaaagcacttaattgaaatataatgaaaatattaactcacggtatatatatttcaggaattgactattcatattataaaataattctatattttccaaaagaattcctttcaggagtgcttcaaaaaggagttttcctgcattctaaataaatcctaaatttaatatatttgtttaaaaaatgaaatacacacagtttggggaaaacagcctggccttattcacagaaggctgtatatttgtacatcatgcatactgttttcaagttaccataactaagttgttcagaccaaatagtttttctccacacaataaccataccaagagctctaggtatataaaatttacagaactgttacagagtaaacttatgcaaaggagggttgagtattaccatactcccttttttcttattttccaagtaaagtactcctcggtatttgagggagattggttccaggacccctcagatatcaaaatctgagatgctcaagtccctgatataaaatagtgtagtaattgcatatgatctatgcacatcttcctttatcatctctagtttacttatacctaatacaatgtaaatgctatgtaaattttgttatactatattgttcagggaataataagaaaaaaagtttgtatatgttctgtataggtgcaattttttttcaaaatattttttgatcccagattgtttgtgttcacggatacagaatctgcggatacagagggccagctatactgtctttcctttaagatgtctccagctgccccaatcttgagtgacctttgccttccttcaaactcctatgccgttaattgtctacacctctcacctggcagttgtcatatgcttcttgtatagtttatcttttatgtatatttacttcctagtctaggaactaactagagaagtctctttacacctttttggtatctccaatacttgaaaaatgctcttaaaacagtgcttctcaaacatccatgtactgtgcatagaaaacacctggggatcttgttgaattgaaaattgtgattcagctggtctggggtggggcctgagattctacatttatgacagactcccatgtgatgtgatgcagctggaccacagaccacattctgagtgaccagtgtctgtcaaaccttcagcaaatgtttattgatgatgccattttttttttcagaaaaaggataagagatttaaatttgttaagtgctgcatttttatgtaatatgcaaatagcactaagactgaactgagatattgattgaaaaaatacgctgaatgattgaagatgttagatatctttttttctgatttctccatctgatcaataggaatggactttagcttatccattttcattaataccagactggatgagattatacgtgaataacttctacttctgtcttcactagattcaggctgaaaagcaaaagtctttataacacatttctagtcacgtaaataatacaaactttttctaacttttctcttatttgggacacctagctttgaggagcagatggttttcccagtaaactcttagattctataggtatcacatttcagggtcaagaattacgcatatcctcagtataaactctgtaaagactttttttctcttgtttgatggaactcaaaaatggagcaataatagttatcaacaagcaatgagtctgagtcctcaggctttaatggcaaccaacaaccccatgctccttattgcagaggaagagtgcattgttgattcgctttatatccccaaatagaaaacacgttaagggtaatcctgggaaattatgcttacttcaaaccttgattgccaacactgaagtgtctaaatagcacttcaccatttttctggttgttttcttagaaacagttcacttgcggccgggcgcggtggctcacgcctgtaatcccagcactttgggaggccgaggcgggtggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaggaaacagttcacttgcttccttcctgtgataaatgccatatttattttagtatgagtcaacctacactttttttatattgcctctctccccagacccccaaatctccaatttctcacaagtgaatttaggcaaactaaagaagacatctctgttccgtgagtattaaaatcaaacatttttaaatgtaagttataaaaataacactttcattgttttcttcctaattactaaagtagtccatgtttattacccctattccacctccaaaaaaaaaagaagaaaaattatggaaaagagtcaagacctaatagactaaaaattttaaaactattcttgtttgcctacttctcagaaataaacactgtaaaataaacattttgacctgacctcaaaccattgtctttttatatatatattataaaaataaaattaagattatataatcattactactttgtaacatcctttttaaattaaaaaatatattgtggtcttctctaatatcattaaatatatttccataacatggttgttaacagctgcatagtgttccagcatatggattaactaaccattcccctactgttgatttttttctaatttttatataagaggatgttgcagagaccagacttatacataaatgtttgtacaagtttttaccttggaactaatttctagaggtaaaattgctaggtcagaggataaaagatgttcatttataatttgtttcatcttgccctttctaaaacgacagaagtagtttaatagaactttgacttatattatttcatagtttcttttgaaaattattttctctcaatagcaaaacttttgttggctcctgacgtacattaatatacaaaagagctacttaatatttggaacacgaattaacctgaggagttcataaacagtaggcattgcaatgaacagcatttatcaacttgacttaccagcttacactgccatagttctgttatagtcatgtcacatttgagacattagttgtacaaacagtacatgaagcaactcacatgaattttaattgagaatgaatatttgccaaaacagtaatttgtctttttaagtctttgtttcatatgcagagaattttatttgttaagcatactgtactcagagtcaggccaatcagaaataatataagaaaagaaaaactggttaactctttctatctatattagtctaaggagtaccagggctaacaaatcttgatagtatgctaatttgttgtgtttcaaaacttgctctttatcctgttgcgaaagctgaattcaatagaaaaatgattatatttttaaaataaatgaattacatgagcccacagcactgattttaaagtaggacttgcattgatacagtttattgaataaagcaaaaatttttacaagtattttataagtttaaatagcaaattgaaattgtgcgaaaatagtgattttgtgattattaaacattcattgttttaagagtgcatgtaacaaaaagtatctgtagttacctaacactataatagttaaaatacctgttaatatgtataagttaactctacatttttgtaaaagtttacaacattgtcattgttgtgttcatttatttattttaaacttccttttttagtaaaaatgtaaggccatttataaaatttatgcaatataataaaataaagtgaatgaggaaatcaagacagagagcaaatgaggctctaaacaataaaatgcatgccatgaaatcctgtacttttgttatgggtagccacattattactcagcttttagacttccacccaatcaaattatatgactgacagtgtccatgacaagcaaattagttgctcacaaaaagcccaacttttcctgatacctaatagaaaattccctcatggatctcaaatgaagacactatgtgatccagcattcactgtcctcaataactaccagtttcttagaatattccttttaagatgcttatggtatcacctcagtgtgtaacaattatatgagaagtcaaaatgatctgatcccacagctggtgcaatataggaatagagttttaaaggaaaagatgtgtttgttgtgttcccttaagcaatcttctatacctgttctttaagtcaaggttttgattaataccgaatgacaataggttcagagttaaactttctgaaaaatagctggaatgtggttattgtatgtccacatgcaagtgcagagcagtgtgcttcacctcttagccaagccaggtgtgctctttgtggagattcagaatagcatggacattcaattgaatggatggatacccctaatgagggagtacccaggcaggacctgaactcattcccaataatttgttgcatagacgtgattgaacaatcaagtttccaaagctctgtagtatagatcatgattgtacagctttagcctgaaatttataaaataagcaggtgtgatcagttgcttgccctatgccatgaaataaaacacccacacattcaaacaaagcaaaacaaaaaccatcaataaaatacttatagacatttgtctttgaagctgttattttctgatgtactctccaagatgaacttcgtacaaaatataccttaagggcagccagagagaaaggtcgggttaccaacaaagggaagcctgtcaaactaacagcagatctctctgcagaaaccctacaagccagaagagagtaggggccaatattcaacattcttaaagaaaagagttttcaacccaggatttcatatccagccaaactaagcttcataagcgaaggagaaataaaatccttttcagacaagcaaatgctgagagattttgtcaccaccaggcctaccttacaagagctcctgaagaaagcactaaatatggaaaggaaaaaccagtaccagccactgcaaaaacataccaaattttaaagaccactgacactatgaaaaagctgcatcaactaacgggtaaaaaccccagctagctaatgacaggatcaaattcacacataacaatattaaccttaaatgtaaatgggctaaatgccccaattaaaagacatagactggcaaattggataaagagtcaagacccatcagtgtgctgtattcaggagacccatctcacatgcaaagacacacatagtctcaaaataaagggatggaggaatatttactaagcaaatggaaagaaaaaaataaaaaagcagggttcgcaatcctagtctctgataaaacagactttaaaccaacaaagatcaaaaaagacaaagaagggcattacataatgataaagagatcagtgcagcaagaagagctaactatcctaaatatatatgcacccaatacaggagcaccaagattcataaagcaagttcttagagacctacaaagagacttagactcccacacaataatagtgggagactttaacactctactctcaatattagacagatcaacgagacagaaaattaacaaggatattcaggacttgaactcaactctggaccaagcagacccaatagacatctacagaactctccacccgaaatcattcttctcagcacccacatcgcacttattctaaaattgaccacataattatacataaaacactcctcagcaaatgcagaagaacgaaaatcataacagtctctcagaccacagtgccatcaaattagaactcaggattaagaaactcactcaaaactgcacaactacatggaaactgaacaacctgctcctgaatgactactgggtaaataacaaaattaaggcagaaataaataagataaataagttctttgaaaccaatgagaacaaagacacagcataccaaaatctcttcaacacagctaaaacagtgtttagagggaaattgatagcactaaatgcccacatcagaaagctggaaagatctaaaattgacaccctaacatcacaattaaaaaaaccagagaagcaagagcaaacaaaagctagcagaagacaagaaataactaagatcagagcagaactgaaagagatagagacacgaaaaacccttcaaaaaatcagtgaatccaggagctggtttttggaaagattaacaaaatagactgctagccagactaataaagaaaaaaagaagattcaaatagacacaataaaaaatgataaaggggatatcacctactaatcccacagaaatacaaactaccatcagagaatactgtaaacatctctactcaaataaactagaaaatctagaggaaatggataaattcctggacacatacaccctcccaagactaaaccagaaagaagttgaatccctgaatagaccaataacaagttctgaaatttaggtttttaaatgaatcttaagtatgaaatatattgtacatagtcaaacccctcagagcaatagagcattcaaatccttagcctgtgtgttcctatgaagcctgtccaaataagttgcaaaatagtgtctagagcctgcaatcctgtccgtggtgctattttgttatttgtgtgagtctcaggtttcaattctcaacctaatgaagtaccatttaaaagcaacaattagagaagcagccacatctcttcccttttgcagtagaaatactctaattttattacaattccccaatgtaaattctggttggtcttcctgtattgcctagagttcatctttacccattttgcaattcaatctgtttggtgcatttctacttatatatttttaaaaatatgtgtattttataaatactggtgtatagtttttgaatgctcagaagattgaaaggcctagagaagattcagtccaatgcaaacatcatatattaagtacttccttgtgtcagaggtactgaatgctgtaagggatactaagatgagtaagacacaatctctaattctaatgtatttatcaactctaggaagagacattcacaactaagtttttgcatgctaagtaaatattaattgaacaattcgacacctattatgtacttggcactgttcttggcatctggatatagcagggaataatacagttctgatctgtgctcttacagagggacagacaacataaaattttagttacaatataaatcactgtgctaaaataccctttgtagcacagaggtttattaactctagctatggattgagaaatgcttcatggaagtgacaatttttctagagtcttagagtttcattgaccagaaaagaagaggaaaaacaagctaagggaaagcacagcataaacacataatggcaagatgtgaaagtattaataagcttcaccccattctgtttgacagggattttgagtatcacagagaaaatacacaggactcaatggaagttttgtaaagaggtttactgttatgacaaatatgtatgttctcttttttatcctgggtcaaatttcatctgcctttttcacttctaaatattttctaaagcataaatcatgtagaagtgtatgaaggaatgatgaggctgaaagagtagctcaagcaagatgaaaaagttccttgaattgtcgtgtcttattttggacttattaattgttggacttacaaacagtggaggcccatcagaggtgtttgagtcaggaagaaattgtatcatgctgactctcaattgcattttgctgaactaaagtagtagctttagttcagaatggaaagaagttcacagaaccaagaggatcctgtgaaacgttgcatgggtaccctagagttccctcttttgtgctccccttatagcactttgcatatatctctagtagagctcttgttacactgtgagtgcttttagagtgttgtgttgaagtcagcttgcaccagcttgcaagatctaattgttagtatcactttccaattctatgctctgccttggtaggaatatttacaccatgaaaatgagcaaacaatacaaatctgttttttattgttgttttttgaaaactgttaaacagttactagcacatcaccgactgtttattaacatgtctgacttcttataagactgtgaccatttagaataaaaataccatcttatttttatttccttatttctagcccagtacctcacaaattataggtatcaataaatatttattgaatatgtagagggacagattaacaaatgagatcaacaaattaggtaatgaccaattgattttgggaatggatgaaatggttggaaatagccctatattatgtagcctgaacatttggtaatagtgatactactagaaactgaagaagaaaaactgagttgagagggagaggcagagggagggatcataggggaagataattgttttgatttgggacatgttgtgtttgaggtactgtcaaaagaccaggattagagatgcccagcattcactccagttactatcaaatgacagttttgaaattacttttcctgtgactttctaaaatacttaactatacagactagttgaagttcaaagttatttatttttttaaaagattgcttcatttcaatagtacaagagaaaattgcatttttataatacattctgaacactacgtttgcagggaaaagcagagatcagatagcctagaagagaatgactgaggaaatggaattttgtttttttttttaaaaacaatgtaagtgtgtttcaagatcatagtcacagtttacaattctattaggaagagaaaaatgaattttgggggaggataaagttaaagttaccttttagaatataactcctaataaaaagtttttcttttcaaaaaagctattataatgtgaccatgagaaaaaaaaatctttttacaataaagtattagggaagtaaaaacaatatactttcagaaggcaataactttacattacctaagaaatggcatattctgatttagtaaatgttctcattaataggataatacagtataatctgtacacatagggcttttcttttttttttctttttttctgagatggagtctcgctctgtcgcctaggctggagcacagtggcgtgatctcggctcactgcaagttctacctcccgggttcacgccattctcctgcctcagcctcccaagtagctgggactacaggcgcctgccaccatgcccagctaatttttttgtattttcagtagagatggggtttcaccatgttagccaggatggtctcaatctcctgacctcgtgatccgcccgcctcagcctcccaaagtgctgggattacaggcgtgagccactgtgcccggccagggcttttcttaagaaatatgtaaccaagaaaatatacttgacttgcaactatagtgaacagagtttattcttttctttataaatgggagtcttgcctcaagatcatatataaagatgtgagttattgcttatagaggtgtatatatttaaaatatataatagtaataaacaagtctaacataagatgaaagattatttattatatgtgatctctcatgtttagagtgaattggtcttttctatgctatggatattcaccagaagattaagtagttctttggggaatagtcttaatatctcaactggaaaagtcatttatgagcatgcacttataaacttaatgctattctagtggattagtccaattccacatatttgtcacatggcattttatatctgtgatgaaacagtaatattatcctcaatcaaagtcacagagcaagttactttcagagctatggattagagcttagagttctcatttccattctcaggcaggtgtgtcctagtttgagaaaatgtgatacacaaaaccaccacctcacaaaatagataaatggtggttacttagatttcaaaaggatgttcttcggggttccttaaaataggcacttctgaaggatctaatatagcctaaggagcccagactattggtaaccaagaggcctagtttctctaccctatcattaacaaagttaatggggtatataaatttgagcatgttagtcattccattcatccattcacttatccactaaatcattaatattttattcaatgaatctttcatgaggattctgtgtgttggatataaaaaggttgtagtccttgtttttaaggagttaagacagaagggtaaacaaacagtacatttttaatggtagaggtaatgcagcctgttagcagaccactaaaacctaaacaagatgtgaaggtgaactgtgatagtaggagtagacttggaaagtaaggaaagaatgctatgctaaagaaatagaatctgtgtgacttggtaacaaattagatggggggcccaaaagggagagagaggagtcttaggatgactcccaagctgttggcctaggtaacttggtgtaagagtggtgccatttatgacgagagggaatttaggaagagggggagttttgggaggaagacaatgaggttagttttgtgcaagctgagtataagagccctgtgggggccaggcacattatagctcatgcctgtaatcccagcactttgggaggccaaggcaggagatctctgaggccaggacttcaagactagcctggttaatacagcaagactttatctctacagagttgttttttttttttttttttttaaattagctagttgtggtggcatgcacctgtagtccgagctactctggaagctgaggcaggaaggtcacttgagcccaggagttcaaggctgcagtgagcattaggcagttgtatagtccagcctgcaactcagaaaagagaactgggcagtagttaaagagtcgtctaaagatatatgatagtagtgaatgaaattgcccagggagagccagaagataagaggagaatatggagtggaccctaggcagtaggaaggtggaaataaaggagcctgagaggaacagtcaggaggagatcctggactgtggtatcatgtgggctgagtaaatggagggcttcaggaataatggaatggtccagagtaataaatgctgaagacaagtcacaaattgagagaatctatgggcaattaggagaatatcagtgtcctttgccaaagcggtttagatagtgttgtgaggcaaaaggctgaagagtaaatgaaagtggagcttattaagacttctaaaaaggaggggaagaggtaggacagtaattaaaattgtctatttgttaagtgatgggagagacatgagcattttgataggatgcataaaataaacttgaaaagagaaaggttgaaaacacaggcgaaaggtaattataatgaaggaagtttcctgacctagagttgcaaagagatgggagggttaattatcaaaagaagaagaaatggcactttctttggcactgaatggaaagggggaagggaaggataatgtgtgtgtatatatgtgtgtgtgtgtgtgtgtgtttgtgtgtgtgtaggaatttgagggagctgaatctcttgatatcagtcttaatttttttttctgtgaagcaggaaacaaaattgctgagagaaaacatgtaattgaggatggagccttgaggataatgacgaacattggcaatgccagctgtggaggaaaagtgggcaacagacatgataaattatagataggtaggtagatagatgatagatagatagatagatagatagatagatagatagatagataggattatagcctaggatggcagcatgagaaatatggttagattgactgccctcaagcttatgttcaaggtttccattagcatgagagaggttaatactgcagatattattagtcttggctcagcccttaatgtagaatgttgctcagaagttaaacctcggtcctgggagagagctactattctctaggtctctactgtccaatatgatggccattagccacatatagctctccagcacctgaaacatggctggttctaactgagatgtattatacacaaaatacacacccaggacttgaaaatttagcataaattaagaatgtaaaaaagctcattaataatttttattaattacctactgaaatagtattttgaatatatagggttaaataaattattttgttaaaattaatttcacttcttattaatgtggccactagacaattttaaattacataggtggctcacattacatttctttttgacaacattgctattggtaattataggagaagattagatggtttcaaaaaatgctcaccttggtctggaatcttagctgcttactgcaactttaaagggaatcatagaagacatgcggcagtttaggaaattaacctttaaagagagtttgccccaagtggttggatctttggatatactctttcttcattgctggataggaggtctgagactgtccgtagaaccaagttacccatatctgtaaaaggcaaaaactgtctgcctcgtcagcaattgtgctgacaaggggatttgtgggattcctgtgaaatagtacatgcttttaaaaacacaagtactatataagtgcctcattgttagctatgagtttatttataatactatgaagacaatgattatatctactaaatgcctccagtttggccagacaccattagacattttatgggcattatcttaattaattcagccagataacgctgaagctaggcctttaaaggcaccaaaatctttctactaactgctgagactaatgttgctactctaggacaaataaacctaaattttataaaatctctgtgttattttataaattggatatacctgtactaagatcagtttattagacccattgtttctttctttgactgacatgccttttttttttttccaacttttattttaagttcaggggtaaatgttcatgttacatgggtaaatgtgttccgtggtggtttgctgcacagatcatcccaccacccaggtattaaatccagcatccactagctattcttcctgatcttctccctcctcccacccctggtcctctgacaggccccagtgtgtgttgctcccctcctcccctccatgtgtccctgtgttttcatcatttagctctcacttataaatgagaacatgcgggtatttggttttctattcctgcgttagtttgctaaggataatggcctccagctccatccatgtttctgcaatggacatgatcttgttcctttttatggctgcatagtattccatggtgtatatgtacattttctttatccagtctataattgatgggcatttaggttgattctatgtctttgctattgtgaatagtgttgcaatgaacatacaggtgcatatgtctttataatagaacagtttatattcctttgagtatatacccagtaatgggattgctgggtcaaacggtatttctgcctctaggtctttgaggaatcaccacactgtcttccacaatggttgaactaatttacattcccaccaacagtgtaaaagcattcctatttctctgcaacctcaccagcatctgttgttttttgactttttaataatagccattctgactggtgtgagatggtatcacattgtggttttgatttgcatttctctaatgatcagtgatgctgagctttatttcatatgttttttggccacatgtattagatccattatttctgatggtacttttataacttcactgctatacaagaggttttaggccaggtgcggtggctcatgcctgtaatcccagcaccttgggaggccgaggtgggcagattatctgaagtcaggagtttgagaccagtttggccaacatggtgaaaccccatctctactaaaaatacaaaaattagccgggtgtggtggcacatgcctgtaatcccagctactcaggagactgaggcaggagaattgtttcaacccacgaggtggaggttgcagtgagctgagattgtgccactgcactccagcctgggtgacagagcaagactctgtctcaaaaaaaaaaaaaaaaaagaagaggtttcagctagaagtctaattgattataggtgactttggagggagcaatttcaatagagcagtaaagctgaaaaccagatagcaaaaaggtacttactaagtgggaacagggaaaacagctttctgtagagatgaggaagaaagatggagcctcagaatatcactgagagttcagctcaagaaacagaaaccagcttagggatgttttttaaaggagttcgattcaaggaagtagctatttacgaacttaagtttcttaagtgttgcagggccttaagtcaggagttgccactggagctattgatttcaagagtaccttcccatacctagaatcctgaagttgctgctgcctccactgctactaccatggcagtgacttaggcattgagtctgccacaactcaaacacttgtgtctcctaccttgtctgcctgtagcaacattagcaagaaggtagcttctgctttgtcctgtcttccaaatctcatttaggacttccacatcgcaagaattctagccaaaaatgtgtctggggaatgtagtttttagatttctaatttccatctagaaggaggatagaataaagagttgagagagtcactctgtagaatcgatcacatctgatttctgttgcttattgtaagccatttgtaaggcaattattaagaaagaggagaggctgggcacggtggctcacgcctgtaatcccagcactttgggaggccgaggcgggcagatcctgaggttaggagatcaagaccatcctggctaacacggtgaaacctcgtctctactaaaaatacaaaaaaaaattagccgggtgtggtggcgggcgcctgtagtcccagctgctcaggaggctgaggcaggagaatggtgtgaacctgggaggcggagcttgcagtgagccgctatcacgccactgcactccagcctgggcgacagagctagactctgtctcaaaaaaaacaacaaaaaaagagaattgctgagccaagggaaatactgtgtgttttcatgcttgaggtaggaaagagcttggtgcctttgaaaagttggaaggggttgatgtgactagtttgaaaagttggaaggggttgatgtgactagttcatttcaggtggggttggagagttaagcaggagccagagcatgcaggactataggttatgttgagaagtttttctttaagagacagggtcttgctgtgttggccacgatgatcttgaacacctggcctcaaatgatccttccaccttagcctcccaaagtgctggggttatagggatgagccaccacacccagcccaagaattttgcattttctcttaatgaaagcatcagagattcttcggcaggaaagtggtatgattcaacttatgtttttttaaagcttattctaactgctttttggacaatatgtttactaggagtagaggtatctaggaaaccagatagaccagcaagtataaaatctaaaagcccaatattctaggcaggagaatatggtgctagagtggatatagaagccgactgatacagggtatatattagtagttgtattgacaggatttgccaagaattggatgttagaagtgccaagagtgggtcccagctatttcattattttattcctttgaggaagtttctgagcattgaattgtaggattctttaaaatagtaaagcaagactggatagtaattatgttatagggatggagtagaatgtggaacgattcttttgcggggagatattaagaatgcctctcttgctttcaggtccagggtgttaaaataaaagaatgcctcttaaattttttagtagtaatgtgagtatacattaaaggttaaatgtcttaaaatgtatttagaaaaaaagaaataggaaaatatttaccaaaaaacccaatcctctatgctaatgtttatgttcttaaattttagttgtatatgtgaatctttgtagtttttgctaaaatactaagtaatttatataaaagtgagttaagagatttttctgactcttcttttttagttgagctcatccttctgaagaatgcccaattcttttaaaaaagaaccaagagatcataatttttacttttaaaagtaacacctgtgtcaaataagacttcattttcacttcagccagttcctattgttggctgaaacagcaaacagatcagtaagaggcaatagttacgatgccatgtggtctattgaaacctaatgaaaaagacaggattgaattatctaaatatttcacctgaaataacatttaattgtgaccctcttcaggttctataaatttacattacagctattttttatctaatgaaaagtgagatgtgaagcctgtcagagtccacaagcctgatgttttagtgattcctcatatacaaacaatttatgtattttccagtgccaataagtgtatttactgtgaacctgcaggtggctcactcaatgagattagtattatataaataagtagttgagtttaattttgcaattactctttctaaagcctatgcataggttctagaaggatccttagacttagcagaaagtagcctctgggtctctccctggcttccttttctacttccaattccttccccatctttcattatctcattttagtttgaattcatctgacattgcttatctcccaggaatataaaactgcataactgtattagtacaaagttgcatactactgggaaaagctgtttgatgggtcagttttggtaagatatttttgaagtgccggaggagtcaagagagcacttagcatgtgctgtttagtattacaagacttgttgcagaagaatactagtaatggatagaaatgaaaatatttgctgttttagttatagtggtcccctcactggcatttgatattaagttttattaccctcattgcctgtgaaaggaggacaatgattgtaacattgtttcacagctgttttagggttactaggacttgagctatactagctcctcttttaatgtttatccatatatgtatatcactgctaacatagttatcctgtagtccagagaatatttttttccttgtacttagattttcctggaattagactagtgacctcgtgataaaccaccatatgctactcattacagtcatgcactgcataacaatatttccatcaacacctgactgcatataggatgctgatcccataagattataatggagctgaaaaattgctgttgtgagatagtcacacaatgcattactcacgtgtttgtggtgatgttggcataaataaacctactgtgctgccacttgtattaaagtatactacatacaattatgtatagtacataatacttgataatgataataaatgactatgttactggtttacatatttactatactttttatcgttgttttagagtatactttttctacttattagaaaaaaagttaactgtaaaagagcctgaggcaggtccttcaggaggtattccagaacaaggcattttatcagaggagatgacagctctatgtgtgttattgtccctaaagaccttccagtgggacaagatatggaggtggaagacagtgattttgatgattctgaccctgcataagcctaggctaatgcatgtgtttgtgtcttcctttttaacagaaaggtttcaaaagaaaaaaaacttaaaaaatagaaaaagcttatagaataatgatgtaaagaaagaaaagatttttgtacagctgtacaatgtgtttgtgttttaagctgtgttattacaaaagagtcaaaaaaagttaaaaaatacttagaagtttataaagtgaaatagttacagtaagctaaggttaatttactattgaagaaataaaaatatttttataaatttagtgtagcccaagtgtacagtgttttataaagtctgcagtagtatacagtaatgtcctaggccctcacactcactcaccactcactcacggactcacctagagcaactgctagtcctacaagctccattcatggtaagtgccctctataggtctacatcattttttaccatatttttactgtaccttttctgtttagatatgtgtagatacacaaatatttatcattgtgttatagttgcctacaatattcagtatagcaacatgctatacaagtttatagcctagtagcaaattatatagcctagatgtgtagtaggctatatcatctaggtttgtgtaagtacactctatgatgttcacacaatgaggaaatcacctaatgatgcatttcttagactatatctctgttgttaagcaatgcatgactgtatctgaatatattctacagttgatctttttctgtaattagtaaatttcataaatctttttctagtttaatttgtttcttaaatagaagggcattttcaattcttacatatctcttctgtgttgtggagaactgaaactgagtggctttattatggaagtaagttattctttgtccagacatattttatcaatctgatagacctattcaataaacagtgacattctttacaataacacagccatagaataattaaataaatattcccttctttattttcagtattttgccaatcactattctatatttggtgcatttttttgatatcttagatttagaagtcattctataagtcagaattcttcctcccacagcaggattacctgagcagaatttttagtacttatgatgagctgtaacatagccaagaatttgacttgatgggactcagcatgcaaggttttaggggaggatgaatatgcctggaattttgtggaatttgaaagactgctgaccctccaagtacaaataagtgtcgctctttaatgagtctgattttctcagcataacctgttatttataaatactgcaataactttttaagaattatttatggtattagatgaaattatatgttggtactttgtgttgcttttatgatctcataattgcttctgctccttgaagggaggggaactatgcgtggtagtatggtcttcaccagagtttaagcagcaagaggaatgtaaatctgttagaaaaaattagggacaatccatcaggaaatggaggggggaagtgctgttattatttcactctcacttttagtattttttaatatttttgtattttttagtatttcaatattttttactttataagcatatgtgatattttatactaatcaaaactaaaattaatttatcaataccttttttaaagaggatctaacatgaaagcctagattttaagagcagatatgaagaaaatacctattgttttatatctttaagtttcattgttatcatttacctaaataaaacattttatatcagtaaaaatacttcatgttttctgaggtttattaatggataataataggtcataattagcttatgatctaatctaaacttatacctttattctaaaactatgacgattacaactcttaagagatgttatatatttatttaaagataatataatatttggttagattatctttgatatttgtcaaaacatacctttctgtctctttaagaattgtcttaatctccttaagacagattctattttatccttgtcttacaaataagaacattaaagcaggcacagagaggttaaataatgtggtgtggtcacacaactgttaagtggcagaggcaaaattcaaatccagagagcctttttccacagcccccacccttatttgctactccatcctgacactctgaatagaagtactgtcattttatatcagtcaacaaatatttaccaaacatttactgtgtgttcattagtaagatacagaatataagggaagttttatattgtgttcagggattgaaatctaatgggatcttactaaaataggctcacaaaacaactatataaattgcaagtcaagaaggcctatattggaagtgtaaactactgtaggaacattgaagaagcaaggattactctgattgggaaggcttaatttgcttttatagaggaaacagtgttttcactgggatgtgtaagctttcaaggcaggtgtgagtgaggtagatttaggcaagaatggggaggaccttgaatgccacactggggagtttagacatttggccataggcaattatgagccttcaaagattttttgagcaagtaaataacatgatcgtattggcatttaggtacaaaattatagcagcatgaaaaatgaactaaagatggtttgttgtgttggagaaatagagaatgtcagtaagatgaagtgtcatgaagatggcagaagaccatatgtgcccatcatccccttgcttaccaagtccttacaggaatttacaggagatactgtttcactgtgtgttgttttaaagagtaaatctccagtgatgctggaaaacaaggaagagtacacacatacacaacacacacacacacacacacacgtatgtttttgtttttgtgggtttgttttttttttgtttttttttagttttgttacaggccataaacttcaaaagactcaaagcagataggattgtatcgttgaggaaaaccaacactctaaaacgtgcaggagagaactgctccagaaggggtaggggtactgggtgggctgcacatcagacatatggatgcaaggctgaggaagggcatggggccttaagcagggtggttagttggagggctgcatgaagagcagcagagtaaatcagcgccttcacatttgcttgcttacattgagcagaaggcagttgatacttttagccacagcctaaggcactgaatgtggggcttgagctaaagaggcagagcaatgggaaggcagctaataacactcaggaaaaatggtagcacccccttctgaaaggaaggcaaccagaatacctcatctagcagcatgtccctggcatctatgacaagcaaatagagaactcataaaaaaaaagaaaaaaaaaaaaacagccaggaattaccaaccatttttgttgttgttgttgtttttgagatggaatctcgctctttcacccaggctggagtgcagtggcgtgatctcggctcactgcaacctccgcaccgccgggttcaagccattcttctgcctcagccccccaagtagctgagactacaggtgcgtgccaccatgccctgctaatttttgtatttttagtagaaacagggtttcaccatgttgatcaggctggtctctaactcctgacctcaggtgatccacccgcctcggcctcccaaagtgctgggattacaggcatgatccaccgcgctaggccaacacacatgaacctcttcagatttcaagtgctgtgcatgtagcagacacttatatgaaagtaatcttttaatgaatgtagtgcaagttaaataaaattttctttttttgagacagggtcctactctgtctgacaacccaggctggagtgcagtggtgtcattttggctcactgcagcctcgacctcacaggctcaagccatcctcccacacagcctcccaagtagctgggactacaggcgtgcaccactacacctggctaatttttgtattttttgtagcaacggggtctctctgtgttgccaaggctgctctcaaactcctcccaaagtgccgattataggtatgagcctggccatcaaacaaaatttgatagagaataggttctaataaaacagtttactggaactgagtaatttaaaagtgtttttttccctgaccggaaataagaaaaagaacgttagtactcacttttcacaatttcataaattacatcttatgtcacaaaatgacagcttcccactatataagcagagtaaggcttctgcttgttttctgagatggagtctgatctgtcgtccaggctggagtgcaatgcacagtctcggctcactgcaacctccatctcccaggttcaggtgattctcctgcctgagcctcctaaatatctggtattacaggcacgcaccaccatgcccagctaatttttgtagagacagggtttcaccatgttgagacagggcttcaccatgttagccaggctggtctcgaactcctgaccacaaatgattcactcacctctacctctgaaagtgttgggattacaggtgtgggccaccacgcgcagctgagtaggtttttaatattggatacttacttgctagaaaaattacggagaacagaatgaaagtaataaatatgaaataaaatataaagacatccttattttctactttatcaaaatgtttttcctaaacataatacatttatagctgacatttgatggaaccctggcaaataaaacttaagtaattaaataaatgcatgtctttaaaacatccttaagtgatggaaccacaaatgtgagtgctgctcagaatctttgcaccctaagctacacctgtcatgattctttctgatttccactttcatagaggtgacccacttacgaccttggcctctcaatctgttgttcttctttcttctaacattcttgccctcagactaaccttatccatggttatgccttaaaactgatcattatcaatcactatagccccctctcctcccacccacagtaatctcagtctcgagtatcttttaactttccagctctcttcttctaacatacagatctcaataattatcccataccactaggagctcaaattcattgatccaccttttcattgtcaattacctctttatcccctaggtcctctcttcctgtctttctcaatttaaatttttttgtacatcattatcattcccttgcctctctctaaccctcattaaattcagggctatttgtgaccatattttttctcttaaagatgaactaccattaagttgatacagctaacatttttttaaaagcttttgaaatcaatagcatcaaattggttcattttaaatcaaagttgttaagatctctactgtctttataaaatacaagtctttcacagtaatgaactagcttcacattttgtgtgattcccataatctattgataaaaagaaatgcaattattatttttccccgatgtagatgaaagcagactttacattgggccacagaaaaacccttataagcactgtctatatataacatgtatttcataaataagttagcgtttcatatagctagtgtttttcttatttataccatatgactaacattaatctatatgtgaatgtatgtttaataggaaattgcccggcatttacgccctggaactctcagagcaatctttggtaaaactaagatccagaatgctgttcactgtactgatctgccagaggatggcctattagaggtaagataaagaaggtaaacatcctatttatatttcaagctcataaattatctcaggagttctgatgtgtaagaaaactttttgttttattgttatacttcaagttctaggttacatgtgcagagagtgcagttttgttacataggtatacacgtgccctggtggtttgttgcacccatcaacccatcacctacattaggtatttctcctaatgttatccctcccctatcccccccaccccctgacaagtcctggtatgtgatgttccccttggatgactctgttacttggccatctgatgattttggactgcaactttgaaagaccaaattgtagcatgctgcatagctttcaaagaatttagatatttttttctggttggcatacattttgattttaaaataattaaattctgtgaaatttgtttttatatcaggtgactataccatcaccataaattgctagtcatgaaaatacatacagttgacccttgaacaatgtttgaactgtgctggtccacttatatattcatttgttcaataaatatattagaaagtttggagatttgtgacaatttgaaaaaactcttgggtgaactttgtagcctagaaatatcaaaaaaatagaaaaaaatgtgtattatgagtgcataacatatatatagatactagtctatttatgtgttaatcgactttttgttatcgatgaagctcccggtcaacagcattagtagttaagcttttggggaatcaaaagttatatgtagatttttccactgtgcaggggataggtaccccatacctccacactgtttaagggtcaactgttttccaatgaaattaagaagtctagccaggctcagtggcatgcacctggagtcccagctacttgggaggcttaagtgggaggattgcttgaagccaggagttcaaggccacagtatgctatgattgcatttgtgaatagcccctgaactccaccctggacatcatagcaagactttgcctctaaaaaggcggggaaggagtctaatatacagtgtgatagtgttacccatggcaaattcatatgggtctgcagcaacctcagtacctgcctcttcagaagaaagaattcaactgaggaagcataaggcagaaggagagactgaggcaagttttagagcaggagtgaaagtttacttaaaagctttagagcaggaacaaaagaaaggaaagtacacttggaagatggccaagcaggtgacttgaaagacaagtgtatggcttgaccttttgacttgaggtttttatatgatggcatacctccagggtcttgcactacttctgaccacttgcccaactcctgagatcttattgagaagccgctcgtcaccagttttaggtgttttctatctactaggagactgccgttccctggcgccagctgtgaccaattattacttcagagagacagttaacaaccacctgaccatcacctgatggtctcccaacactcctggtgtgaggtatgggagccctttcctgccctgctcatacccgactagctaccaagtataacaatagcactcaaagtgatagctaacattttggtcacctttattaaccagattctaccatgacacatgtgttgtataaatgatttcttttcattgccatagcaactccaataggctggtattcattatatctgtttttttaggaaactgaaattgagactcagagaggttaagtaacatccccaaaccagacagctaatatgaaacaaagccatatttgatctctcatcttttaaattaacataaaatatgaaatgaaaaattctgagaaaatataagtgaaaatgggtccagtttagggttaagaaagttatttctaggccaaaatccaagaaggaaactgtaaataaatattttatttttttaacttcttatagattttaaaatttttgtgtcaaaataagctaaatgaaatttaaaaagaaataataaatttaagtgattaaatgaagaaaaatggttgatatccttaatacacatttattttaatgagtattatgttttatgtgatcaaatctattagtcttttaaaaaaaaattatgtcctggaagttgtacatagaaaagccttccccaaatattttgttttcattttcatacattgaaatgttcaatccacctggaatttattagacatatagtgtgaggtatggatttagccagctatcacaatattattaataataaacaatttattttatttaaatggctaaatccatccatcctttcattgttctttctcatttattgaatacttatatacatccttgcctgtttctgaacttcctattttattccattgatctgtaccagcaaaatactgtttttattattgtaggttatttatactttacaaaagtgttcttggttagtccctaaaatgtattcctccaaatgaactttttatttatttattgagagggagtctcactctgtcgcccaggctgtagtgcagtggcacaatctcggctcactgcaacctccgcctcctgagttcaagcatttctccagcctcagcctcctgcatagctgggattacaggtgcatgccaccatgcccagctaattttttgtatttctagtagagatgaagtttcaccatgttggccaggctgtctcctgacctcaggtgatccacccacctcagcctcgaaaagttctgggattacaggcatgagccaccacgcctggccaacctccgaatgaactttaaatgactttttaccgaggtctttactccacccctacaaaatgcaagtgggactttcagtgacattacaatatgtttataaattatatggaaatgtcatatctgtaatagtgagtttctccaacttcatatgtggtatgcctctccttttatgcaagcagtagagtcactttttttcatatagttcttagtaatagtctattaaatttatcaccataagtttctttgttgttgttatagaaaatgactttgttagctccattaagattttctgttataatccaagatatttgtaaaaccttatctattatgcatctttgtatgaaatttagacatacttgtgaaatgtaaaaatgtaccaagctttattttttaataaccaaaaagattaaatgtttattttaaattttaacttattttataaataaatatttcctcactttctgatagcttggacctatcaactaggtttgaatagagacttttacttaatgagactgaaatgttattaaccatgaaatttatacccattaaaaatattatccaagagggcctgaggggaaaaaaaggaaaaagtattatctaaggtatgcctatgattttgttcatattgtttgaaatagattattactgcctgtagtttgcaaagccatttactaaatgattgcaatttttctgatctaacttcactggagatttcagtgtacattaatgactgtgtggtttagagaattaatcaaaaatcagaagttagagcatcagtagcttcctcttatatggctgattattttcttgatatgaacttgaataagtcacattttctttccatgcctcacttcttttatcaataaaatgaaataaagagtgctgagatagtcaaggatgcccttatcaattagctactttcagattattatttggcttcagatgataaaatattatgaaaatacataaaggccaaatgaggtatctggctataggtcttcaaagtgaaaatccgagtgacacaagacaagttgtctgatcagtgagcactttgttcctaggatcagctcttcattagggggacatcctttagatgcagagtgaccataaaatttattgcccaattaaacaccctttgaaaggcagctctaatcagaaaagatgttcggacaagaggcataaaccagaactgtcacacgcaaactagaatatattgttatcctatttatatggcaagaagagaaagaggggaacatgctacttctctttaatctttccctaatgtgatgtttactgagctatgtgtcatgggtatagagctcagaaagtatggcttcagtttatattttgtcattatccattattttatttatttatttatttatttatttatttttatagcaaacaattatagaacatgttttacttgctggattgtgataggatcaaacaattcatttctactgttctcctagaactcatagtaagtttgagaggtcaaagatcttagcatgaatacagaaatttgttttctttgaatattgctaattgtgacccagtcaattttgtgattataggaataaattatggtatttataatatgagacattctagaatgttctgtcactgttaatgttctcttatactctgctggttgtaactacaatgatcttaaatttgtgtgttaaagatagcattgatggtaaaatgttcagctgagtaatcaaatactagttttctattaatggcaaagaacttttgaagtaataatgcccactgctggcaatgctacagtaaagtagataccctcatatagctggtgacaactatgggcaaaacatattgaaagccttggaatatttctataacttttgtcccagaattctacttcttaggatctaagcaaaggaagagagtggcagcaggactacaaaatggaaagttatctgcacagatgttcatggaaggagtatttgtgatcattaacaatggaaataatatgcatgtttacagatacatcccaccttacctcctctaagaaaccttccatggcacccatagtctgcatcagtccgtatgtgtgttttcatagcactttgccttcctatactatagtggtgtagccaagtcaaaatagctctgtactcctgggcaagttactcatctcactatgcgtaggtttcctcactctgtaaaacgaagataacagtacctgccctatcaaatatcattgtgcctagcaaatagtaattgctcaacaaatgatagtagttattattattattactattacagcacagtgtctgtttgctcatgtgagactgtgagtacacatagtagggaagagattttttcttgcctggcatataaaagctcttcaataagtgatttttgaaagaaaggaaggaagagtttagttaaataaattgtattttttgcactcggtgaaaaagtatgtcacactttatagagaagactctataacagtgtttcctagccttggttgcacatcagaatcacctagccagttttctaaatactgacgtccagactcacccccagagattctaatttttttttttttttttgagacagagtctcgctctgttgcccaggctggagtgcagtggtgcagtctcgactcactgcaacctctgcttcccgggttcaagctattctcctgcctcagcctcccgagtagctgggactacaggtgcatgccaccacgcccagctaattttttgtatttttagtagagacagggttttgccatgttagccaggatggtcttgatcgcctgaccttgtgatctgcccgccttggcttcccaaagtgctgggattacagatgtaagctaccacgcctggccaagattctaatttttttaaacaactttaaacttttagaaaagttgcaggtacagtacaataaattttttatgaacatttgagagtaagtcatcaacattatgtgcatacttctgaatcctttagtgtgtatttttaacataaaagggcatttttttttacataatcacattacaagcatccaaataaggaaatcaacattcatttattactaccatctaatccttagactccactcagatttcaccaattgtctcaataaggttctttgctagcaaaaggatccaggtcaggaccatgcattgcatttagttttctccttagtctctttcaatctggatcagtttctgaatttttccttgactttcatgaccttaacacctttaaagataacaagtagagattctaatttaattgatccatttatccctttgctcatcagaaatttttctagatggcttccacctacagttctaacaagatactggcaaatttattttgctgtatggcatacattactcatacgagatgtcatttgttggctcccccttgtctatgaaaatgaatgatgcctttgtgatgttatgactcaacctcgtgtacgcctcccctcttctccacttcagtgttagttgtcatctcatgtcaccagtgatacttgtgagaggcagttttactttctccttgcttccttcatctttccccaggattcgttgaaaaacatctttgggaatcattgttatgtggggaaaataatatctacttctttgcctttcactttacctttaaacatgtggtcttttccaaggaccttctttttctgattttctcttatgggaacaaccaaaactttgcatgtactaaaattgagaacctcaatgttgctgaatgggtatatggtagaaaattcaagtatgttcaaattttaattctgtataccaaaatgataggtcaatcattcatttaggtacttttattattattattattttgagacaaggtctcaccctgtctcctgggctggattgcaatgtcgtgatcatggctcactgcagctttcacctcctgggctcaagcaatcctcctgcctcagcctcctgagaggctaggactataggctgtgtgaccatgcccaaataattttttttttgtaaagatggggtctcatcgtgttgcccaggctggtcttgaactcctggatttgagcaattctccagccttagcctcccaccgttttgggattataggtgagagtcaccatgcctggcctgtatttatattttttaaacattaaaacacttcactgagaacacagcagtaaacagaatacatgtggctcttatcttcacagagcttacctttcaggagacagttatgtatagcaaatattttataggatgatgaaaacataggtctttcctgtttttttttttctaaatgttctgtaacttggtgataccacttttgtgattataaaattttaagaagcatataaaatatttaattgtatgtataagtgtaattgcccaacgggttcttcctgccccctgcacagagaaaatcagttcaccaagactgtggtattgaagttaccattttaattgacaagaggccgcccacataagagatggaattattactcaaatcagtctccccaaaggatcaaaggttaaggtttttatggacaatttggtgggcaagggctaggaagtgtgtactgctgactgactggggatgaaatcatagagatgtagaaaacggtcctcttgtgctgagtctacctctgggtggggccacaggatcagttgagtcataagtcagggtcaaggtgaggtccatcggttgccggaatgcatatctaaaaaaaacatctcaaaagaccaatcttaggttttacgatagtgatgttacctatgggatcaattggggagatcacaaatcttgtgacctctggaccacatgacccctgagcagtaaagcattatagaacctaggtctacattttagcagcattcaggcccctcccataatattaatattgtggcttttcattagttttacaaagacagttttcagttccctagccaggaaggggttagttcttgttttcaggttaaactatagactaagttcctctcatggtgagcttggctgacacccaggaatgagtgaagacagccagtctgtgaggccagaagcaagatggagtcagctatgctagactcctctcactgtcataatctttgcaaagtcagtttcataagtagttgatcaaatctgaatttggatacataattacttctgcatggattcttattctggtacactctgggggaaaaaatagtgaatcaaggattaatcagaaataaacataggtgcatggtgactaagatgattggacaggccccaatttcttggccgtgattaacgcaggcctctgcacatactgacactcataatttatctttagttttagcttctatcttgaaagaagaagagttgtgatttttagtagtacattgtcaaagagggaacaacttgtacaaatacaaaagcaaacagctttctcttagagatctaaaaatagtgcagtaagactggggctttgacctaggaggtagaaaatggcaagagataaagctggaaacatcagcaggggcctcgtaaagtcatattaagacaactgaacttcatcttgaggccattagggatccaaataaatgttttactcaggggaatagcacaatgatacctgtgttatagaggtcactctggctgcagtatagagaacagatgaaagggccctggggtcaggcagggaaacaagtgggtggagtctagggggacagagactaggtagaagtctattaagtaattcaggagaaaattctggtttcctgaattgctatggcagaagggatagccagaagcagtgagcttcaaaagacatttagtggggtagaacagaaagcctcagagactaattggatgtgaaaggtagcctgtgggaatgaatccagattaatgcctatccccaagcaaacgtgatagtaccatctttatctgtgttaccaaaatctaataatctaaaaatgtctgaaaaccaaagttttttcataagtttaatggtaaaacctaacctgtcttatatcaagttgtgtatcattaaacagttttgtttcagtagcttgacaaaacatttaatgtatatcatttttatttaacctatttagtgtgactcttcacactgctgtaaaaatattaatgtatttgatgatgagtgacttcccagaccccttggagtattatataatatatactatatattccagattattattgtaaattccaaaacatctagtacaggagtcttgaataagagatagtagacaaagtttaaagtggccatgtagaaagtgctgatgacaagaatatatatttatgggttgtatctccaactcagttgatttagcagattacatgtattatggtgttattattctctggtgaacagtttggcccaggggtgaggtttttacaggagggtacgatgaggaaagataattgaggatgttagcaactatagttgaagttataaacaaggaaagatgtgatggcaggaggtgcttgaagaaagggataaagtagatgggccaagggaccgaatgcttttctaaggtacctacagagaccccaggaataacagggaaagagctgtgtcactgtacacttcagaagtggagctttccatggtaatggatgatatgattcagggtgtggccatggaaggaggtagccagtgtggagtggagatcagtatcagtcactagagatatgtaagtctaggaactgagagaagctttcatgttgagtggcattgaaatcacctaggatcatggttaggaggtagggtggagaagaaaatggtgactcaaattctgaagtctttcacaaactagggaagtttgtgaaccaaaggtgtgacagcaacaaggagaaaagatctagccagatggcataagcctcaaaaagtcaggagttcatatataaggggaggaggtcttaaagtagcactgggacaaaggatagaactactcctaccctcctggccagagattcttatcctgcggactccaaggaattgatgcccttaggggatatccaagtttcatttaaggctaagaggcctatgaagagattcaagtttcaagggagtttacaatggcactgaagttctgcagaaagcaataggaatagttagagattggggaagggaagaagaatctcagagccatgtgagaatagcaggatcggagaaaagaggtgaatataatggcctccatgttggtgggttggggtgtgacaaattaataattaattttctggtcactagtaaatagagaccctaaaatcatctttaaaaatgagaacttttatttttccgccccataatttgagatctgaaggtaggcatgtgggactggtatggcaactccgtaataccatcagtcacccagtctcctcctccttggtaccgtcatcatctttagtatgtgctttttgccttgttgccacagaatggttgtcagaactcgagttatcacttcttttttccaggcataaagaaagaagagtgagggcaaaaggcgaagaatgccagctgagctaacacttcctccctcgcccacctttaagcttttccaaaaaccagagccctcacccaacagcttcaggttatgatttttgttgttgctgggatttagtactgtggccgcccctttttagaaaggaagtgagtaaatgtagttctgttacttgggaacattgctcccactagcaaaaatcaagatactgttagaaggaagaaagggagaatgaatgttggaaaggtaaaaagcagtatcttctccaggtggtcaagaggcatttagctagtaaacaggcttccaatggaactggccctagctaatccctagtgcagtggttcttatgtgtcctcccctgctccagaacagctgcatcacctgagaacttaggggaaatgaaattctcggggtccactgtaggccagctgcttagcaactcggggatttgacccaggaatctgtgctttaacaagccctccaggtgcttctgatgcccatgaaatttgagaactaccgtcctagtgcagcggttcccaatcaatggcatgcattaaaatcacctatagagttttttttaactatgtaagcctagagccctattatagaagattctggttaaggaggtctggtatgagctccttatatctatagagtagagccccgttattcatggtttcactttccacagcttcagttacccatggtcaaccatggcccaaaaatataaaatggaaaattccagaaataaacaatttataagttttaaattgtatggtaccttaaagagcagggttgcaaaaattaaaaaataaaaagttttaaattgtatgccattctgagtagtatgaggaaatattacagtatattgttataattatgctattttattgttaatctcttactgtgcctaatttataaattaaactttatctctcatacatatggaaaaacgtagtatagatagagttcggtactatccacagtttcaggcatccactgggggaactggaacatattccccacttataagggggcactactgtattttatgttgcaggtgattctgatattctgatatggctgatagttaaactagcatttagaaaccactgtcccagtgagtaggggcacaccagacttttttaaaacttgtaaaagaacctatcaacatagtaaacagacaacctatcgaatgggagaaaatttgggcaaactgtgcatctcacaaaggtctaatatccagcacttatacaaaacttaaacaaatttaccaaaaagataaaaaacctccatcaaaaaggacatgaacagacacttctcaaaagaagacatacaccagacttcttcgaagtcggctttggttctgcttttgaggaaagcctagaccctgtgagaaggccagcaaagggattgttttgctttcaggacttaactgacagttggaagcagcagcagcctcttaactttgaaaggatcaatagcctctctagatggatttaattgtagccaagggttgttacacttccaagggaactccagtctctgaatgggggaatctgtggcttctgtggaaggagccagccatgacctgattgattacccagattttttggggggaagtctcaatgtgaaggctgccatttgccctcccagggaggaggagaggcctgagatatgtggtatgcatgtattgcatggatgctgagggtaacaagggcagaggccctgggtttcttgcagcttaaaatagttatctgcaggttcatcaaatctgcactcaccatttggcatggtcatgtggctcagaggtgtacaggggaccaactcttgtcattctccctgtgggttgtgtaagtgccttgagggcctgggcttataagggacttttgtatctccagctgctaacatattgcaggcttttagtctgttgagtaaatgcatgtgggaatatatcatgaatggggacagtgcacctccataccctctctctctttatgtggcggaaatgtctcaatgacctgatgagagtgagccccactttcaagtaccacatctcaccattccctccacctgccagttgccagaaaagtccactgcagcatcccaaaaatgtgaacaattattatgtatcaattaaaaaggccacgtccaccagcatcttctttcattgctgtttattcaagtaaaacctgaaatatgtgcatgtggaaagcgaatggtttgcatggattcttttcttccttctcaaacctgatatttcagaagtctctacattcatcgtaaaaacatcatgataatataagaggccttaagctatcaaattgtaattctttatggcccagttagtatttcatcagcattggttgttttctcagataaaagaatcttggataaggagcaatttcacattccctcctatatcccgtcatagtggggcataagttcattgctagattcaaagggagttacaggttcataggtctttctgtttctcaagtacagtgccagctccacctttcttcagataggctgccttctgaatctgaaaagtaacaagcttaatgacttaagaactgtatttaatataatttatcccactttatataggcacttataaaatcatttgccgaagactctaggattattttagattaatttattttggataaattggttaattaataactatggaaaatccatataaaataaatagacacaatcattggactaaaagtgaccttacagggggcatttaagaatctccaggcattttgtctcagcactttttgcatcttctctacctattccctgggaaatggttcttcaaacagtagcacaattcctggatggctttttaattttttttttaatttttttgagacagagtctcactctgtcacccaggctggaatgtagtggcatgatcacagctcactgcaacctcgacctcccaggctcaagtgatccctcctcagcctccctagcagctaggaccacaggcatgcaccgtcatgccccactaattttttttttttttttttttttgtagagacagggtccccctgtgttgcccaggctgctctagaactcctgggctcaagcaatcgtcccaccttggtctctcaaagtgttggaaattacaggtgtgagccaccatgcctggctgggctttttaaaaatacggattgctgggctgtaccccccagtgtctagttcagtagacctgagatagagcctgagaatttgcattctaacaagttcccagttagtgctgatgctattggtttagagtaccacacttggagagccactgttctgagccaaaaaacactgtgcactctccattaagtcaagttgttctcttgattaatttttgtcaagctgttgtcagatttgacatttcacagacctggaacatttcaaaaaaaaaaaaaaaactaaacagtaataaaacccacttcagggatagacacaatgataaagtttttaaaatttaacaaatgaagacattagaaaaatttgtttcccatcatcatcgttttgttttaaaaggacatttaatcaccaacagcattttatcacagaataatggactgtctcttcaactgaataaattcagctttacctgaagctcactttattgctattgcatgccaaaggcatgatggtcgaagcagtccacttcaggcacaggcaaaacagcattgcatcttctgtagatcattttaaaacaataatagaatccactaatagtttgtctgctttttgttatcaccataaacaggcagttccaaacaacgtcagtgagaaaatactgccccttccccagggtggactactcctgccaacccttgcttcatcactgctttgttgccctcatttttcccattttgccagaaagcagtgaaatgtcatcctagaccctcaccatctggtggttgggagcaactgggctaagttacacatgcttatggagtctttgattgataattttattcaaacttgatatggaaaacatatatcacatttcataggtcaaagaggaatgtaaactagttgagtcctgcgagtggtgattttatctatgttaaagaaaattgggacaggtgctgtggtaatcccagcactttgggaggctgaggcagaaggattgcttgagccaaggagttcaagaccagcctggacaacacagcaagaccctgtctctatcttaaaaaaaaatttttttaaattatacaaattttaaaaacatattttaaaaataaagaaaaaatcctttataattatttggagaaatagagtattctttaacacttatacatgggcacaaatatttttaaaaatatttatttaactaggactaatggacaaaggtagaaaattctgattttttttttttttttagacagagtcttgctctgtcgcccagactggagtgcactggcttgatctcagctcactgcaacctccacttcccgggttcaagcgactcttctgcctcagcctcctgagtagctgggactgcaggtgcccgccaccatgcccatctaattttcgtgtttttagtagagacggtgttttaccatattggccaggctggtctcgaactcctgatctgctcaccttggcctcccaaagtgctgggattacaggtgtgagccaccgtgcttggcctctgattttcaaattcaaaataaaaagccagagatttttttataatattgagttcttcaatgtaacatgaggaattaaaaattaattttatctccttaatccatggcttaattttaagttaactaccacatgttattttatttaaatttcattcattcattgatatgaatccgcagtcatttcaccaggtattgttttgaagatacacatttctgcccagcacagtggctcacacctgtaatcccaacactttcggaggctgaggtgagagaatcacttgagcccaggagtttgagaccagcctgggcaacatggcaagacccagtctctaaagaaatacaaaaattagccaggtgtagtggcatgtacctgtggtctcagctactccaaaggctgaggcaggaagattgcttgagcctgggaggtcaaagttgccatgagctgtgatcatgccactgtactccagctggatgacagagtgagattctgtttcaaaatataaaatgtgattatccctatttgactgggcacaatagctcatacctgtaattccaacactttgaaagaccaaggcaagaagatcacttgagcccaggagttcaagaccagtcggggcaacagagggagatgtctctacaaaaaatcaaaaaaaaaaaaaattagccgagcatggtggcaggtgtttaaagtctcagctagtcaggaggctgaggtgggaggatctcttgaggctgggaggttcgagattgcagtgagccatgatcacatcactgtactccagcttgggtgacagaacgaaactttgtctcaaagaaaaagaaaagtagagagtttagatggaaaagataaaaaaaatgtaaaattaaattgtaatataaaattaaacaccagcataaaagaatgttaccagatagtgtatgatgaagtgttaggaacagtaagtatgagagttcaatggagagcagtatgagtgtggctgaagggggtcaggaaaatttcatgaaataaatttcatgaatttaatgaaatggtatttgaagaataaggcagatttttatacacacagaaaaagaacatggcaggctggttttaggagacattgagttcctctggttgaagtggagggttcctttggtagagtatgggagataaatttggaaatgtaaattagagctagattgtggagactttggaaagctttctgatggcaataatgaacattatggtaacagtgataaaaataataactttaatttactaagcaatatataccaggtactatgccacattgtttacctgcattacctaaaaactctgttgaatagtttctattatctccattttatatgctaagagagtgaggctcccataggtgaaatgacttggccaggatcaccccaccaatgagtggcagagagctgaaatttgaacccaagtttgtctaagtccaaaaccagtgtttctatacagcaaactaggtcaacgatgacaaaagtgtttcaattcacgtgccagtttttgatttattgataaaactacaaccaaatagaaaaaaaaaatcaccatgatggattactgatgtttgctgtaaatgctggatgggagtttcttggtatgtatgacacacagtggctacttaggctctagaaaactggaagccatcaaaggtttttgaacagggaagtgactcgataaaggttccaaaactttaaccaagcagcagagtttaaggtgagtagataataggagtaatggacgcgtatactctgatcatccagtaacaagtcttaaggacctggtagtctaaaataggaccattcagaaattttcttctccttcaagtgatctatttctactatcaaggtgtaattctttgaagagtatctgtctccttccctgtcctctatgatccatgagaacagtgaccttgtgtgttttgttcattcctcagttctccagtgggtaggcattcaatatagttttcttaaatccagtaataataaaagcaatgatgatcatagaaagcactccctttgtgcccagactgggttaagtactttcagtacagcaaatgcatatggaatcagactacctgggtttgaattctagctctgccacttactagctgtccaagcaagcaggttaaactcttgtgcctgaattgcctcatctttatggtgggaataataatagtacttacctcagagagcagcagcaagaaatagattaggtgatataggtaaaacaataagaataggaagtattcaattaaatattggttattattattattatctttttaaattattatctttaccattctatacttaacttgtccattagaaaataaatatagtagagtcaaaggaaaggctatatataacttctatggcaggcctgtttcgtgtcaggcctgttaggctcttttataaatgatatcccagctaagttaaaactctaatttcactgtcagaacttacttaattatctttttaccaaatataaaacccacacaaatctggattttcttttcatttcaactgattatgggctttaacaaatctggtttcaaataatgtatttttaaagataaattggaaatttatcatgggagggctcccatgaggatgcaaggcaggctgaggaggcaggcttcagatcaggtcatgtaggggcaatgaacccgagggaggaggcagatggacagaggacatagacagagggagggggtctgcagagggaaagagatactgaccgaggtctggaatgaccatctctaccaagaggccctctgcctcccacagggtgtccagacactggtgcacacattcttacccaagggcctgggctggcacagccctcaagaaggtggcacccactctggcagtcagtgggtctggcctggtggaaggatcatcacaggcttcagggggctggacagcctgggggggactagcggaggtcatctcttccagcctcctgccctcaaccaagtccagctctgagccctgggtcaccgagggccaccctggattcattggaatccctccacctccagtaggtcaagttctgtagaggtctgaggatggtggtcagctggggagtcaggagcgggtgaagagggtcacagttctaccaaagccttgtccagtcatcctccatcccctcgaggcctcttccctgatctcccactccatcctgccacttcactcatttcatcagctgcccctgaagcacccgggactcaggactggttttatcttccaaggccttggtgaagggctggcccaggatctacagccacacctcatacagcaccagctctgccttcccacctagagcaatgagggtggagatggcatcagccgggccccctctcctggaagccctggggtgggactcatacccaagctctaatgctccaatccagcagtcaaccaatgttagtctaagggcccatcccttgctgcctgtttttgtgcggcccatgagctaagaatggctttcacatgtttaaatggttgaaaaacatcaaaagtagaataatattttgtgacacatgaaaagtatgtgatatgcaaatttcaatgtccataaataaagttttataggaacatagcggggaaaaggcttttattcttttagtgtagccttttatgtttgaagagcaaattatattgccttgcaagaaattcaaaggtcagtacccaggtgctagcctctgtacctatctgaacttgctcctctttttttttttttttttttccttttccagcctctcttctcatcatataaaccctcttgtctgtcacctggcagtacaattaaactcatggatgattcccttttgtagctgaagtttgagaggcaaaagttagctggttaatagaaaggaagtgagaatacatgttttttctagacaaccaaaatatccctttgcctactgtttattaaaaacaaataaaatcaaaagcttgttccatcaccactaagcaatgcttgtctctattttgtaggcctttactatgatgatcttcagtaatgttaatatattaagtgagtttggccaattcttgatcttttatcataatggagaaattaaggggttagcaagggcccttgaaatccagagagatactagcaactatttgtccattaaatgcaatgtatttacaatataccttaccttttttataacaagtatacagatagactagcttgcccttagactcttaaatatatttttctcagctgtcttatagagcacaaaaatatttgttatgggcttaatatgcacacacacacatacagacatacagagtaaattagagacaatatatatacatattgtaaactagagacagagtctcattctgtcacccaggctagagtacagtggtgcaatcatagctcaatgcagccttgaattcctgtgctcaggcagtcctccactgtcagcctccaagtagctgggactacaggcatgcaccaccatgcccagctaataaaataagtattttataattgaatggaagtgattaagaatcatgaagggacccaaagtcataaactagaaagatgttaaaagactggctcatatcagaactgtataatccgaattcaataagtcagtatcacagtaatctccccttatccacagttttgctttccattggtcccagttactctcaatcaactgtagttcaaaaatatttaatggaatattccagaagtaagcaattcgtaagttttaaattacacaccattctgagtagcatgatgcaatctcatgctgttctgctttgacccttcatcatcacaagaaggatgaatacagtacttaagatgttttaagtgaaagaccacattcacaacataactgtaattacagcatattgttataactgttctattgtattgttactgtttttgatcccttaactgtgcataatttataaattcaactttatcataggtatgtttgtataagaaaaaacatagtatatgtagggtttggtactatatgtggtttcaggtatccgctgggggtttgggatgtatcccctagggataagggggaaatactgtaataaccaaatataatcctctagcagtagagagaaatgtgtaactaaaatattaacttctcttagttaaatattatttattttatttttttattatttttgagatggagtcttactctgtcacccaggctggagtgcagtggcaggatcttggctcactgcaacctccgcctcccaggttcaagcaaatctcctgccttggcctcccgagtagctgggactacaggtatgcaccaccacacccggctattgtttgtgtttttggtagagacaggatttcaccatgttagccaggctggtctcaaactcctgacctcaggtcatccacccacctcggcctcccaaagtaggattacaggcgtcagccactgcgccctgcaagttaaatattacttaaaactaacaaatagatatgctcactagtgctcttatttctagtaatcttgaagttgaaagaacttccagaagagcattggtatagaatatattgtgtgtatgggcatcttgtgaaagagaaaactgagaaaagatgccaaggacaatacatgtatgggtacatggctttgatccacatatcaagtaagggagacaaagtgccctttttaacctgtgacttttgtgtctactcacctaagacagctggtattgtgttcacattaccaaccaccaacactgtccagtcccttcattttcctggctctggaagactgaggagaaagatgaaaccaattcactcattgtgctttgctctctgcagtttgaccctgaactcttgactttggtctgctccctgcctcatttttcagtcagtgactaagcagtttttgagttaataagtaactcttaggtgactgattaaaaattctaggaggtgacttagaaaggagtctaaaacatggttgccctaatagaattcatcctgtttttcattcataaaatattacagctactcccactttggctttagggtgaaaattgttaaacctactactgttctttgtcctttagacagttatgggctttcctgttttaagaggaaacagaagactagtctaacaggaaaatattaggctcaatgttttcaagagcacatgtattgagaaggttttgcaggttatggaaagcttttaaagaaatgagtccgggcgcagtggttcacacctgtaatcctagcacttggggaggccaaggcaggtcaatcacttgaggtcaggagtttgagaccagtctggccaacgtggcaaaatcttggctctacaaaaaatacaaaaattagccaggtgtggtaatgtgcacctgtagtcccagttactcaggaggctgaggtaggagaatcgcttaaacccaggaggtggaggttgcagtgagcagagatcaaagcactgcactccagcctgggcaacagagcgagactctgtctcaaaaaaaaataaaataaaagaaacttgaaagaaattttctttcaagaaattgaaattatttctttcaagaaataatattgtatgagcaattttctgtgagataattgtgaaagaagttataacaatcgctatatccttctcacctttaatctgaatgttaatttagccacaaagatagcaataagacaacatcttgaaagtatcttatccacagcaaagtcacactttcttaagcatagatgaaatccaaactactatagtcgttacttttaaatctcatattgggcaaatgcttacttgatatagttacgaatttgatacagtcatgctcttgatgaagtttaaaagatagctctgctattaaatttatttgcattaactctttcttatcattgcttattgattttttatttttatgtatatggtaggaatattaactagcttgtagggagtcctggccatatgccaagcattggtctaagtgttttatatgcattaattgacgacttcatttacagatgagtaactgaaacatagaagagttaagcaacttccccagggccacacagctagaacataacagagcacagacttgaacccaggcaatctgggtccagaatttatactctctaacctcactgcctttctgtgtgatcttaaatgtaacaagtattatttctttagagttcatgataggatggggagtgagactagaaaaactaagcatgagggaagatataataggaaatagagtcagaatatttggcctccctcaaaagtaattagaatgattagatatttacttaggttttatccttattaactgatatttttattcacaaacttgtccaactcagttttagattaaaaatataaagttatttattccttaaaaaattcttaactatcaagctgctgtattgtcagcagcaagaggcctttgagttcttgagggggatgagagaaggtcacgtgcccctggaattccaaaggattattctgatctcactgtgatttcactgtgcttacccatgagaggggcatagtcagtatttgttgaatgaccaagtacataattctcatctcccattctaataataatgtgtcatatgaggaacaaaatcacaagtactttctcctctttgtccccattgtccttatacatacttctgttaacatacttggtgtattgttaaataattatttgtttctgtgtagttcaccccttagtgtgaactccttgagggcaggggccatgtcttacctttgtatcccaagaacctagcctctgtttatcagtaacttagttgattattgacaaatggctgtggaaggaagggaaggagtaaggcagacctagagctgatatccttgtgtatttattttacatttattaaaaggtcattgggtttaatcatttgaggcttttgaaatatattcaaagatgatatttcttggatttgatatgactcctctgatttaacccctgggaagaggtcactgggatttaaagagtatgtatgttatagtctgtcccttaggtacaccacctgattttattgctaaattatgtcatactccaaagggctttggctgtacttttggtgagtttatctgtaattattgataaatacattcatttttgcttaatttatacagaatgcctgtgtgaatcaccccaaatcactgtagcatttaaatttccatctcatggtatagctatggactaggaagtctgccttggaaattagggcttattctttgaaaaaccacagatgtatttattatttgagacaaatgtgtagtatgggatcttttctccctccgataatattaaatgctgtgttctcacttgtaagtgggagccaaacaatggttacacatggacatacatagggaaataatagacactggggactctaaaagcggggagagtgagaagaggatgaagattgaaaaattgcctattgagtacaatcttcactattatggttacaggtatgctagaagcccaaacctcaccatcacacaatatatctatgtaacagacctacacatgtaccctctgaatcaataaaaataatatgaaatgctgtatctctccactttttactttcttcttcaggcccactatactctcatattataccacatttagctcacatctcttgtggtatgcactgtgcactcacaattgtgctggatgctgtttttgtttctaggggttataacaattcgattttcctccataattctatttcttgtttttaaattcgggtcaacatacattgtgaattccatctttgttgtaagcacacccttatttactgcttttactgaccttgtcatcttacagaatagtctactctatcagtgagtgatatctcccattctgtcattaccactatggtctgagcaagagtaggggctggaaagaggctacaatgaggctatctatggattttcagtgggtaattttaaaaactgtgcctccatggaagcttctgataatgcttctgtcctcacctccaccccgcctcccactgtgcttctataactggccttatgacaacaaatgaatctggcataagagagaagagcaccagagtaagtgaaacagaattgtgtgaattagccgtctcgttggattctacccaatcacactgtgaaagtccattatgcattatgcttatattccattgtgtaatgaatggtaattcttctaatgataaatactggtcccctttggtaccaaccttagagttagaaatagcttaatctgttgagtaaatgaataaaaaccgcaagttgaaaacagcaaaaataatttctttgcttggaatatcagtgtacatatctttccgtgcaaagttctccacttttctcattacccattaacttgtttgttactctacaatctccatctgagagctaaaatctgctgcttactattcacaaggcagagagaattataaaacgttatacaatagtagcacacagcatagctttgaatctttccataaagtcatcataatggtacgttttctgagtattgccttcagtttgttttaataaagaattcattgttctagtgtttacatgatgattttctgtaacagaaactgatactgacattgataccttaggctaatgcaatttttagtcattttactggggtaaaaataactttgttgtataataaacaaattgctgaagcaatcctcctgcttcagcttccagtaattgggatggcaggtgcacgccacagtgcctggcttcttctcacattgataattttggtccttctcaggttaacatacatttattgaaggcctgtttgtgccattcactgttctaggcactacggctaaataagacacactcctcattctcaaagaatttaacattctccaggaaaaattgttatcgaaattgacatcagaaagtaaatgctaggagattgatccttcctgggtttcatgaaagcccctatcaggaagtaaatgctaggaggttgatccttattgggtttcagcacaagaatcagatgagcctcctgttagatatgaaatctgctccaagtattggaggatatgttaaaaaaaacaaaacatagaatagtattccaggctgaagaaatagtgtgtatgttgtataatatattctcttgtaatggcctttgtggataattacacattgcaagtattcaattttatttgctagtattccagtttgtcttctcatttgagggatattatgtatccattctcttagctctttaccttggttttttgtttttgtctttgtttcctgagatggagtctcactatgttgcccaggctacagtgtagtagctactcacaggagcaatccctaattccatgtagggaaactacatggaatttgatatagcatagcttaaaaagacattagagaattgcagatgagcatggaaaggtagctaaggctcaagtcatataattattttatgccaaatttaggagtttgaaatttattcatagggttagtccatggactgactggctgaaattgtttgcaaaatgttgtggatgtattcattctgggggggaaatggtccgtagcttattagatctcaaagttgtccacaataaaaaaaaattgttgagaatatttgcagtgaaaagtttaagtaaatgcccatactgttcactaattagagtgaagtaaggcataaccatatccatgtttcatattacaagaaatgtgatgtacagagctgtcagtgcaatgaatggaagttgccaggaagacttctgtagccaaaactaaaccgtaaattcattcattgaacatttcactgaacttttcctatacaccagaaattggtaagcactgaggagacagtaatgaacaagagctcctattcagacacacattccattcagggctcatagtctaatgaggaaggcagacattaatcagataatcacaaaaggaaatggacaagtataaattctgattattgctgtgtagtgaaagacaggatgagttgtaatcggggaacctggtgtagataggggattaagaaaggtttcctttagcaaatggcatttgaactgaggcctgaaatgagtgtcagctgaggaagaaggtagttgactccaggccgagaaaatagcacttgctaaagcccttatgcggggaattggttggtgtgttttagaaaaggaaagaagaaatataaaatgcaaaaaaaaaaaaaaaaaagcctgaggtgacactggagaaatagagattgggccatgcagggctttgtgggctattttaagaatatggatctttatcctcaaaacatcaggaggcaacccttgaggggaatgggcattgacataatcaggtttatagtttttaagaggtctctccagttaccatgtggaaaatggactgaagggggtcaggttgggatagatttgttaaataatagtataacaactgaaaatacattgataccatgtactttaatttatgggttgttataaattcataaaatgtgtctaggcattagtttctccatgtggaaaatgatgaggctgaacttgtaattctcaaagcttggactcccctacaaatgagctgaataattgatcctctgagacctggaggcagcagctccaatccttaaccacttcctgtgccggctccaggatgccatgcgagaatgagcattttctaggtgcaccatgaggtgacaaagattgagaggccctcctctaaacccctttcctgcactaacattccatgattctaggttttgaggaaatcaaattctaatccgacaccttggttttaccattgaggaatgtgttgcccaaagaaggaaaatggctcacctaaaattgcatggcttagtgtatagaacattactctcctaactagtaatcctgggtttttctagtttgccatactgtctctgtatcctttgtaagcagtataatgaattattataattatcaaattgcaggtgcttctttttctttcctctatttatgaacagaagtacagtttattcttttttgattaccagttaagaatttattgctgtaagtcatcaagcatcgttttactaaaacttgaagactagaaatggagaaattaattcctaggaaaacaacacatcttatcttattctggcttagctgaaaatattgcaagactagcatttctatttcaaaatcagcccaaaggctgtgagcatacagaagtgatgaatagaaagatgttagctgagctcttaatgacttttacttgatttgaacttgagttcaaaggtaaatcaaaagtttaaagttgaacttgaatcttactatgccatataggctttccttagccttctggaaaatctaaagtataagggaggtccaggagtatagtgattctgggcacagactctggagtcaggtggtctgagttcaaatccccagcttctcctcctaccaacttcatgacttaggaaaaattacctttctcagactcattttatctacttgaagagtagaaataatgacatttcacagtaaaaattaaatgaagcaatatatgaagtaattttctcttaaatcttaaattacctcagcatatgctttcacaatttctttccaattttaagtgacaaagtccatcccagctattcacttcattatctcatgaattctgattatgtattctctcagcttttatccaatctaagagctttttcacttttctcatctgtccttataaaaaaaaaggcattccatcttctaaaaaatttttatttctattttctaactctattatttttgtcttggagcttttctaactgaaatgtgtatgaagtatagcaataggaacttcccaagaaataaaatattctgtggtttgtttttcttgtaaagagtactgtaattccttgggtttaattgacaacatcctttatgaggacactcagcatatcagcattgatggcctcgtagacagcagtcttggcccaagtattcagggaatgacgaggacatactccaagatccttttcccgaatcactgtttattgtttataaaactcatcttgtaagcctgctttatttccttatcaatacccaaggtaatcctgttgaagtttactctgcttttctgcccatattccccacttcatcttttgaggcctacctgtctccttggcacattatccatgttaagtgcctccaaggtactgtggatactagtaaatgccaaattaagtgaggggttttattctttccccagatcacatataatgatatcagatgggcttggtttgggctctgatttcggaggcacctactttgactaactatctaggacagtagttttctttttttttcttcatccagaaactttattgtaaatcatttgtcaacaagatctgcatttctaatttcagtttgtcattcctctgaggcacagagaaaggaaaagatgagattagggttaatgtttattgagcactatgtataaaggatcttatttagtccttataaacaatactagggcagtggctttcaaccccagtggacatcagaagtgtctgtgaagctctttgaaaatgtggacgtctaggacctacccaagacctaatgaatcagactctccagggtgggggtgtaagcatctactttttggttctttaaagatccatagggtgattgtgatgtacaaccaagttgaaaatcaccaatcttgagaactggtctttatatctacaatttcttttatttgaaatctttttttttttttttaaggatagactgttccctgtcaaaatcttttcttctctgggagccacaaaatgaatttctaagaggaagtgtcaaggtcacctgagtttttcccctctgcttgcttggcattcataactgagaaaacccatccctgaagctttactgtagctgatttgtagcagagcccatcctgggctactagtttcagagtgggaacatggggccatatgtcctttttaaaaaagtattatttgtataatgtgctacaactttataaattcacccagaaacttacatgcccactaaatccaatgaggtaggttttattatcttcaatttttagattaggagacaggctcagagagtctaaatgatttgcctaagagcactaggaaatagtggctagaataaaactcaattcttccaactccaaatctagtactctttctgttctttctactgattaatatttttatcattccattttgaaataatttcagacttatagaaaagtttaaaaaaatactttccacaagccctttacctatatttgccaaatgttaatattttaccatgttaatcatcctttcttctgtctttctgtacatatgaatttaattatttataatatttaacagtatgttatagatgtaattcccctttatctctcaatacttcagtgtatatttcctaaaaacactgatattatctacagtcaccacagaaagtgattgcgaatcaagaagttaacattaatacgatactattatcaaggtacagaccttcattttttacccacaaatgtcttctgtggcaaaagaagaaaaatagtttctggttcaggatccagtcagggatcacatattgcatttggttctcacgtctgtttactatcttagttttcaaagttttcttagtctgcctctgctgttcatgacttgaataattatgtatgctatcatctgataagctggaattgacagttctggctgtcagcacttgatggagttattcagagatacttgggttcagtgacatacagcaggatgggccataacattaggagaatatttggaaaccaataatagtgatatttattatgcaatatttatgctggacactattttaaatgtcttccatataattcctcatttaaacttcactacaaacctacatagtaggtattgttacattatagatgtggaatctgaggaacaaagaagttaagtaacttgctcaaggttacctggccaggagatggcagggctaggagtcaaattccaacagccaggctacatccctagtgtgagctctgaaccagcacaggctgaaccagagacatttaacaaagtgatatgtctttaggcaaattattagctcaaaaaacttgagtctcatgaactgaaaatgggactaataataccaatgtcataaaggtggttgtaaggattacacacaataatctgttaaagcatttggtatgtagcaagaacttcattttttaagagtaaaatttaaaatataaatatggaaaaattgaccgataagcatatctgaagaagatactgttatgactaagaagatactgttatgactaagaagttactgttatgactaagttcacactgagatgagaaaactctcagagaatacctttttaatcattacaggtagggaggagaagggaacagaagcaacaaacatctgttcatattttgagagactggggagataccagttacaaccaaaaccatcttcgaggcaaaaggggctagataatgatgagtcatgaaacacaattttatgatgaatttatggaaagttgtagcctttagttatattagcaaagaaggtaaatattttccataaagagaaaagtcagcaccactctactctgggctgagatataattaccttccagcttttaaaagggaattttctccttagtgggtggcagtcagaggaatcaagaggtttttatcttttgagtttttaatttcatatatacatatctatatatattttagagagtgggtcttgctctgtcacccaggctggagtgcactggcatgatcttagctcattacatcctcgacttcccaggctcaagtgatcccctcacctcagcctcccaagcggctgggactacaggtgtgcaccaccacacccagctaattttttttgttgttaatttttttgtagagacagagtctttctatgttgcccaggctagtttcgaactcctgggctcaagtgatcctcctgccttggcctcccaaaatgctgggattacaggtgtgagccactgcacctggccttgaggtttttaaaagagaactctgaagacattgggtttccagaattagaaaaatgtatagtcattttaatgtgacattttcatttagtcttttttttatttttatttatttatttttttgaggagtctcgccctgtcacccaggttggagtgcagtggcacaatctcagctcactgcaacctccacccccggggttcaagcaattctcctgcctcagcctccctagtagctgggattacaagcatgcagtaccacgcacagctaatttttgtatttttagtagaaacgaggtttcgccatgttggccaggctggtctcaaactcctgacctcaggtgatccacccgcctaggcctcccaaagtgctgggattacaggcatgagccactgcacccggctcatttagtcttaaaacatttcaaatatgtcaactaaacctacggagaagataagcatatctgaagaagacactgttatgattaagttcaacttaattttttaattagaccataaatagatttgtggggggtacatctgcagcccaagggcttttggggttctatagctacaacaataggcaaggatggatttttcatctcctttctatcaaggtttgaatgtttcctctgagtctttccacccagagaaccctagacttctttcagttaccactcctttcctcactattgaccacttctgagccccatattttgggagctgaaaagtaagtagtgccttggagagggaagacaaaaagggaaagggagcccagcaaaggttcattcaaggctcacatgtgcatcccctactggtagctgcctcttgccatccccacagcataagccctcccctcctcacccctgcccaaggctgcagagcgccatcacagggcctctgttccatgcccgctgagtctgccagctcacaccttccataatctgcctcaccctgcaccttccccaacccgcccaactctcaaccatcgatctgttcattgcttattttaaaagcagccttttcaaccacatttttcattcagtcattaggacaaccatgctaaagcaaccctacagtagacgcccttggctttaagcagaactggtgcagaataaaaatgtcaggcctttttttcaaaattcattaagaatttcaagacagcagcagcagagcattaaaccaaacacaaggctcttctaggcatgtggccccgtgcacagactgcaggcccatgcagccagccttggctgtaaggggcccaagtgagttgaaagttggtcatctactaaatacactgatatatttaaaactcagtatcatattattggaacactaacaaaattgcacttcaatcaaactgactagattttatccaaaaatctagtgtagtgacacaggcacacatattttaatttggtgctggaattccacaactgtgcgatagattctctaagtgttcaagcacatctgtactcttatttaaaagaaaatataactccataggcatttctgatactcaatcaacattaaaaaccattggaaaatagatgcctgcattccacctctaaagtgtctgatacactaatgaaagaataacaagcttcacaaagctattgggaaggaaatgagatttatatgtgaaattagactatgcactataaagtagtaaataaatgtaagctattgttcttatttaaatttaatggtgataaagacagaacgagccttcaacttaatcttataggtagtcaagtatcattatccgttggatatgttgaatatgttacatgaatggcagaagaaggaggggaaggaagtggtatcgatgagaatagtttagaccatgtaagacgtttagaagtacaaaagtaaaaatttcatgaggacctagtgtgtttggacactcccctgtgaccccctacctctaccccaccccaacatttcattgtcagtgctgggtacatagtaggtggctcaggagaaatttgcaaatgaaagaaaagaaaggcctgctctaggcaaaggtttcaaaggtttatggtaggcatggacttctccatctattatgtttcattttctgcagtataacctgagttgtattatactattatactattctcttgctgtctagaggctccaaagcagactcatcagaacctccccaaggcctaatctttacctgctggttatttcagaacccctgctccttatcaaaaggaaaggatcctatgtcctattcctgcaggattgttccatactccttgaagcactccaaaagacagaccaagtaatgactatatcgggcactggctgtgcccgatatatgtggctggctgttttaaattaacccgtgtcacctcctgcctggtctgtatagggtcaacactaagggggaatgtatgtgtctccttggaaaagatagccctagaggccgcctatgattttatgaaatccaagttttgtaaaggctttgtgataaagctagctacagatagtatgctttactacaatatgggcattctcttagggtctaggatgcctttgtgactaaatgaaagagctgaattctgtagtcaataagagtcaacaccttagtaagatacttaatccctcagaaaggactgatgctgaaagtccctcagagaaaaatagagaattaaagcatgaaccaagatacccgccttgtttcacccctttgtttcacatgactaggatatgggtgctcattggaaccatcggttggaagaataacaggcttatctatttcttgatcatctttctcagtgtagagcccaggggactacagataacatgtctggttaacagtagccccctcttaaagaaaaaaggagaaagtcatgttttctcagttgaatttgaaaccaagatcactttattcactcaattaaaactgctattgtctgttccttggatagtttccctctgtattcataaggtcccttagtcctagattttcaaggtaatgttatttggttctcctctgtgagccaaatatacacagatatcaaagtgttactaatcctttaagaagccaggagtttaagctattactgagctttgaaaggttctcataacggaacttttgtttctgatcactgataatgtttttaatttggagttggagcagttccctctggtattaggtgcagctggagcagacagggcatgctattgttctaaagtagataggttctgggtaatgccgtttttggttgttttttttgtttttgtttttcaagacagggtctcactctgttgcccaggcttaccgaagccttgaagacttgaacctcctggactcaagctgtcctaccaccccagacgtccaagtagctgagatcacaggcgtgtaccaccatgctcggctattttttttttttttttttttttttttttttttgtagagacggggggatctccttatgttgtctaggctgatcttgaactcctgggctcaagtgatcctccaacctcagactcttaaagtgttaggatacaggcatgagccactgtgcctggcctaaaatgctatactgtcaagcagagtcctaaattttagccaaccatttatcacttccatgctttttatcatatttaccacctgaaattttactatttttctttaaatccattcagtgctatacttgaacaaatttattttactgctataaatggaaaactacttgttttaaactattcttaattgaaggtaataaaatacaatgaaaaccagtttaaaaatcctagctaggtaacatcttatggcaaagcttctgacaccaaggcctgtccctctttgtttgcaagggaaattaaccagggttgaggacatactaactcggtatttcagttttccttccgagaatatgaagggttgaaaagagaatcctttttctctcttcagtatttaaatgcttttcattccaagtagtcagcctatctttgaaaaactcaatccctttatattgtgtaaggaattaagtatttgacaggacttgtgtgaaaacccatttcttgaatgtaagaacaccccaagggagatagatggcactgtccctacacccatgaaatatgtcatctactgagggtcagaataaactgattaaaaagaaataataaatgtattgaagagtctgagaaatatgcaaatggttaacactagaatatgagcagcagaggaaaaaagatggagttttgtctgttttgttcactgatagatctctcactagctgttagaagaatgcttggcatatggtaggtatctgttgagtctaagaacacaaaccacattccccagtctcctagtggtgatataacactaaagatcaggagtgggaaataggttggcacaatctggagaaattaagagaagcaagatttggagagaatcttggagaaagttacagacacacacaatggcttagaacagaaagtacacaatacatacgaaaacaggtcaagtctcaccaaggtcgtgaccttatagcagccttaaaaatgcaaaataccctccagtttgaatgaatgctcccctttcctcagacctaaagccccattcccttattcacaagcatcacaaatttaaatatcacatacaccttacaaaatgagctgatgtttctgcaagacaaacttctatttccataaatgtgggttactttgagaaactcagtttcatgtaggtatgttagtttgaggatttttctgtgtcatttcaactactgaagtctcctaaagacttcaactattaaagttaagcagttgtgccatttttcatagttcccttgctatttttttgttaagtggagtcattgttcctctggtactaatttcgcatcacacaatttgttgctctagaaatagcaaaacgagaaatagattactgtgattataaatatgaagcagtaggtggaaactgaagctgtttctggcatttctcaccaaaacggccatggcctccaggtctgtctctctgtaagagggcagcacccctgaagacacagtgccacgtcaaggatgtgtgtgagctcctctgcctgcacaggctttgcgaaaggtttccgtttcagaaatacaatgccctgattttagtgtgggcatttcccatgttagttaagtgatactaaatctttaataattatagctggaaaatgttttttggaaagctgatttttatcttctttcacactaaggctaatttttaaatacagctaaataaggacttaggccaatccctgaaccaaaaagcaaggtatgaaccttaatttactgaaccacaaacctaacctcattttttaaaaactgaagtgctaacaacttttttttttaacacatatgtctagtgaagcaatagcaggaaccaacacttcatgttttctaaactgagtgaagtagcagtagcactgcaagatgatttttttaaatggaacttcaaactggagcttcatcgattctctgcctctgattgattgattaacttttagtgtctttgggaaggggtatgccagtgtctgaagtcctgaccaacctcttggactctgttaagtggaaaagaccaaaatttgtctgaactaagaaattatgtgtttctccgtttcaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaagtgactttggtttatttcatacattacactttttcttgcagaaaaaaataaaattgtacaactgcataaatataaaattcttccaccatgaaaatggttaaaacattcataaagacacagcaccagcatgtgatgcctccagaaaggaaaaaaggaaagtaaaagaaaatgtataaagcaaattaattagccctgtcactagccaaagtgatgggcagatccagatctcagacacagctttagaacataccggaggacaaggcaagagatgtcaagacagcattcaatacaagcataacacaacccatcacctttttgtgtttttctgtagtgtcacttaaaatttaaagggcagttcccccatgacaaacccccaccccagcccccaggaaaaaaataaaaataaagacctaacaccacaggaaaagactatggagtatgttaaaaatgctcatcgatgggccattacctttgaaagagccaaaaaacaaaaaaaaaaaaaaaaaaaaaattaccatgccagttttattcccgttgaatatttacaccttggacagcaaaccttgctcacataaagtagaaaacagatacaataaaacatggcttgaaaaatgaccagagtatgcacctgtagtactgtacactaaataaaatacacaaggcagcaatacttaggggccagaaacactgcttactacaagtcagttacggaatcataatttacagtaaaaatgggcacgtcccaaggctcaatttttctttttcttttgtcatttacagtagaataaatattttgttgctattgctacactttaatttacattctaacctattaaatgcagaaagctagtgtaaagcatatagattaagtgtaggtcccatacgtatgacagtttgttcaagactagtaggtttttgtttttgtatctttttttaacttattaaatggctagtgggaaagatttgtgcttgtgatcagctcttaacttcaatttttacatcaaaacgtccctgaaaacggtctttctcactgtacccaatgttctcaccgtacgccttacactctatgcgaatttcagtgtccatggtaagattggtgaactgtacggccagcaggggctgcaggtatttgggctgcaggagtttgccatagtacggataatactgcagaggaaaaccaggggagttgcccagtccaaaatactccacatttccaactttatccttatcttcatctcgctgaaatccagaatgaaatgaaattttaatggctcacatcatgcatcactatgtgtactcaaaaacaagactcaatctacacagtagtttgcaaactactgagagaggaaagaacatctactcagtctattccattgcagccttgagaaatggtcataagaagagactattctcaatgtgcaaatggatggggaagctgagtcaaatgccaaataagcattcttcaagcctcctagaaacaaggccaacattgaaaggcagaaacaccttgctgttggcccagtaaatgatctgtctagtgatattatctccaaagtttactacttgcctctcattttcttgttgagaaatcaatctccacttccttgcttggtgctagcactgtctgggaactccctttctttgttctgcctttctctctaaacggtccattagtttttggatccaaaggaaacatgcactaattgttaccttagtctttcaattttttttttttttttttttttttttgagatagtcttgctctgtccccaggctggagtgcaatggcgtgatctcagctcactgcaacctccgcctcccaggtccaagcgattctcctgcctcaggtcctcagctgggattacaggcacgcgccgccacgcccagctaatttttgtatgtgtagtagagacagggtttcaccatgttggccaggctggtctcaaactcttgacctcattatctgcccatctcggcctcccaaagtgctaggattac

SEQ ID NO: 16102 - DNA, 36661 bp, Human
actgatgagaaatgggaaatactatgtgcttaagagatgcccaaaggtttcaaaaaatttgaaaagccaaatcatcaacggatgcatggaatgggtaatgagcacatgaaaagatgctcaaaatcatggatcattagagaaatgaaaatcacaaccacactgaaatatcactacaaacctatttgaatagctaaaattttttaatggcaattttctggtagtggtgggcaatggtatcaccactttggaaatcagctaggtagtttcttgctttcttttttttttttttttgagacggagtctcgctctgtagcccaggctggagtgcagtggcacaatctcggctcactgcaagctccgcttctcgggttcacgccattctcctgtctcagcctcccgagtagctgggactacaggcgcccgccactaagcctggctaattttttgtatttttagtagaggcggggtttcaccatgttagccaggatggtctcgatctcctgacctcgtgatccgcccgcctcggcctcctaaagtgctgggattacaagcatgagccaccacacccggcctcagtagtttcttttaaagttaaacatacattaccttgtgaaccagcaatctcactcctaggtattgacccaaatgaaataaaaatttgttcacacaaaaacctatacatagatgtttatatcaactttataattacatttatgtaattcattatataaaatataatgaatataaaattcattacataaaaagtaatgaattttcaaaaactggaaacaacccaaatgtctttcaactagtaaatgtataaacaatctgtggtacatccatgctatggaatattactcaacaataacaagaaacaaaatactaacacatacaatgagatgttgaattttaaaatggatgaaccttaaaagcattatgctaagtgaaagatggacatgaaaggctacgtgtggtatgattccatttacttgacattctggaaaaggcaaaaccatagagacagaaagtaaatcagtggttaccaatggctgggtgtttgggaagatttgactgcaaagggatataaggggatgttttggattgatggaactgttctaagtcttgattagggtgctggctatgttactgtacattatgtattttaaaaggtgaattaattatatgtaaattataactcaatgaaaagaaaattcaatgtgagggcaaaaatactgaaggataaatagggggtttatttagattaaacccattacattttgagagcagagcacactttctagacttgactgggtccaatttcagcagcatggtagaatgcttaagtgtagaaatcatatccaacttatctccccatgggcccatagtacttccttatgcaacttatgagttctcagagtagccctgcaaactggtatacccgcgcttatactcaagggttaaaaagtgttggattgacaacttaaaaaaaaaaacaggcattcagccttacagaaatcctagatggctctgttacttcagtctatgatttcggtattttgaaatcactgtctgggtatttgtgtggcccggaaggctagtttggagaacaaatacaggggtttgctagtagcgggtagggtaggacagaaaggggtgaggtgctgaaaggtgagggacaaatatgctactaatcagtgtttttcaagtgaatatttctacagggtagagcagcagttggcttttataatctagatacaaagttgttctttctccagggagcttcttagacttacatgctgctggtatattcctagaattccaccttaaaacaagctgaatgtccttatggctgacatctcagcatggaaaagttttgcttaagcaatgacacactgcagttggatccttctcacccacatctggaagccacatgtcagcggcagctatataaaacggtcagaccagcaatcttagagtgacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacaccacagagcctcggggaacccacggagtgctggtgggaggagatcaacagggctggcatggaatggtaagggccagtccctgcactgcactggggctgggaacatctctgcatatccctcctcctgggggctgctagactctcaaggaatatcagtaaccaaagcctgggcaaatcccaccccaaacctcaccactgcatgctctgggtggagcagggctgctgctgagcagactacatgacaggacaaaaacctgggatggggagtgtctgtgggagacagactcctctgtggctctgttccttccagaagctgttctacctactctcagtttgggccaggggctggtgtaggtcggcgagaagcttgcttaccagactaccaaaagatatgtacagaaactgaaagtaataaactttatagaaattaaaactttctgtgccatcggaatggcatttttcttttttagaaatttatttttaccattttacaaaagtactggcccacagtagtttgggaacaagaaaaataaacaattgatctctcagcacggagggtttgagaactattgatttagagcaagtgaatggaaaagaggggacaaggacatttaggcaaaagaaagtggaattaaatagctgtctactgccttgattaaatgtgctctctcaattatgagtactgaggtccttctctctgcctgaatttaaagtgggttttattgctggaaaatagtttactaaagggttttggagagaggtgctgtcttcccctgactgcattctgccctaagcagtggcatggaattttttcgagcttgtacttttttgtggggtgtgattgtctcagctgggtctcagcccaggtgcttggtcaggagctcatcctagtaggcactgactgctaggctgattatttacaacagcctagatggagccagcactctaggaggcttggaggagagaacggaggaggcagtccagggaggaggaagcccacctggagggctgctgcatgtgctatctgtagagcaacccagatgtgtggcaacaagtacttagtgtagtggggattggaggggtcaagcacaaaatctggccaggtgtggtggctcacgcctgtaatcccaaacactttgggaggctggggagggaggatcacttgagatcaagagttcgagaccagcctagggaacacagccagaccctatctctacagaaaaaaaagaaattagcccggtgtagttgcatgcagcctgtggtcccagctactcaggaggctaaggtaggaggatcacttgagcccagggagtcgaggctgcagtgagccatgctcgcaccactgtattccctcctgggtggcagagcaagactctgcctcaaaaaaaaaaaaaaagaaaatagaaaaaagaaaaagcatagaaccctgggggacacaaccagtagagaggtgatgatgggaaatccaagaggaagaaacaccgatgggtgggggagccaggaaagagagcgggcctttaagtaatgacaacagctaccatttattgagtgcttaccctgagcaggctccatgctaagtgctttatgtggatcatctcgtgtaatgctcaaaacaagggtatatgccatttataggtagacaaactgcagtctagagatccagtatttcctcggctagaaagctggggtttggatccacagagtctttgcttcaaagagtttgtactttgccacagtgacgggctcctgagaggctgctgcctccacccagagtgggctcccacccgacagctgactctgtcagcagagccagtgccacaggaccagattcagggcagttcttcctcctggagagggtggggacctgcaagaccacagcagaagcccagccccagagggatgatccctacttggttaccaggactgtggaggggctcagccggactgtagaaggggtggggagaggactcacacaggcagcagcaggtgagggtgccggggctgtggaggctgcttggacagcctttgtgggccattctcatccacccccatggcctctggtgagcagatttagttattcaaaaccccttctgacagatgctgattcagagaccaggctcaccttgattgttgtctccatgactcctcacagccaggcccactgcctaatgtggagcatggcaatgacctaattacaactgtccctccagtcctcacctctcaggagcactatcgcatgggtgcgactcctttctaacagccgttttttgtgccacagtcaagcagcactcagccatggttccccaagccatagaggaagagccctaggctctgaatcaggaggcctgggtctggatcctggttctaatgacttgtggtgtgaccttggcccagacgctcagccctccagtctcccgcctcatttggaaagtgagcagtcaggctgcatgatctctgaaggctccacagagctgtggctcacccctgaaaacactcttggctttttcttgcattctgttgatctttgtgttcatccctgctagagagagaagccaaatgatgtttagttttaaacttgccaactgtgactggtttgtcatgaactcccaaactatttgaagaaaagcaaaagaggaagaaggtgaaataacatgattttatttggcccatgggagtcaagggaaaagctgataggcgagatacctcttccacctcctcttactcggcatttttgggtgtgcagtgtctagtaattttggtttcctttcctccttccaccctctgttgcctccttctccccgtctactaatcacagggttgaaaactcacaaacatgcaaaacaacttctttacaataagatccagctgccccaggactgacacgaattaccctggaagcacttttaaaaatgattatgcctttgagttcagcctccagtctcagtgaaaaatctgtaaggaaagaaattgcttatgggctggggagctattacatctgacgttggctacaggcttagtctgttctcagggaacagttgttgatggttttgtgcagttgggctgccttgtataaccaaattagctttcaggtttattttaaaagaggggaggagtctcgaatataggtttgacaatagcacataggatctgctaaaaagaaaatctttctaatcaaagtgccatctttaaaaggtgttgccatcatagctgagtggtctgtggtgctgccattgatcacagtttctctgttgaaaatcacctcttcaagtgccggcttctgaagtttggatgatggtctctggcactaacaactaccaggaggccttacctgggtccccatgagtggtatttcaccatcccagggcatgcctaggttgttctcagggaatctgctctaacttgggtcagcacaggctgtagggcactgggtcctgtgtggaataagatgaaggtgaaattttctagtgagattgagctactgtgtagcggaaggagccctgggcttggatgcaggaaacctggattcacagctcctgcttgtatctgtgacattcggtatctcattctggcaaaaaagaaagagaagaaagaaagaaagagagagagagaaggaagggagggagggaggaaggaaggattgaaggaaggaaggaaagaaggaaggaagaaaggaagggaaagagaaaggaaaggaaaggaaaggaaaggaaaggaaaggaaaggaaaggaatggaaaggaaagaaaagcaaaggaagaaaaaggaaggtgtgactcccacctcacaagctgctacttgtgttactgtgatacttgtaggataaagtataagaaaactctaaagcaaattgaagtctaaaacaaatgcctagcacatcatgggcaggtagtaaaagtttagtgaatctgaaattgatgtggctgatgttgggcaagccagctttccacggagtctgagttcagaggaaaagtgttccatttattggtatctactttttaccccgggcttcaaagaatctcaaggagaagttttggagtggcagtttgtgttagagctgagtttatgaattcaatgacaagccacagactggagaagaggagaaagaatctatgcaacagggctatggcagcatcgaggtgcatttgaaggtggagaggttgggtgggaactccgttttccatggtcggactatttccctaatctaagcaagaccaagcctcagtgtagttcagggcagtcgtcctgagtcatggttctgagtattgagtactcacagggcccacttcctcggggatgctttccaagaccacctcctctccccacacatctcgctgtctccactccctcagcctgctttgtttcctacaatgcccttgtcactacctgattggcatttgtttcttgttttgtctccctcactaaaatataagcttcatgaacacaggggctttgtctcattcaccactgtatccccagtgcctagacaagtgctggtacataacaggccctcaatacatatgcagtgaaagaccaaatcagcagtccaaaccccagccagtgtccccacggccctccgcaaggaggcctgcaggttttcccacaggggaaccattttgcttatgtctttgattcccaatattccagtgtctatagtaggggttccaactgtattgttcacatctcattttgatttattgcatttaccaacatgcaggatggtctttcaagatttcttaaggatcgctaaaacatgcacagaggatggctgacacactttgccgccgcagaatgaagtttttatcaggttttcattctctcaataatcttaaggtctcgatcaatttcaaaaattgaaagtaaactctttatttcaaaagccataagggctaaatgctgcacagtaacctatcctggtttgacatttgtggaagaactgatgaaatcagtttggtgttataccaaggttaatttcttagcatttcttagcattcctagacactctagagttatgaaaattaacattagaggaacctgggtgaagagtatacatgaattttgtgtgctgtctttacaagcattctgtaaatctgaaattacttcaaaataaaatttaaaaaaataaatataaggatgcagcacaaatatagtacaacagaatcgtggaattccagcactggagggggtcttgggcacaatctagagcaacctccttacctcacagaataggaataaaggccatgagactgaagcaattaaaaactgaataaaaacattgctgtcaggttaggaactgtcatcctctttttacaaaagtagatataaatatcagtagaaggggagagatgggtcatggagcaattctgtttggaattaggagagaaatccataactttacataagtataggttctatggccctaaccctgatctacgtggtgatttatgatttatagagtattcctcatttatatgttcatttgtttattcattcactaccaaatgcttattagcacaaactttcccaggccccaggaagatggagatgaataacatacagtctatgcccatgagttattcaaaagctaatattgtttgatcttcacaacagtattggaatccaggtgtttcacacatgaggaggttgcccttgcatggctagcagatggcagacggaggacctgagccagccagcctgattccacagtgctgtgggtgatatgaaatgctgatgttatttttgttcctggataaagccatagtgagtgctgacctaaaaaagatatcaaatccacctaaggatgacttctgagggcaagaaggctgagtgtgggagaatagggttatgacagatctaggattcttgccaactttccatctaggtcactctcctaagtgctaggaatcaattgtctgggggaacttgagctctgcaaaaatggttgttggctgctcttgtaaggatggcaaaagctccctcctcccaggaggggatttgcttctgtctgggaacctgcaggacacaatcttctcaatcaataagagatttctgcagagttaagatatcgtgtgtgtgtgtgtgtgtgtgtgtgtgtttctttgagggatcttgaagtattgaaaagttaatgaagtttagagtcagaacaattctcaaaatgcagccccactgaccccactactacctttactcaagtcgtctcaactccgaaatactcagctttcacaactaaaacacacctccctagaactgttgttgtgagaattaaataagataatatatgtacattaacttgtgtccttaggggaattacttaccttctctaaacctaagtttccttatacgtaaaatggtgatcgtggtgagaagctcattatttgaacccattttataggattgttttgataattaaaataattaatgcacgcatagtgctaagcacaatgcctgcacattgcaagtccttgataaaggttatttattattactttatcatgactactctgtgtaaactgagactcatggagacaagtatcacacagttggtaaattacaaagctggagttgaaaaccaaattgctagattacagagcctctgaaatatatcattttgcttttggaacatataatttaatcacaatctataaatattatgtgtacattataagtgtcttgaatatttattacattttaatagacacggagatagcattagatctcttgtttaaaaatattataattgatattcataaactcacgtcaaatttactgtgatgctaatgtagctcatgcaattcctgtgtgacctggaattgctctcaggacataaatgcatctcacaagataatctagatcttctcagaggccttaggggaagcctctcctgcctgtatttttccaaaaaaaactgaggaatttgtatttttggaggcattctcgctctgtcctgtgctaggtctttctatccagagatgctgttctgcaggtcatttctgcttcactgttaaaaccttgtagacagactagcagacttaaaacctggacatggagaagacagcagaattcttacccagatgcaggcaggaagagagcagaatgtgtgcaacttaacactatttaaagagactgttcatatccccaccatggtggcaggaggatgagcagtaaacggtgcagtgttcaaaaactttgcattgtagccccatgaggctactcagtgacagtatgtgttaggtgaaatgtgtaatggtgatatcaacatgtcacaaggaaggaaagttagtatgatttggaattgtcaagaaaggaaggatctttgaaggaggagaggcttggtattgccttttgtgctctgatatgtgctttctgaggctcctctcagtgtctaattggagaagttcaatcctgacaatttctaatgtaggctccaatatttactgaaagtgatgtttcgtgactaggatgtagcctgtctttctatcagattacaggtacttttatcatcatggtagtaataactatgacttcccctgcctttcaattatatacgttgtgccaggttctatgctacacttgatatatagcatctctttagtttttgtgtaatactgtcaggttaagaactgtcatcctagttttacagaagtaggtataaatatcagcagaaggggagagatgggtcatggaacaattctgtttggaattagcagagaaatccagaactttgaaggcttcttttactgggcaaacttgcccccaactgtgtttgtctctgtcccttgccacttcactgctccactgtccccaaccactctcctatttctctgctcctctgtctttggtaccagtctacttatttccagtatctgtattatcatagtgtctgcttatcagttacagtgtctggtaattctgcctgtccaatgtcatagtgtttacttatcagtaccagtcttctgaagagattccagaccaagtgcagcatcaggtatagagtaagttctagtgaatatttgtcaaaagacttaatgaacattctaaaattctgtgggcctttttataaatgcctgatagcaactcaaagaattattctggggaaaatagaattaacaaaaatcaaagctttactctaaaagaaagaaactcttttggtactatttaagacctcatccacctttggggcgggaaagaaatttgggagtgttaaggatgctgtgccacatggagtgagccacttgtctagatcatgggcaaaacttctcatagtccatctctgcagtggggttggaaactggctaacagcccttgaaacacctgtgtgtctgtgaagctgggaaaaaaaagaccagcacaaccagcccatctattatctatttaatgaaattttgagagttcttgaccaagatggtgctgcttccttttaccttgttcatcacttgactcaaccccacaccacaccacctaaagtccaaacttcttagcaagtccaacttctaaaattgtatagaggggttcaccaacaaaaccagacactcacacaccttgcaaatgctctgtaattctgcctgtccaatagctttggacttggtaaagaatgcagacaacaagaagaagtcctgtccagcataccaatcagagctgtgggaccatctcgaagagatttattatatttcttgagagctcatgaacatgagctttgacctcagatgaatctgagttgggtcctggctcttccagttactctcttggccgagagttttgtaggcattatcactgactccacacagtgccttaggtgaggctccacaaagcatgtaaaggtcagggctaggactagaactcatgtctgctgattcctcaacaagggctctttcccctgcaccccactgctgttatgttttactattgcagatacaggagaaagtcttccgttttagctttcagggtgatgaccctgagataaatcattttcagaaagtccactttctcagaataggttcacaaatgtgttttcagaggaggagtaattaccttgtgactttccttctagaaagcttccagtttcagatggagcagggctaacaatactccagtttctgaaactgaaattgaacctcagccttcaaagaggtggtaagaaaaaaaaaaagtatgtcttctcagatgggaaggagagtcttgtaagtaaggtaccagtgccctcctgctctaaggaaatagtcttatttccttagagctgcggtcatgttatacaattcaccaggatattagccatcgtattggtgactgttaggaactcctcactcacatccatgaaggggcctgaaactccctccaagtagtttccctccaagcggaatagagcattgagccactgccctgttctccaggccattcaggagcaacaaccaggtgctgtgaagtgagtcagagcattagtcatttgaccgctacccatctcttttgaaattgagtttgagtaactttagcaatgcaatccctgacagttcccccagtcctgttccatttagaagttgcctctcttctcacctagctctgtgtttgtaatcctgcagctatggccagtgtttaggtgagtcttgttaaataaggagctttgttaaaagtgaaaatgagaggaatggaggagaggaatgcccaaagctatatttattttgccccctcatcatggagctgcagggagagaacggaagcaagaaaagggattgctcacccaagatccatgtaaactacttggagggagtttcagggcccttaatggaattgagtgatgagctcttaaaagtcaattctgcctccaataatgggacatagtcgggtcactcattcggtccctcattcttctattaaacatttgctggacaacaatgtcagacactgcatggaatactacttcctgagagtggtaaggcatactaaagtacctgtgctccaaagtgggtggctaagacatccaacctcattgagctttgttttagggaaacagcagctcagggagggcctatgaatccaccagtgttttactgattagagacaggggagccaagggacagcttttacaaagtagactcataattactgtgtagactaaacataagtataatgacactaataagcaatttattaatcccaggaattttacatgcgttgtcttatttggtcttcacgataactttaatacatatgtgctattattatgcccattttacagatgaggaaactgaggctattagagggcacgaaacccgcccagatgatacagctaagaacagtggagccatccagcagcatagccaatgctcttggccactctactatctgctccccacagtgtgaaaaggtacccccacaaagatccggctctggaaggaatgctttcacataccaaactcctgaacaggctgactctaccaaaatgtgaaggcaatcaaaccaaagccggaggaggagggttatgtttggttatctaactttcactatatgttcttaggctctgagtctgtagggtccaaataatcttcacagggcagagttatctgaggtggtgtgtgagaaagtgacacacacttcccgtacaggcactggggccagcagcctggccaacagctggcggggaatttgtggaacttggattgccttcagaactggtactccatgaaacagttcggcttatcttcctacatttatttttacttaggggaacttacccccatgggagctctgtcccctataggggtctgagtacagaagacaagccaaaacaatggaacaacaactccgtggaaaccacagcccagctcagttctgaaagggctttgttttagaggaaggcagcattttagtgatggtaggagaacaggtcacagagagcactagcttatggcaaccttctctttttggacacatatgagttttgcttatgattcttagagcttcatattgaaattacctctcacctactttactaagaattaggatagaatagaacaccctggtagatcagcccctaaagctacctttccaccatatcatgagcctagtccattccactcatatagcttgctgaagtatgccaggcatttacaaagtgattagtatactcctgatgagatgcgagcaatggtagaatgaagaaggctacatcagtcatatgcagaaaactgaaactggaccccttccttacaccttatacaaaaattaactcaagattaattaaagacttaaaggtaaaaacccaaaaccataaaaaccccagaagaaaacctagacaacaccattcaggacacaggcatggacaaagacttcataataaaaaacaccaaaagcaattgcaacaaaagctaaaattgacaaatgggatctaattgaactaaagagcatgtgcataccaaaaggaactatcatcagagtgaacaggcaacctactgaatgggagaatatttttgcaaactacccatctgacaaaggtctaacatccagaatctacaaggaaattaaacaaatttacaagaaaagaagaaacaatcccatcaaaaagtggacaaagtatatgaccagacacttctcaaaagaagacatttatgtggccaacaaacatatgaaaaaaagctcaacctcactgatcattagagaaatgcaaatcaaaaccacaataagataccatctcatgccagtcaaaatggtgtttattaaaaagccaagaaccaacagatgctggcgaggctgtgaagaaataggaattcttttacactgttggtcggaatgtaaattagttcaaccattgtagaaggcaatgtggtgattcctcaaggatctagaacaagaaataccatttgacccaacaatcccattaatgggtatatacccaaaggactataaattattctactgtaaagacacatgcacaggtatgtttactgcagcactatttgcaataacaaagacatggaaccaacccaaatgcccatccgtgatagactggataaagcaaatgtggtacatatacaccatggaatactatgtagccataaaaatgaatgagatcatgtcctttgcagggacatggatgaagctagaagccatcatcctcagcaaactaacacaggaacagaaaaccaaacagtgaatgctctcactcataagtggaagttgaacaatgagaacacattgacacagggaggggaacaacacacactgggaccagtcgggggtagagtgtgaggagagggagagcattaggacaaatagctaatgcatgcgggccttaaaacctagatgacaggttgataggtgcagcaaaccacaatggcacacatatacctatgtaataaacctgtacattctgtacttgtatcccggaacttaaagtaaaataaaagaaaattgtaaaacctagatacatgtataataaactacacagttgcacataccaaaaaaaaaaagctagatcatcaaagagccataggtctcaatttacaccttaacctgcattactgagcccctatagctgagttttctagtctgccagaacttcttacaagtcctgggaacagggaattcaagctaatttacatggttgaccgaataccgagcccatctctcaattcttctcacaacataatagcaaagtgattgatacagaacagtagtagagtatgagatgtttaataaatgaatgaataaataaataaataaataaatgcatatttgaattatatacattaggtgaataaatgaataacaagtaataaataataaatttaaaaggacggatgatttctgatgacagacaagtaatatatttaatatctaattttgttagatctgcaagttcattttcagcaatggaaaagaataaatgaaatccacttgttgataatgttacaatttgtgtgtcaacaaggcctctctcaccagtcagcacacggtacttactttatgcattatattttctgaaaacttatcttcccatgaaatacaaggttgcattccagcagctgtctggccatgcacatagacaactgcctgctctggctctgcccactcataagaggggatagaccaatggctgggatggtgggaaatgcaaagaaggagaggtaactgaagaactattttggaagggtttgtgaaagagctcatgctataaggtggaaatccactggatttcatcaaagggccatggctcaccatacccatctgggctttgcatgctgtgtgggggcagaacaaatgatcatccttgtgctcaatttccagggctctgctgttaagcagaagaaatgtttatttgaaattcgtcaatacattgtgcttctctttgtcttctttttattttaaattccagtaaaatgaattataatatcttttattttaaatgacatgcataatacaatcttgaatttgtaaaattctagatgtaaaattctagatcctggataagtagcaagaacagtggaaatgccctgactgtgtagagcttatggtcttgtgggtggtggaaagattcctggataagtagcaagaacagtggaaatccactgtggtcaggtagaaaatagtgttatcatcacagcaaaaagtgggaagcctgaagacgccataggaattgggcccaggaatgggagaaaatcatactagagatggaacaaaggaagaaatgattgtactattctaagtcaatgtttagttcaaaaggtgctgtgaagaccagcagcagcacaggtagaatgaaagagcaaaaattatttcttgtctgtggactggagtggagcggttatatatttgaagaattaggactaagcagctaggacaggaaagggatctttagagggggtttgaggcattcagttggcctgttgcaactctgtaaggactgcctccacagccaggattcttggtggccaccaggaatagaattctgagaaaaacatgccatggctgtgtagagcttatggtcttgtgggtggtagaaagattcctggataagtaggaagaatctgggttgtggtcccagctttcctactgggctgccctgggcacattcaccatgcccatctgggctttgcatgctgtgcaggggcagaacgaatgatcatccttgtgctcaatttccagggctcttctcttaggcagaagaaatgtttatttgaaattcatcaatacgttgtgcttctctttgtcttctttttattttaaattccagtaaaatgaattataataccttttattttaaatggcatgaataatacaatctcgaatttgtaaaattctagatgtaaaattctagatccacccatttatgcaggcttccatctaacaatatatattgaaagaggtatgacaggggcagtgttccctaaattttgttcagttagaaaattctgagtcacttaaattttaatggaggggctatgttatttctacaaatataataaagactattatttgcataaaatggaataaattgttaagaatctaggtcagagaaagagtgtgtaactgtggcagtggggtcttgggaaggggtctgtgtatgtgtcactgttcttaggttcctggggttgtcttctcttcaggtaccagacgtgctccaacaatgggctggtggcaggattccagagccgctacttcgagtcagtgctggatcgggagtggcagttttactgttgtcgctacagcaagaggtgcccatattcctgctggtgagtctggcagccgaccaaaccctcatgactcctggggtgggagaggcacctaggaagtgctctagcttcaggtaagcttgagggtcacacacaagcctggaaggcagcgctggcatatagacaagaatgaatgaatgacttaggaggatgttcccgccaagagggatctttcaggttatccaaccccccacatccttcttttggcagaaaaggaaacagaaccatagagccggcactgactggcccaaagtcacccacctactctgtgggaatgccaagtcttaagcttaggcctaatgactcccatcccagtgctgttctccttctccccaacttctggtaacttctcatcatatccaaggctgcagggcctatttgggaacctagtttcctgtagtctttctctgggagaaaccaatcctctcatgggtcagagtctagtacatagttatagacagaaaaaataaaatattaaaaaattaaaaaattaaaaaaaaagattgtgctgttttctggatccatttggaattccagcctctgatgttttgtttctttccctatccctgggctcatgccgaatatctcctgacctagccttccaattgactaggagaatgtgtatattgtcatttgccctgatgacttacactgggtgttgataacacaaccggcccaggtttttttaatctgaaaatgagccaggcatttctgccttgggcaaggggatccagaagtgtcaacatgtgaaggttggctccctcaagtgattgatctctctacagtttgatgcttgcaaggacagcttcacaggtcatgcttattctctgcaatcagacagcttactccacagatgcccagtggcacacagtatctctagggatacaaagccccaaaagcttaacgtttttctttttaaagtaaggaccgatagtaaattcagagctcaaagtcacctgtcactgtatgatggagcagaaacctcctctagttcttcaaaatcgcttccataaagcagcttttactcctctacagtgggtgaacaggcctggcaaaggattacgatgccactgggataggtcctgaaccaaagacctaaagatctcttgcagtggaggaggtagaaggagcaccagtttgggcaaaaagaaacttgagtttcagtctctgtgttggcctttcctcacttccctcccttctttcccctttccccttctcccctccctctcataactctgcaggctcaagcacatcacctaaaatgatgaccaccttttttgagtctccaagatctttaagactctgatgaaaactatagaccttgtcttcaggggggaaaatgcacttagcatgttaatacaatagtttgcagagaatttcgggagtccttaaactccctgaaggccattcatgaacacactgccaagaacccctggatcataagttgaaattccaaggactagaagatctttcaggttgtgttgaaccctaaaaatgtcttaattccaaagacacttttggaaaagatgatccagatgccagaactgttttgagaggatgaaggaagttccaaagacgagtgcgccctaatgaaaggggagagtaggtaggagcttggcctccacaaatctctcattcctggtctattaacagaatggcacttcccacaaggaaaccagcctccctttgttgcaaagcattaaaagccagttaaaatgtatgtaaattacctgaaagagcaagcaaaacctaatactcagtcagtgaatttatttactacattagtataactttccctgaatcagactccaaaggaacacatcagggctggggtatgctgggtggccaggaggagtgggttcaggagcaggggaaagagtgaggaggtgaggaggtagccctgcacgggctgcagtggggaggaaggggaacatggacagcctaggggcagctggaggcctggatgttggtggctctgtctctctgcccttcgtagatgcctctgtcacagcactttatgcattttaccacctgtgtacagttgctcctctctacctggacttccagtgtctggaggatatggggccactcactgatctttgtattttcaatgcccagtatagtgcttggaacatagtgtcttcttaacaactgttgaacaaatatccacattaataattgtggagggtgtatataatgtgaagtggcccagaaaatataattctcttacataaaattttttgttctctcccccatccctccacttctgcccagaatataagctctacacaagcagagatctttgtgctgacatatgccaagccctataaataatgacaggcacataacatttgtttggatgaaggaatgacttcaggctactttttgttatgagcattaaataagataatatatttctggccttgccactgtctatgatcacacagagctgacctgtcttgaaacagagtccccttcaccctcccagatgcaggagagacccagcctcctcaccaactaacaggacattcaaaggcaaactctgcccaggaacaacctagcaggtgtcaggtcattgcaggaagcagaacttgagagcggggttggttatgcagaggaacaagacatgtgaccagttggacagtctgttgttagatgtactaactcattcttccccaggcagagaggagtaagctgaggcagcaacattcctcatcacagcaaggctcgaggtctctgcagagatgagtgggagagcctgctgtgtctgtggccatgccatcatggttggctggcccctgcccaaacagaacaacaacagatagtgggcttgggcctcaaggctttgggtgaccaggcaggcaaggagctaaggctcactggttttagaaaatttgtcaaggccgggcatggtggctcacacttgtaatcccagcactttgggaggccgaagtgggcagatcacaaggtcaggagatcgagaccatgctggctaacatgatgaaaccccgttctctactaaaaatacaaaaaaaaaaaaaattagccaggcttggtggcaggcacctgtagtccctgctactcaggaggctgaggcaggagaatggcatgaacccaggaggtggagctcgcagtgagccgagatcacgccactgcactccagcctgggcgacagagcaagactctgactcaaaaaaaaagaagaagaagaaaaaaaaaagcaaagttgtcaaacagaagaaatagggggtggatgaaggtaagtgtgagagaaagggataaacatctaaattttcctggaattcccatattccgtggatctgtgggatctgtgttaacactctgagcattgcttcttgaagcttatcctgtctgtttatttgaatgctgagacctgaaaaagacaggtctttgtgtttccagttccaccgttgttttaatgatgccccagatttccagtggtcacctggagactggttccaggatacttctgcttccccaagaatgctaggtatcgttcctctcacatactttagaaaggcttctcaagctcccttagatgcaattcaccagctaagatgctaaaaatgtaatgatcatatagacatatatgtaggaacaaagtctcaatgttaaagattgatagataaagatgagcaattttgagttgccagagatattcatgtctctgctcacaaagtttacccaaagccttgatctgcaatgactttgccactctgaacccaccccaacccccatacccttcacccttccttaccccatcctaccatccagacatgttgctgttggtctgtggagccaaaaggtggggaaagtacagagaattaatccaaaaggcatgacaagtcaactttgaaacaagtcccactaaggtgtggttccacctggctggttctatttctgaaggcatggtgttagagctgagagctatcacggtcaccaaataaaatggtattttttcaaagaaaacattggagaagcagcagaacaagattcaagtgtgcaccatggtacacagtgtatgactcactatcccgctggtgtgtctagacattttagtggcatctttaaattgcctgagtcatgatgttgtattatatgtctttctaaatgcctccagggcataaattaggtcttattttttcaacatctccaggatattacccagcacaaaatagactcttaataaatgtgtcagatgaataactgaatgttgcaagcccctaggaacagtaacaatggtgaaacctgacattgatgtgatgatgttttatagttgacaaagacttctttcatgtacattattttatttgatccttttaacagccttacagagtgaagtgagaactctttttcctgcaccttcccacagtgaaatgctgataaccctcttatctgaaaccttcccttacatgactttaattagcttgaattacctcccagggaactggacccatgtgggtgggaacgacatttttccccttccctctttgaaaggcattcttcagcacgcagcctgacactgtatgaactagctaagtgaatatctagcgcctgcgtttgtgagcacttagggattcagaaatatcatcactctgggctggaaaaaacaaatcatccaaccaactcccaaatgagtatgagatttatttgtttggtgggaaccaaggtgctgctctcgtttcagcttgtgcggtttctctttggatattacagcctcactggactctggcaagaaagcaaattcctgagagatgtggacatgccattaggaaatggtctccactggattggatgaatagtgaattttatagatatttatttagatatgaaaattctaattcttagtctagtggtctgcaaaccacaaacacatgtcactgaagttgccacaaccctttagacattgtttgtcataatctctcttctccaaacagctcagcagctgcaggctgcacaccagactgtctactgtccaggcggagactctgtgtcccaggatctgatggttgtgaatcattttcttttccaaatggctcttctccagacccatggcctttcattaggttcattggataatatcttttgactgtaaaataatgcatccatttaggtaacctttacttttctcttcaaccctgatattctgtctctcagactttgcattctccactgcctacttccccactctctgtgtgcaagtcataagccagagagtgctttttttaaattcctgtatagctctagttaacatcagttgattagaacattcttatctctcccaccccaaagcacccagtcaaagctaatctttaattcttagcctctttgttcagatgttaatacaagatagggagtgtttgcatgttcactcctgtaatgctgttttagggacatgaacaatctcacaggcctctgcattgctgtgcctgtcatatgccacctgtgcccagacagcctcctgcaattcagctcccagaggcctggtaagaagagcagcttccattaggtatatctcctaatgttagttaacaggtgcagcacaccaacctggcgcatgtatacatatgtaacaaactgcacattgtgcacatgtaccctagaacttaaagtaaaataaaaaaataaaaatgaagagcagcttccatactggtcctctgcgcaagctggaagctattactatagagatggacatacttaagttttgaggaaattggactagatgtctcaatttaaaggaacttatattgggtttagatgctctgcgccctactaaaaccattgccttccattgcatgatgtacatagcactcattgtgcagacagcagcctctctgaacttgagcaaaatctatcatccctttcatctgctggaatggtttccataattattgtgccatatttaaaatgtagacatgtacaattggcactccatatctggggttccctatccaagaattcaaccaactttgaatcaaaaatattcagaaaaaaacaataaaaataaaaataacaatacaacaataaaaaatgatacaaatacaaaaccatatagtataataactactcacatagcatttgcattatcttaggtattatacgtaatctagaggtgatttaaagtaaacaggaggatattcataggttatgtgcaaatgctacaccattttagatcaaggacttgagtttctgaaaattttggtatccatgggggtcctggaatcaatcccctgcagatgccactgatgactgttgtattagtccattctcacactgctaataaagacatacccgagactgggtaacttaacaaaggaaacagtttaattgactcacagttccacagggctggggaggcctcaggaaacttacaaccatggcagaaggagaagcaaacatgtccttcacatgatggcaggaaaaaatgccaagcaaaagggggaaaagccccttataaaaccatcagatctcgtgagaactcactcacgatcatgagaacagcatgagagtgaccgtcctcttgattaaattacttcccactgggtcccttccatgacatgtggggattatggaaaccacaattcaaggtgacatttggttggggacacagagccaaaccatatcgactgtatttggtgcctgcattataggtgatacctctctccttatgttcaaacttcaaaagcagaaatatcatagatgtgtctggctaagtattggttaacccaaggccagctacttagaacaaagtaaacctctcagttacaaaccaaatctgatgctttattctatctagtctgcttccctctactataatagattctagaggcaatcattcttacttctatttattaattcacttaagcagtcaatgaatgtgaatggatatgaaataataacaattcataggctttgggtgagaccctactaatgataatgatgataataataatatttatttattgacacttaccacgtgttcctgtgttactgcatttaatcctcacacacaaaaattatgatactatcatacagatgagggaactgagctatagaagttgtggctcccttcaaagttccaaacttgactcaaccagtctatctgcctccaaatcccatgctctttgcatagtactgagctgtctctagatgaggaataagacttctacaggtgaaatattacataatagcacagtaggcatctggtagaaaacagagaataaaactattttaattggaggggagctgttgaaggtcaagtagcccccactgacatgcagacccagggtgaccaccacataatgtggctaatgaaaatcaacacgagtcaaagtgaatgtgcttactgactagccctgggcttggacagtgagttagaaactcagttccaagagagcaatttggaaagtgttcagggactttcctctactcatttaagctacagatatccctggaactgttattccttcgtgttgtgatacatgtctgaaatgtttgaaatgtaaagtcccaaaatgccataaaaggacagacatggacatttgtttttatttcacacacctcagagcccctgggttcagattttctgtgcagagaagggcacttgggtgactaccagaggtcccgcttggccaatccccagctcttgtgggaagaagcctggggattgttctctgtggctgttttcctttacacataactccatttggggtttattttttctgtctttacaaaactaattcaaagggggtctgatgtagctcctaataaagacaaactaaattaatctgaaatatgttcattccttatagcttacttggaaaagcattatgcaagaggattgatcatgaacagactggctttatttaacaaacttctcaatgatttgactgtcagaaagggacatctttttagctgaatatataaaacgtaagccaacctcaacacaccaaatccgcaaatgttgagtttctcctccaaacccacctctgaaccagatcataaaagcatatttgattccatgcaccagtgatccctcaaagagctcactatattggccatcatgatgttatacagtattctattatcttgctaaatatatagtgctgatgtattagtccattttcatgttgctgataaagacatacccaagactgggcaatttacaaaagaaagaggtttaatggagaactcacagttccatggctgaggaagcctcacaatcatggtggaaggcaaggaggagcaagccacatcttatgtggatggcagcaggcagaaagagagcttgtgcagggaaactctcatttttaaaaccatcagctctcatgtgacttattcactagtatgagaacaacacaggaaagacctgcccaaaggttcaattacctcccactggatccctctcacaacatctgagaattcaaaatgagatttgggtgagacacagccaaactgtatcagctgacatgtcacaggacattagaatgggatatttaaagtaaggtgctaattgagtggtagagaaatagaagaaaaacagaattcaatattgaatgaccaacagaagcttctctaaaatgttgtttgagcataagctgggctataaaagatcatttggaagacattctaattttattcttattttttaaaaagctgaagtatggcttcctcaggtacccgttctgatctgttcatatgtaaatgctggggtttttttccagtttttatggtagggagtctgtggtgtgtgcttttctggtgtccccacaaagtgggccaaggttggggatatgatgtttcctgaccatgagatgaagctgtatctgttcatgtgcacatcaattggagggaaagtcctgaaagaggagcttccaggtgacaccgactaatccagttgccctaatttccccaagtgaaacagctgtaacaaacacatctcagtgctatgaagtttgactttcatagaagaaaagtgtctagctccgaataaggtctcgtagaggtgggttttcacaaaaccttacgctgagtcactttatgtcaaggaatagattgaaaatctttactttaactattaaaaacctaataagttctcaacccaacctctgacaatgaataaaattggccactgtatataactagattgtatctctatttccctttctaaaatggatgtgagagcgtatacctggactcagctctgcaatatgtctgttcttgtggcaacggagccgagacatctatcagcagcagctcagtctatgatattgtatcatagcaaacattcattgagtccagttggatctgttaataattttagagcttcaagaatcttagatgagaaaaatcctatatcaatcttaaaattgtcttcagttcgaactgatttccctcagctcataagtaagatattattaatttttttaccatcagcttcagctgacacaagagttgtgcaagtggctttatgttatcaagttttttcttagctttggaacaactctctgtctttcatcttgacagcagaaaaagtgctgtgaagtgagaaactgtaccacaagagtcattcatctgaaagtgcgcatgcacacacacacacacaccccacacacacaccagtagttttgctttttttgttgttgttgttgtttgagacggagtctcgctctgtcgcccgggctggagtgcagtggcgcgatctcagctcactgcaagctccgcctcccgggttcacgccattctcctgcacagcagtagtttttattaaaaattaagtaatagctaaaattgaataaatctattcaaacactttactttaggggaaaggagaaaataaggcttcccatagaaatgtttgaaaagtagactcatttcaataaaggcatcttcctgacctgcgctcttcttcatcttgccaagctgaaggtttgtttgattgttttaattggtctaggaatgtatggcaatgctcagtatgaagtgtgtttttccaaaaaactgcttaaagtgacctagtaattcacaaggaattcacaaggaagctgcaaccacaccgaactcttccccgacctacactcgcaaagcccagtgtcacagcttaggaaaccctgatcattctgcttccttgtagcctcttttaatttcctgaaaagtccctatgccctgtctcagtgtctagttctgaacgtttaaattcttttttctctctaaggagctattactgggctttcacttattaggacactttgtgcgcgtgtgtgtgtgtgcgcgtgcacatgcagtgtcatcaagcgctaaatgcagccacatatatctggtttgaaaatacagaacagagcatcctgggccacattgactcaatagttcttcctatggatggtgtttgggaggttcactttctaccagtgatttgggtcatttctcccttggtatttttatttcataaagtaggagagatttccatcgatatccaacctccttccctatcctcctttacccaggtttctctaggacagtctaaactcaatcccatggtgttataacaaaaacaagacaaaataacaacaaccaaaagtcacacaaaacaaaacctgtctgggaccaagaagaaaaagtaccaatggtcatgcacctcaccttctctaggacattctagaaattcactggacatcagtacctcatggagaggcttctcggacaaactgtccagttagacagggggcttatgtctggtcactaccaaaaatgaagcaacagagaatcctaattaaagaaagcattaaataacattttccttctttgaagcttaaaacttcttgatgtttttaaaggtaagcttttctttcccactttattccgtgatatttatccaagtatctgaagacagatcagagtggtcagtaaaaacttaaaaaataaaaatctagcttcataatttccaaatacttttggcaattggatttagcttaatgcagtgttgctgtatgtagattctgccttagcaaaaaaaagaaaaaacacacaacttggtaattaatttttacacattgtatccagagatgcttcaaaagttttagaaaatattttttgttccctgaagtaaggaaaacacacaccccctcccacccccatgcaacctcttattctaatttgcattattgatgttctcaacaaacctctctttccttgggttaactttaatacagtccttgttagaattctcatggatcataaatcagtgggatccaagtaaggccctattagttctacttataagacatttaccatgctgggcgcagtggctcatacatgtaatcccggcactttgggaggctgaggcgggtggatcacttaaggtcaggagttccagaccagcctggccaacatggtgaaaccccgtccctattaaaaatacaaaaattagctgggtgtggtggcacacacctgtaatcccagctacctgggacactgaggcaggagaatcacttgaacccaggaggcggaagttgcagtgagccgagattgcaccagtgtgcaacagcctgggtgacagagtgagacttggtctcaaaaaaaaaaaaaaaaaaagacatttacctgaaaggtaaagtcctgcttctggatctctttagaagcacaaaataagtttctggatttgcaggaccttatttcccttcatgaactcgttaagcaaaaacacaggtacctcactttgggttggacttggcatcctgatagagcataattacgtcttaggaaaagtcaaatcagagaacaagggttagtgaataatgggtaaaaggaatgattatgaaccaagagaatgagctaaccattgatctttctccatctgtgcactgagatcctcctaggagcccttacagtttataaatcaatcttttcatgatttaatgacaatcttggagaaagatcaccatcagtctgcagaggagaagatctttctagcattaataaacagtgatctggtaaacccaaatcagatgaaattattgacactcacaaactagttgttttccaagcgtccctggggtgtggataaagactttggaggagctatttcatggtaaaaggactgttttggtcctgaaggttccagtggcaaagcccttatgagaactgggggattctagactttattccaggatggactaccatggacctactcatatgaaggctcaggatttactcaatattggaagagaaggaaaggaaaggaggaagaggaagaagaaacaaaatagttcttagtgattcaacacctaccatgtactagtatagcacactcatcactcatttttattagttccaatgacaaacctataaggtagactttattcttctacagatcagaaaacagattcattgactttccccaggccatatatttattcagctaatatttattatgtatgtgttttaggtgctggatgaacaatggtggacaaggcaaaaactctacctttggggagcttacattttaattaaataatttttgaacactttgttgactataactcacaataagaaacattaaactatcgcaatatgtacatcttataaacaaacacacatatatatttgaaacaaaatgtttacatacatagactcgtccttactgcatgtgatgcatgcttttatattttcttttctattttatgtctcttttaaagccaattaaattgattttgttatcaactaatgaatcataatctaaaatttgaaaacattgtcttagttgacttgaatagaataggaatagtattgatattaatcaatatcaagaattccaaagttattttgataattccaaagcctggggaggtatcttcatctttttcagtgcacagtttaatggcctagaaaaggaagatgagaagtgggaggagagctgtctgtttcttcacagcctggagttgtttggtggatgtcatttaacttcagtctggatttgccaggatgctcaaactccatctcttcttcatagtgtgtcttctgtttgctcccagcaataataatgtgtttcattttcctctaacctttgttcttcctgcataggctaacaacagaatatccaggtcactatggtgaggaaatggacatgatttcctacaattatgattactatatccgaggagcaacaaccactttctctgcagtggaaaggtgagaaagacagccccttcccaatgggctagggttaaaggagttgggactaactccctgcaaggattttacctgcaggaatttataaacacaaacacacacacacacacacacacacacacacacgtagaatacaagtgaaaatttcttacatgcacatatatttctgcaggaactttgacctgaggttttacttatcttagtttcctacctggtcaaggattaactgcagttttggctggaaaatgggaggcagtgggaagtgagctgttctcatgagctcacctcatggagctgctcaccttgcaagtgagggtggattccagcctgctcaagagcagagagtcctaaactcggtatcccttgatggtctaagcttttcccctcactcaatttcaaagagcacttttcctcatgaaacaccaagaggagaaggcaaatatgcttagaggagtgcccattgtcaaaatggacccccttccaccccgtgcctctatatcatccccactttgggttttaggaaagaagagagaagagaaagaaaagggattggagataagaaacacacagaacctactgtcttagtctgggctgctataccacattaccttagactgggtaacttacgaacaatagaaatttattttcacagttctggaagctggaaagtccaagatcaaggtgccagcaggttcagtgtctggtgaggggttgctcgctgcttcagagatgttgctttattactgtgtcctcacgcatggtggaaagggcaagccagctcccttcaacttattttatatgggcactaatcccattcatgagagcagagccctcatggcttaatcacccccctaaaggctcctcctcctaatactatcacattgagtattaggttccaatatataaattttaaggggacaccaacattcagaccatagcatctaccaaccatatttagaaatgaaaggagttaacaatccctcagtaaacctgcaaaaattaatgaaagaagagaatttaaatggcctaaagataaaaacagcactaacacttttttcatcacctttctctcacaatcaactccttaatcctatctcaaatacatcaaaacggtaagaagaaaacaagaattgtactccctattaatatagagaaatgtgtgggtaaattcaggtgttaatgattggtttggcctacttttagtcagccgataatcactttacacagaaatgaattcctgaaaagttaccaataaatattttgcaaaccaaataacacttacattaactcattagatagtatgctatgatgaatttgagtgtgacacatctttggtgtgtgtctgtgttttcaaacagaattacatcttaaataaagtgaacttatttaatatgacctagaatttcttttttttttttaaaaaaaaaaaagacattaagtagctctggaaaggcacaatatatgttgcaggctgatcagcaaaaacctttatgtttacccataggcaaaccactcagtttgcacacattacttatttttactttagatacactttaaactagcttagttaccaattttctagaagcagcaaattagaaagggaaacgagtatatactacttagaatgaaactcattccaccaatgagaataaatagctggatgacatgataacaaatatgcttaagaaaaataaagaaaatgaaaggctcaagaactcaaagaacatgggttgtcatttagcagggccatgctccccaaagtgcaaaacgaaataacaggggtgctcaatgctccaaatgatgacttcagctcaacaagaaaattagttctatgttccctgtttaagaaagcaggaattaatacagtaaaggaagagtgccatccaagattagtatgaaataaatatatctgagtagttaaaatgctcaattcagttttcagtaaattcactttttagtaaatttttcggttatgtggattacccagaatcatgaaaaactgaaatattatgtcattgcattaatttaaaatgagtatcctccccccaaaataaaataaaataaatatactcatgcaactttgctactgtcatcaaaaataagtagcttaatgatccacaacttgggtttcttctcctctgctgaaagatgctgaggtccccagcttggagaactattgtcagggcaggactccttgtgcaagagctttccctccacatgcaaatcatagtggtttcctcttagaatgctgttgttccatctatgcgctattgacatctagggccagatatttctttgtttcagggtctgtcctttgcattctagatgtttagtctacccactagatgccattagcaccccaccctaaccaaaagaagttgcagacattgccaagtattcccttggggagcaaatttgcccccactgtcctggtgtgaaatcagagactgaacctggtggaatcatttggtcttcataagaccaagtctaagttttgctcagcatcaattaatagccttctaaaagagtagtttgaatgcctgatcataagatcttgtttatctgtgtttgttgctacacagataaataagacctggctgcagtaattacagacatttggtaaacccacaggccaccaattttctaatttccttctaaaacaatctatgacctcttttgacaattgcaggaatcaaaatatcacccaggccctggtatcacccagaccctcaagttgatcacccagatttgtgttgagggactctatacccaattgttctaaacaaacgacccggagcaacagactcagaattagaaagcctgccttaagctgtttgagcagagtgagccctgcttcctaggactaagagcaatcagccccacttttcagtttagaagctggatggaggccttgttagtcatagtgtttaggataaattgttgaaaagagggcttgcagattgaaaagggagatagataattctgagtttgtaaaggaccccaccaagctttggaatgatttgcataattaaatatggaaaaactcttcgtttttgccctttatcaggactgtgcaaagggcatggcagccacgtgttcttctgggcttaagattacctagttaggcagactgtgtggtttaagagaaagaccaagatttgagtacaataaactgcgaatctgaaattgtcacctattacttgtattaccttaaagcaagttaattatttctctgagcctggtttttcacctaaacaatgaatcgttgtgaggattaaaagagaaaacacgtaaagcatctggtgcaatgccagatatattagaggctacaattatcattatcactgttcaacagtattagaccacaggagtgtcatgcaatgtaggcactcaaaacatttctcttaaatggatgaataaagaacataaattcaccctgagcaaagaacattccttgaaatgtatccacaccacatttttcaaaatttagtaatgctatgtacactcttcccatccccaaccacttaaacacataggcaattcataacaattcttgtgatgccagaatggcagccattttcttttttaatttaagggactttttcattcctctgtagcagtgttttctgaagggaaacacatgtatagcacagagcccagtgcatggtgagcactcagcatatgttaagtgctcagaaagagtcagtgggaaaatggacggactttttaaaacaagatttttttcttttttttgagacagggtttcactctgtcacccaggctggagtgcagtggcaccatctcggttcactgcagcttcaacctcccggactccagcaatcctcccacctcagcctcccaagtagctgggactacaggcatgcaccaccacacccagctaattttttgtatttttttgtggagtcagggtttccacatattggccagactggtctcaaactcctagcctcaagcaatccacctgcctcagcctcccaaaatgctaggattgcaggtgtgagctaccaagcccagcctaaaacaagattctttacaatgaaatggagatgatgttaaataaatgcttttattccaagctgttaacccacaggtccttgaggtactttctggaggcagcaggggtgagctgaccaccagtgatgaacagaggcctccacacagccagtgacctaattagtcaccttcaagggtgacctgaactcacagatttgtcggttcttgggaaactgcataaagatgtcttctaagagcaaagtgaggttaagtgtcccttcagttcccagatcctccaaatgttctctgctgctgtttccccagcagcgattcttcctgccatgtcctttctcactgacattcattttctgactctccctcccacagggatcgccagtggaagttcataatgtgccggatgactgaatacgactgtgaatttgcaaatgtttagatttgccacataccaaatctgggtgaaaggaaaggggccaggggacaggagggtgtccacatatgttaacatcagttggatctcctatagaagtttctgctgctctctttccttctccctgagctggtaactgcaatgccaacttcctgggcctttctgactagtatcacacttctaataaaatccacaattaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcatagtggaggggagaggcagaactggaggagaggtgcagtgaaggttctctacagctaagcctgtttgaatgatacgtaggttccccaccaaaagcaggctttctgccctgagggacatcttcccactcccctgctccacatgagccatgcatgcttagcaatccaagtgcagagctctttgctccaggagtgaggagactgggaggtgaaatggggaaatggaagggtttggaggcagagctgaaaacagggttggaaggatttcctgaattagaagacaaacgttagcatacccagtaaggaaaatgagtgcaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggccaggagttcttctgcagagatggcgctatctttcctcctcctgtgatgtcctgctcccaaccatttgtactcttcattacaaaagaaataaaaatattaacgttcactatgctgaaaatattcagggtcagtttttgctctctactctttcccttgctgattatttatccattcattctgaaaatcctggttagcattgtggtttgtgccaagcaccatgcagaccccaggaataaaatgatgacaatgacagagtgtggtgggggaatcagatatttaagacataaagtgctaaatgctttacttaagattaaacaaaggaaggaatcacatttcttggcctttgagttcagcctaatcttttttcagcatccttcaaccttcctcatcccaagatgtcacatgaatttttaaccacaggaagtccctcttttctttatccacagcagattgccttttttttttttttctgatccatgctgctcttccctcatcctctctcccagtggacccagaagaagagccagccaggcaaaaccacagggatcgcgtaccctgccatacaccccctctaggtggtcaagaaggtgactctcagccagtggtgatggtatttcccacggcaagatcccagcattgtgatggggaaggcagggctaaggatatcttctcctgccttaactcctaaaacactttttcatattagagctttgctttatttcctccatgtcattgtttctgactctctggcaattttaatttataataagatgcttcggtgttatttttcacaaagggagccattaatattttagcaatttcagcctggttcaggatggaaaccaggaaatagccttagttgggtatgtggagcacagcaggaaaggagacaagcaatgctgattggctgacttggcatccatgaagaaagcaaatggctggtgagaggatggggagctgggagggtgcagggagcatggctgggggaggagaggctgcagctgggagtagccaggagactgcaagaggacataagtcaagaaaaaaaactt

SEQ ID NO: 16103 - DNA, 34278 bp, Human
ctcactgcagcctccatctctccagctcagtgatcctcccacttcagcctgctgggtagctgagactgcaggtgcacaccaccatgcctggctatttttttttcttttttgtagagacggggtttcaccatgttgtccaggttggtctcgaactcctgagctcaagcgatcctcctgccttggcctcccaaagttctgggattacaggcatgaaccaccacacctggccaccagtatcactctttttttaaaaaaattttatttttattttaagttctggggtacatgtgcagaatgtgcaggtttgttacgtaggtaaatgtatgccatggtggtttattgcacctatcaacccatcacctaggtattaagctcagcatgcattagcagcactcttaacacacaattaaactcacatgtaatgagattacttctcattactccacaccatagtagtctattttacagatgaggatactgaggctcagggaggctgagagatttacctggagtcaatcaattgttgatctggaagcatccgatcaccaggtcttctgaaataatgacagcagcaacaattaacattatgcttactatgccaaatgctatgcttagcattttacctgcatcacaatcgcgattcctttgggcagttaggtaggttccattttaaccgaatttaaagaggaggaagctgaggctcagagaggtaacttgccctaggtaacccagggtagtcagttaaaaagtcaagactcagacctcgatctgactaactccaaagaaacccgtgccactctgcctctcggaaaacactgcttccagctgcacagttcaaaaccccacccaaggcggccctgaatcgcggtcagtcggcttcagccgaatcgcactttgttttgaacaaggatacagagggcgctgcctgatgttagtctgggggcttgggggagaagatgggggtccagggtggaaatgtaggtgctggggctgtgccagagggagagtgtccgggaccagcgggcgagtcacgtgcgcgtgaaactcgacctaaggggaggggaaaagaagggagcccccgcccccacctcggggcgcagctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggcggccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggtgagcagcgtgggcggggagggggcgcgcgtagggtctccggctatgcgtcggctgagagacaccgaggccggctcccgccgacactgccaggcttcccaaggaaagaccgttacttgcgcccgcggtcccgcggcacagtgtcccatctcgccaagcgcgtccttcccttttcttttctctgacccctccgactcttctcttcctcccgggtccccgctcgctgcacttcctctgcttagagctgcgcgtttgccagagttccagcggacctcctggagcgcttgaacccaaagccccgtttcacagatgagaataccgagtccccctggaagaagtgactggtacttcctcccctctctctgggtctttcttgcccttctcctctccgctttcctcggtctcatcccagttgtcgctccccgcccccgcgctgcccgcgttccctctcctcccgccgaggctgcagcggccgcggcggggggagctggggctctttccctccctttggtaaacacacccgcccgccagcccatccgccaccgctgcccttataaagtcagcagccgccagacttcctgccgaagtccgagccccctcccggggctggaggggggcaagcgggttccgaggtgcaaagcctggtgccccgagccctgcggagtgagtgaggggcgcgcgggggaggagggaaccgaggagagcccgtcctgggtctccctccacgtggcagctgttggcttggcccgagagactgtagggtcgtgggtcacctgatacggaaagggggagggcttgctgtcgcccggccccagagggaaggagaggtcttggaggggcaactggaagatggggtcgtagggtagccttgaacttgcccttcttcctgccagcttctaggggtctttcctggcgcgagagtccggacatgggcccgcggtgcttcagagcgcgctctgccccttgctgtcctctggggacctgggcagatgcggactttctccccagcagcccggccctgagcgccctggcctgggtgagagaacccggcagcctgctaggaagctgcagcgcgcagacaggaccttccttgtttccgatagtggctcagcgggagccccgtgccgcgtgcacctctggcactgctagtgcgcgcggagccagctccttggcaccggctgggaagcccagggctctatggggcctccatgaggggctcctcgcgggctggcccgagaggtctcgggtgccaccatgatgcaggacccttccctggggccactggggggcccttcacccagcgctctgtttctgtgcaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccaggtatgcctgaaaatgggctgggtgggctggggggagggatggcaaaggggcaggtggaagccagaaaaggttaggtggccaggtggacagaaagcagggtcagcagttggacagcctcacttctcgacctcttcaaacttcagggggagattgggtggcactctgcccactgtttcatttatctaatccagtggtcactgaatgccaggtgtcctgctggtcatccagaccctgggactaataggcagagtcctaagcctctgacagcctcaggtctagagctctttgaaggagacgtgctgggagaggaatttcttaatagggctatcataagacaagggagagctgcacaaagtggagtatgaatataaagggccccacatccttcccttttcaggagctgggagcccccaggttttcaaattactcatttggacaaagttacatagcctcatttactctaggagggcattgtggagagtctctggtttccacttcaatcaccttgtgtgagtggccccgaagctgggagtgggaattctaacactctttgggagcagtaactacagccataggctgtctgcagctgccttggggcagggagttaccactgctggtgtctaggacttgcctctgatgggtatcttcctattctgggaaggagagagctgtgctgacaagctccgcctcaggagctgggtggaaatggaattgggctcccctctctttttatcccctttccccaacctctgtgttgtggagtaagcttggaaggaagtttagcttggatttgaatcccagcttccatcacttttatcagttggtgacttcggtgagttccttaaacattgagcttcagttgcctggtcttcagaatggggataataatatcgattccgtgggagtgctgtgagagtctgcagtgcttaataaatgttagtgtccttctcgttgctcctggcttctcgtttcaactccttcctgcacagcacctgatgtggctatggaagaaaaccgattccttgaggggtggagatggggaggtcttgatcactgctctgaacagcggctgctccaccccaggatctgccgcatccagccatggttatctgtaaagatgcaacagatggcaccgagagatggcgactctcccatgcctcctggccccaattatggggtgacaggggctggaggaggtggggttggcagccaggctgggatggctgggtgggttgggaagaagaggcctgacatgaaatgatacacataagagtggctgcaagaaccaagtggagggctattagggacccacatggcatctaagtcccctatgagtttatcctggagataggagagaccctgcctgcccttgacacctgccactgtcccctatgtaacttttttttttttttttgagacagagtctcactctgtcacccaggctggagtgcattggcatgatcttcgctcactgcaaccttctccccctgggttcacgcgagcacgtctggctaatttttgtatttttagtagagacgggctttcaccatgttggccaggctggtctcgaacacctgacctcaagtcacccacccggctcggcctcccgcagtgctgggattatagacatgagccaccactcttggcctaccccttgtgtaacttcttcctgccttctccacctggtgctggtggtgtttctttaaaatcaactttcttgaagattacatcatacattttgatgaggtctgacaaatttatatgcctcagtacccaccacacaatatttagaacctcctcaaactcctgcttctctttagagggctcatccctccacctgcatttttaaatatgtaaaatatgtaaaacagctttattaagatataatttccatgcctcacaagtcacccatttcaagtatataatttaacagttttagtatgttcagagtagtgcaaccatcaccagagtccatttcagaacagtttctttatccccaaaagtaactctgtaccattagcagtactcactcgcctcacccccacctctgcccccaagcactaggcaaccactcatctatttcctgtcatagctttgcctgtgataaaagttagatttacctattctgaacatttcatttaaatggaatcttgtaatatgtagccttttgtgattggctgctttcacttagcataatgttttcgaggttcatccttgtagcatgtatcaggacttctttttattgctgagtaaatactccattgtatggatcaaccaccattctatttatccatttgtcagttgatggagatttgggttgttttcacattttggctattatgaataatggtctggctgggtgtggtggctcatctgtaatccaagcttatttcaaggctaaggcaggaggatcacttgaggccaggagtttgaatgtgcagtgagctatgattgtgccactatactccagcctgggccacagagtgagacccaaatgttcttctggactttttttttttaatttttttgagacagggtctctcactcagtgacccaggctggagtgcagaggcacaatcacagttcactgcagcttcaacctcctgggctcaaatgatcctcccacctcagcctccagaatagttgggactacaggcccgcatcaacacatccagctaattaaaaaaaaatttttttatagagactgggtcatgctatgttgctgagactggtctcgaactcctgggctcaagtgatcctccctcctgggcctcccaaagtgttgggattataggtgtgagccaccccgcctagcccttgtaaagtttttaatgtcgaggtatgctttcatttttcttaggaattgctggtcagttgcaagggtaactatgtttaacattttgaggagctaccaaattgttttccaaagtggctacactatttcatattcttaaaaaaattttttttttatttttgagacagaatttctctcttgttgcccaggctggagtgcaatggcgctatctcagctcagggcaacctccacctcctgggttcaagcgattctcctgccttagcctcccaggtacaggcgcccgccaccatgctcggctaatttttgtatttttagtagagatggggtttcaccatgttgtccaggctggtcttgaaatcctgcctcaggtgatccacccccctcggcctcccaaagtgctggaatttacaggcgtgagccactgtgcctggcctcctttacatttttttaaatttaattttaattttttaatttttaatttctcatatatatatatttttaagactagccaagtgaagcagtgggagtggaaaaggaactggttttgatcaataggtgtaaacaccactgcactgggaccagcctattttacattcctgttagcagtgatgagggttcactttctttgtagcctcaacaatatgtgtcgttgcccatctttttttttttttttttttttttttttgagatggagtctcactctgttgcctaggctggaatgcaatggcatgatctcagctcactgcaacctccgcctcccaggttcaagtgattcttgtgtctcagcctcctgagtagatgggattacaggcgtccaccaccacgcccggctaattttttgtattttcagtagagatggggtttcaccatgttggccaggttggtttcgaactcctgacctcaagtgatccgcccacctcggcctcccaaagtgctgggattacaggcatgagccaccgcgcccggcctgcccatcttttttttgttatagccatcctagtggatgtaaagtttttttgtgattttgatttgtgtttccctactgatcaatgatgttgagcatcttttcctgtgcttattggcttttggtatatctttggagaaaggtctattcaggtcctttgcccactttaaaattaggttatctttctattactgagatgtaagagttctttatgttctagatataagtctcctacatatgatttgtaaaaattttccttccattattgggttgtctttcactttcttttggtgtcctttagtgcacaacagtttttaatattgaagtccaattttctatttttctcttttgccacttgtatcttggtgtcatgtttaaggaactattgcctaatctcaggtcacaaagatttacacctgtgtttccttctttccttccttccttccttccttccttctttccctccctccctctctccctccctccctctctccctccctccctccttcccttcctccctccctccctccttccttccttccttccttccttccttccttccttccttccttcctttgtccttctgacggaatcttgctctgtcacccaggctggagtgtagtggcacgatcttggctcactgcaacctctgcctcctgggttcaagcaattctcctgcctcagcctcctgagtagctgggactacaggcacacaccaccatgcccagctaatttttgtatttttagtagagacggggtttcaccacattggccaggatggtttcgatctcctgacctcgtgatccacccgccttggcctcccaaagtgctgggattgcaggtgtgagccaccatgcccggcctgtgttttcttagagttttgtagttttagctcttatagttagatccttgatccattttgagttgattttgtatatagtgtgagatatccacctggtgttgtaaattgcccagaagtgggtatgcttctaaatctggctgttagggattactagaggtgaccaaagtgaattttttctttgtttctttttttttttggagacagagtctccgtcacccaggctggagtgcaatggcttcatcttggctcagtgcaacctctgccttctggtttcaagcagttctcctgcctcagactcctgagtagctggtattacaggcgtgtaccaccatgcttggctaatttttgtatttttagtaaagatgcagtttcacctgttggccaggcttttctggaactcccggcctcaagtgatccatctgcctctacctcccaaagtgctgggattacaggtgggagccaccgtgcccagtccttttctcagaatttatttgtttttttttgttttgtttcatttttgagatagggtctcactctgtcagctaggcaggagttcagtggtgtgatcattgctgcagccttgaacttctggactcacgtgatcttcccacctcagcctcctgagtagctaggattacaggcatgtgcttccacacctggctaattttttaattttctaggacttatttgtccattcttgcaaagcagggtacaacatgcctatctctacctacctctcttcccttcaagggactccagccaaaatccttgaggctctcgggctgactgtgggtgctgttgcctgatctgcctcagtcatgctgcatgatcaaaagtgtccgttttctgcttcttggaactttattcactttgggtgtcagtcttcctctgcagtgtcccaagaacacagaattagaccaggaatctgtgttgccatagtgtgtggaaagaggcagacttccaactccgctatgtgctgttgggtgattgaagcttaattttctttctatctttctttcttttcttttctttttttttttttggagatggaatctcgctctgttgcccaggctggagtgcagtggtgcgatctcacctcactgcaacctccgcctcccaggttcaagcgattctcctgcctcagcctcctgagtagctgggattacaggtgcatgccaccatgcccggctaatttgtgtaattttagtagaaacagtgtttcaccatattggtcaggctggtctcgacctcctcacctcaggtgatccacccgccttggcctcccaaagtgtcgggattacaggcgtgagccaccgtgcctggcacttaattttcttaatacctcaattaccccatatggtaaaatgggactagtaatccataccttatagcgctgttgtgaaaatgaaatgagggtaagcagataaaatttcagactacggatgggattgttactacattctgaacctggctttgctgttatttgctatgtgaccttatcttctctggatctccattctttccaagtctataaaacaaagtggacaattgtcaacctttcttccaaagagcaatgatttaaggatcaaatgatgtcatttaacaaaaatatgaagagctcaacaaatgaggaactcattattattattacaattattattattttagaaatagggtcttgttctcttgcctaggctggagtccagtggtataaacacagctcaatgcatcttcagcctcctggatacaagtgatcctcatgtctcatccccctaagtagctgggaccacaggcatgtaccaccacgcacggctaattttttattttttatttttattttttgagacagtcttgctttgtcgcccagactggagtgcagcagcgcaatcaccgctcactgcaacctccgcctcctgggttcaagtgattctgctgcctcaacctcccaagtagctgggattacaggcctgtgccaccatgcccggctaatttttttgtatttttggtaaagacggggtttcaccatgttgcccaggctgatctagaacccctggcctcaagtgatccccctttcttggcctcctaaagtgctaggattacaggcgtgagcctctgcacctggcctcggctaattttttattttttgtagagacaggttctcactatgttgccagggctggtcttgaactcctgggctcaagtgatcttcccacctcagcctcccaaagtgctgagattacagatgtgagccactgtgcctggcctggaactcattattgaagcattcactagtatcaactttggggttacctggccacatcctctgacctacctataagggtatcacagctaacggagcctctgtttctcagaatttaggcagaagcagttcaatttatcacaaactactctatatccagcataagtgcccaaataaaacaattgctaaagttctttaggcatttactgtttgttagttagatatttagtcctcactacaaatctgtgatacaggtattatttttattaaccccattttatagaagagaaacctgaagctcagagatgctaagtaacttgtgcaaggtcacacagctagtaaataaagggcagagtaaagatttagtttcacattggactccagaacctttctactgggactcatgggaatagtgtggatgtccctgaccttcagtggcccagggctctcctgggggaatccagccatagacaagacaccagcgagagcccaatcctaagattttgtttgtttgtttttgagacaaggtctcactctgtcaccagactggagtgcagtggcatgatcaatgctcactgcaaccttgatctcccaggctcaagcaatcctcccacctcagcctcctgagtagcttggactacaggtgcacaccaccacacctgactaattttaaaattttatttaattaattacttactattattttttgagacagggtatcactttgtcacccaagctggactgcaatggtgtggtctcagctcattgcgtcctccacctcccaggttcaagtgatcctcccacctcagcctctggagttgcagggactgcaggtgtgcgccactatgctcagctaatgtttttattttttgtatagatggggtctcactatgttgccagggctagtctcaaactcttggactcaagcgatcctcctgtcttggcctcccaaagtgccgggattacaggcataaaccaccacacccaacccctaaggtgtttttgctgaatgtgaccatgtcagaggcaggaaagggaagcatcatggggttaggaaaggaacactgagcagggagacaaagaaaatgggatcattttgtgagtgttcgctgtgtgtgtatgtgtgacaattctcagagccagcctctcaggtggttgagaccacagtccccatttcccagatgagataatggagcctcagagagtttctgcagcacagctagtggaattagaatttgaacccggctcttccagactccaggtgcttcacaaccatcccaaacctagtcatttgcagtttaccttcatgattttaccatttccctttgccatagctagtgttatttacttaataattccttttgaatcagtctgcttaaaaaaaaatagcttcattctaaagtgtaatattcttggaatatcgggtttgctgttacccacccccacacgttatacatatacatgtatgtttctaatacatatatatgtacgtatatacgtgtatcgttttttgttattttttttgttgttgttagttttttttagatggagtctctctctgtagcccaggctggagtgcagtggtgtgatttcggctcactggaacctctgcctcctgggttcaagcgattctcctgcctcagcctctggagtagctgggattacaggcacccaccactacacccggctaatgtttgtatttttagtagagacagggtttcaccatgttggccaggtgggtcttgaactcctgatctcaagtgatccacctgctttggcttcccaaagtgctgggattataggtgcgagctactgcggctggccaatgtatgtttttaatacacattcaaataacgaataactatgaaacctgaaaaactgctccatgttacttcctgaacccatcttgagtgctcacatgctgtgcataccacatattgggaaacactgctttccctggcttccaagcccagcttaatcactgtcccatcctatgcttcgctttatttgtctataaatgttggggttgggggttgatgccaaagaccttttctgttgtcattaacatggacacagctctaagaggtcttggcatcttgggctggctctccttttagttcagaatttggatttttatccaactactcagagtgatcaagccttccttatgaatgaactcgttggtcaaactcataaaaggctgatcgataaaacaggaatgaatgtatgaattgacactaagtcattagcatttcacgggaatggattctccgttagtggaagagcacatgtcctttctggcactgatgtgtgcttgggaaacttactgagctaactggcccatgtaacacagaggccctttggtgcagtggaaaactgttgactttggagattatcttgagtttgaatctgagcctgcctgtaagaagctggctaactgaattgctttgcttcttggacccttaccatttataaaatggggaccattgtactcaccctttagggttattgcatggattaaatgggattctctatagaaaatattggcacaaagtaggtgtaaatttgcacgctagtgggattgtttgtgagggaaattgtcatttgattatcaaagacttaggagcaggaacagtgtctaattcagggactgcaaatggaaatgccagctgaggccaggcatttgctaataattgggtaaagcagggcaggtgtagaatagcaatgtctgggaattaaaagagaggtgaggacgtgtatgaccttgagaaggcaagccctggcaaaaggggatggcctccactcagctacagtcatgcctagatcttctaactttttatttttatttttattttttgagacggagtcttgctctgtcacccaggctggagtgcagtggcgcgatctcggctcactgcaagctccgcctcccgggttcacgccattctcctgcctcagcctcccaagtagctgggactacgggcgcccaccaccatgcccggctaattttttttttgtatttttagtagagatggggtttcaccgtgttagccaggatggtctcgatctcctgactttgtgatttaccctccttggcctcccaaagtgctgggattacaggcttgagccaccgcacctggccgatcttctaactttttaaagagaagcaagacatctggatttttatgtgataactcctgattttaaactggcacccaattataatttacaacactataagggtcaacattgccagcagagcaaaacatgggtgggggcaactgctggtcaccggtgtgcagcctctggtctaaaatcatctttgtatttcttcttgctttacgcattgtcccagcacagtgctgttgtatagtaaatatccagtaagtgggtgtagaatgaataaaccaatgcagataaacctgtagagaggccgggcacagttgctcatgtctgtaatctcagcactttgggaggcccaggcaggcagatcacttgggcccaggagttcgagaccagcctgggcaacagttgaaacctcatctctacaaaaaatacaaaaagtagccaggtgtggtggcatgcacctgtagacacacctactcaggaggctgaggtgggggtatcacttgaactcgggaggtcaaggctacagtgagctgggaagtcaaaggtgcagtgagctataattgcaccactgcactccagcctgggagacagagtgagaccctgtctcaaaaaaaaaaaaaaaaaaaaacctgtagagaaatgacagtgatcataaagatcactaaattatagggctagcctgatccccaaaggctgtgtggtccaacccctaagtgcttcctggaggtgtctgagcactttccccacctccttggcagctggtactgaagaagactctctgttgtccaggacagttccttccatggctggtcaacactcaggatctgccaggcctttgtgttcttccttatgtcaacacacagattcctttatctttactcttctgccacctgcatgacctttggatatgtaaagtcaggggtcattttcactactgagggcagatgtcctctaccaccccctagtatccaggcattatcacatccccttgtccccttgttggtttttttgtttcctttttcttttcttttcttttctttttttttttttttgagacagggccttgctctgtcacccagactggagtgcaatggtgtgatcatggctcactgcagcctcgaccgcccgggctcaagcaatcctcccacctcagactcccaggtagctggaactacagacatgcatcgccatgctcggctgatttttaaaatttgttttgtaaagacaaggtttcccaatgttgctcaggctggtcttgaactcctgggctcaagagatgcacccaccttggcctcccaaagtcctgagattacaggtgtgagctactgcacctggcctggtttgttcttttagcagcacctgtcactctagagctgagaacttcctgtctcatgtagtgtggatgcccagctcctagagtacgtgcttaccacatgacccaccaggagggtcagctaccccttcctcagatccttcaggagcactttctctgggccaggcactgtgcaaagctctttgtttactgtctccaatttaatcctcctaaggaggtcgtgggttaggcattctttggtccggtttacagacaagaagaaagttacttggtcaaggtgcacagctagtaaggctggtggtgggaattcagaccctggtctgtctgcctgctccaggtgcaccctgagtttgcccttggcagtgctgccaagtgacaacttggaggcctgggggcagccacctcatgactcactgagcattgagtaaagcgaagcagccctttgtctcctatcactagcttttctccttaacttgtcacaactccaagttggcagtttaccgttaaggacaagtcctccaagtggacttctagaggggactggagggcagtgcctggttctcattctgtgcctcagcttcatcacctagggaacgggatactttattaactgacttataacagtgcctggagcatagttaagtgctcaataagtattagctattattttatcagactatcatttatcgggaaagcttcctctaagttttagtgttctttctaaatttcttttttttatttagagatggggttttaccatgttgcccaggctggtctcaaacttgtaggcttaagcgatctgcctgtctcagcctcccacagtggtgggattacaggcatgaactaccacgccgggccattttaatgaattcttgttatagccattagagtaccactcactgcctttgcctttgcctctagatatgggggcacttcttgttgggggtccacaaccccctaagcttggacactgagtgcatattacaacttagtaaatacttttatgtccagtatttcatttgagctagttgaagcctcaggctgtgtgtgcacaagactctcccagggtcaggtactaatggctgccatttctggagcagccccatcagaggagatgtgactctagggtacccccaaaggcacttggcatgggatttgaaagcaggccgcctgactgtgggctgctgtctcctgtgcccagctgttcctggtgtcatgtgctgagccctcccttccccctcctcagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcaggtgaggtggctgggctatggggaacgggaggacagggaccgtgctgcagggggaggggagggggggtgctcacaggccaacccctcgcccttccctgtgtctccacagtgcctgcttcactgcgtcctgcaccctcatggccctggcctcccgggacgtggaaggtgagttgtctgtcctcttgtggccccacaagaaaagaataggtgggatgaaggcggatgtttaccccagctcccgcccttggcttcccacagctccccaaatgccctcatctgctgctttcccctttccagctctgtctccgttgatattcctggcgctgtccctgaatggctttggtggcatctgcctaacgttcacttcactcacggtgagtgtcacaggcctggcctggcagcagagttcccccgagtggggtgagggcagagtgagtggggtgagggcagtatgaatgggctgggggaggggcctgtggacgcagatcactagatcaagtgagtgtgtgagaaactgtgcaggtggctgcaaagagcaggtgtgaggctgtgtgtgtgtggatgaggctgtgtgtcggggtgtatgttaatgtgtgtgtttgtgtgtacagagcccatgaatgtccatggagctctgttctaggtcctggactacagcacaatcaggactgaccgagtcatcctccctgctggaggttacattttgggggtgaggggcacagataacccaataaacaagtaaactaataaattatgtcagtcgtcataggtgctgggaagaaaataaaactgggtaacatgatcttgagggggagggagcagcttgagatagcgtgtgcacgcttgccatgtcgtgggagagtgggtgtgtgaccccgtccctgtgaaagccatgagttggtaggtgtgtttgtgagtgtactaggttgaaccatatgaaattgtcgacacctcgtcgtgcacatggcttgacctattacatgtggtgagtggtgtatgtgtgttgctcaaagtgtgtttatttatgtgagtgtgtaaacgcgttaaaggcttaggagtgttaaaggcttagggaggttggaggggaaggttcctggccgggctggctcggactgtttatctctgagaagggctgcctgactgggtggttttggctgaatttcacctctccccagcagccgcctttaattccaaccggggacatttcacagctctaaaggaaggaagcggatccctttctccccgcccctctgcgcagccccttctccctgctgtgcaacttggcccagggccctaaatcccttctctccggcgcttgacctcagaccctccctggcggccgggtggggcttgtccagcggctcctccctgctatgtccccgcctcctgtaatctccagccaatggcagggtccggcgctggcaccgcccctcagcctctccccgctccctctggccggccccgccccctgggccgctgctcttggcccagacttggacgaggacgtcccgtgctgagtcttgcgggcccagctgctgttgccacgcacgctgcaaggccgccagcccggggttagccggccggcctcgccttacccacggtactgggcgcagacagcgtttgtggccccttggaggggagggggccctgcccctctccaggcctggcagccttccctggcgtccttggcagtggtgcctcacggatgcagggtgcaggaaaacctctgcctgagtgggtagaggtttttcctgagccagccacttcaggggaagggggaaggataatttagttatatgtgtttaaacaccatttttttttttttttgttgagacggagtctcgcagtgtcgcccaggctggagtgcagtggcgcgatctcggctcactgcaacctctgcctcctaggttcaagcaattctcctgcctcagcctcccgagtagctgggactacaggtgcacgcctccacgcccggctaattttttcgtattttagtggagacggggtttcaccgtgttgctcaggctggtcgcgaactcctgagctcaggcaatccacccgcctcggcctcccaaagtgctgggattacaggtgtgagccactgcgcccggcctaaacgccttttttaccagagctgttgaggcctcccttcagagtctcagtttccccctctgtggagtgtgtttaggctttgtacggatcctaaggtccttctcagctgtgggatctagtgacttggggaggatggtggggccagaggagggtgtgtgcgaagggcatcctgactttgccttcccctgccctgagggcttggctgaggcaggtgagtggaacacatgatcaattaaattctctcctggtgtgggttctgaccctgctctgcgtcagagccacctcctctggagactgtctgccctggctcagttccctcccttatttccaccctcacctcccaggatgtgatttgtcctgattaggcagaaactgggctgggacgtcaaccgagagggttaagaggcactgcctattaccgggacacagccatggtcacagccttgggttagggctgggacaacgacaatggggagaaagccattaatgtgctctgtgaacttgagtacacttttcctccctgggtctcaattgtctcatctcaaatgggttggacaagatcactgtttctttcttttcttttctttttttttggggggtggggacatagtctcgctctgtcacccaggctaaagtgcagtggtgcgatctcggctcactgcaacctccacctcccaggttcaagcgattctcctgcctcagcctctggagtaggtgggattacaggcgcatgccaccatgcctagctaatttttgtatttttggtggagatggggtttcaccatgttgtccaggctggtcttgaactcctgacctcaagcttcccaccagcttcggcttcccaaagtgctgggattacaggcatgagccactgcgcccagccaagatcagtgtttcttaagcacctattccatgtgtttttcagaggtgttacgtaacaaacttgggaaacctggaattaaacaaaattaacaaaatgtctctctgaggggtgtctgggagcctttttgaagctaaagggcactgtgactgtgtaggcagggggcagagtacagtttcccacattgatttttctgtttgttttaccttggggcttttctgctgcgtctcctggagctattgtatggagcagggctgggaatgctgggcaagggtcacggtgtccccacctcatgggtgctgctttccctcctcagctgcccaacatgtttgggaacctgcgctccacgttaatggccctcatgattggctcttacgcctcttctgccattacgttcccaggaatcaaggtatgaggccacctgggttttctttttgtcttgacacaagaaccgggtggggccgagtgagcagcagctagtgctgacccacgggtctgacttctccgctctcctttctctgtcatcatcccaatgcaggccttccccctctctcctgggccacagcaagctttctcagctggtctccctgcctctgattctttttctctgtactctgtcactcacgtgacttccagaaagatctcagatggggaactggctcacacactgctgaaaaaccttcagtggtttagcttcacctacagaatcaagtccagccccttcacatgcgttcaaggtccctgactctctggctttattcagcctttggggccacatttttccacaccttccagagaggatgggtggtttggtccaaggtcacaaagtgagtttatgccaggctggatcctggacaggtcaacctggtgtacctcgaagccaggggaccaaagttttagctcagtgcaagatgggggcctcaatttcctctgtcaaatatcaaaggaccctttgactgagccatgccatgctcctcaacctccacggtgggcagtaccaaactgcataccgttttgcactttacaaagagtactaaagaaggtacttttgctcagtgtctccaaaggagtttgagagagcgcatgggtgggggggccatcagttgttctggtgggcaggcatggagggtgggcagttctcccttcttttcaactgaagtagtgtttgaagagccagatcttacctccacacatttgggggtgtggccctttgaagctctgtcctgcccctagggaggaaaaggcaccaaggtccaagactgcagagaaaaaggtttgagcaggagcctgaggggagagcagacattaattatcctggtcagatggtatggggaggacaagaggacagatggtgcatcagcttcttccataagaagggctgacacatttgcacagaatctcattcaattgagaacttacctgccctggggttgagagcccttgggcagagcacttgcacctccctctccccaacccccccagttgttgcacgtgggaggacctgggaaaggtgagaaaaggctgagcatgagcagtctgggtttgccttttcccctggggaatgtgccaggaaggggcaggataaacacgattaggcccggtaaacctagagcactaagtttcctttgtacgtactatgaaatggacatttttgtgcgaacatgaacatgaatgtttgtggagtcataggcaaaaatgtatgtatttttttaagataatggaaatttcagagatattttgagccagtggccagcaacttcaggctttgtggagactatttcatagctctctagggggcctcaagtgaaaaagaaaaaggaatgatgggtcttctgagtctgactctaaacttctggtcttggtttcctcatctgcaaattgggcacaaggacaaggggagaagagaacttctttaaggcctctgaggcctgggatctaccttggtggggtctggggccaggcagtctcccccacgggcctgccccctcctctcacagctgatctacgatgccggtgtggccttcgtggtcatcatgttcacctggtctggcctggcctgccttatctttctgaactgcaccctcaactggcccatcgaagcctttcctgcccctgaggaagtcaattacacgtgagtggctggagtgggcagagactctccctggggcagagagggctgtggtgatatgatagacggaattaactttggattcagagagacctcggcttggacctctgcttggcaaatcgcttgagccctccaagctctgctttctcatctgtactatgagcctgttcctacctacccacaggtcgcttttgtttgtttgtttgtttagaggcagtgtcttgctctgtcactcaggctggagtgtagtgtcttggtcctggctcactgcaacctaaaactgctgggctcaagcgaacctctccctctgcctcccgaggagctggggttacaggcacacaccaccatgcccagttaatttttttattttttgtagagacagggcttactgtgttacctaggctggttttgaactcctggccttaagggatcctccccgcttgcccttccaaagtgtccgattacaggcgtgagccactgtgcccagcctcccatgggtgtttttaagtaatacagttggcacataacaggtggtcaaaacatggtaaatatttatttatttatttatttatttttgagacagagtctcattctgtcgcccaggctggagtgcagtggcatgatttcagtgaactgcaacctctgcctcctgaatagctgggattacaggcacgcgccaccacacccagctaatttttgtattttttagtggagacggggtttcaccatgttggccaggctggtcttgaactcctggcctcaagtgatccgcctggctcagcctcccaaagtgctgggattgcaggcgtgagccaccatgctcagctcatggtaactatttatgtgggtgcaaaagtaattgtggtttttgccattaaaagtaatgggccaggcgcagtgggtcatgcctataatcccagcactttgggaggccgaagagggtggatcgcctgaggtcgggagttctagaccagcctgaccaacatggagaaacaccgtctctactaaaaatacaaaattagctgggtgtggtggtgcatgcctgtaatcccagctagtcaggaggctgaggcaggagaatcacttgaaccctagaggctgaggttgcggtgagccgagatcgtgccattgcactccagcctgggcaacaagatcaaaaactccgtctcaaaaaaaaaaaaaaagtaatgacaaatactgttttcatcctttctgggtttggaggagatctgagtaggaggcacctcagcaatggcactcgatgccatgtggtcccaaaaagagggacataaaagaatcaagcaccccatcttttgtggagccacctgaatgccaactttttccagccccctgtcagttcagcagaggcaagaggtgatactccacaccaagcacataaggtgacattacagaactgacagttatgccaggcactgtacttagcccctataccatcctcaaacagctgtatgatgtagattgggtattaaccccattaataacaaaagtacagggaacaaagtgactttccaaaggtcatgccattcaaaggagggtgaatcttaggttggacgcaggctgtctgactctggagtctgaggtgttaatgctgcctcctccatgggaacagcccaagtgaaaaacagctgatccactcttcatttacttggcatctgtgctaagctggtccctgagccaagctctgagcaacagaaacagaagctctgcattaggagcttgtgagcatgtcaatgccgggtaaaggagtgctggaaaccgctgggatggccgccgagcactaggccgttgaaggtgggctctgtgtgactggttcctctacactctggcctggctgcctgcaggaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagagtgagtgtctggtcaaggtgccggccttgggggatagtgatggtgggtcctcatattcagtgagcactcatggttgagtatttattcgcacccctcttcagtccttacaacaccccatgatgtaggtggggcatgctcctcatttacagatgggcacatcaaagctcagctaacgctgggaagttcagattcagggttaccctgctggattcctgggattggggagggaggagcttccaaaatggggacaaggtctctgggcctgtcgggtagctggtttcctcagggccccttgcaacctctgagcttattgcatcaggtgcagccaggcccgtgagcctcctggcaggggtcctccacacctggctgtcttttgccccctgctggtcacaggaggagctgcagcacctgcctgggctgcttctcaggagggtacatgaagatcccaggaccgccagctccatgataagtggaaggagctccttggagtcaggagcgggagttgaggagtttgagtcctgctctccagttataggctatgtgacttgtgtagatcacctaaccttgctcttgatttccttacctcttaaactagcactaaaagcaccccacaaactgtaaagttagttgtgatgattgaatgacaccatgggtgtggaagctctttgtaaagtgcaaaacggtgtgcagtttgagggtggttacccccagtgccgattctcagagggcaacatggctaagggcacgagctggagttaggctgacctgctgcttccagccctgtgagcttgagcaagtcatttaacttcctgagctgcagtttcctcatcagtaaaatgtgataaggatagggttgttgtaagattttattaaatggggtaataaatgtcaagtatgtagcccatagtgagtgcttcagagtttttttcttttgtttctttcccccccgccccgagatggagccttactctgttgcccaggctggagtgcagtggcatgatcttggctcactgcaacctccgcctcccgggttcaagcaattctcctgcctcagcctcccaaatagctgggactacaggcgtgcaccaccatgctcggctaatttttgtatctttagtagagacggggtttcaccatgttggccaggctggtctcgaactcctgacctcatgatgctcctgcctcagcccccgaaagttttgggattacaagtgtgagcccccgtgccctgccaggttttttttttttttttttttttgtaaaacacccacagggtattgctgttgcctgggctggagtgcggtagtgcaatcatagttcactgcagccttgacctcctgggctcaagtgatcctcctgcctcagcctcctgagtagctgggaatacaggtgtgcacaaccatgcctggcttatttttatatatatatatatatatatatatacacaaaattgtatatattatattattatatattatattatatattatattattttttatatataaattatatatatatttatattatattttatatatatatatattttttagagatagggtcttgctatgttgaccaccaggctggtcttgaactcctgggctcaagcaatcctcctgcctcagcctcctgagtagctgggaatacaggtgtgcaccaccatgcctggcttatttcatatatatatatttttatatatatgtatatttatatatataaatatatatataatttctgtatataaataaataaatatatatatatatatatttttagagatagggtcttgctatgttgaccaccaggtcttgaactcctgggctcaagtgatcctcctacctctgcctttcaaagtgttgggattacaggcgtgagccatggcacctaactgagttatttttaccacacgaagcataggacatacatccaaaaatgttctgagctgagcaagagcctggaggcaagtgaatctgaactttcccgtctttgaagaaaccagtctctctccaaagtcacatagttagtgtcactccccccaagaactgcatgagctgggacaatcagagggcagtggaaggtctggggctcaggggcgccccctgctgtctccccagggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatggtgaggcaccgctgaggcccctgggggttgggggcacaggcgggtcaccctggctgagctcccctcaccatacgtttccctacccacagagacaaatgaacagcaacaaaaggtggcagagacaggtagggctatgaaagcagggccctggctcacgcccaccccactgcaacccgcttctcagggggcgggactcctctaggcctgggcccacccaggtaacccttttgtgggatgtaagagtctgggttcagaggaaggctattttggtgctctctggcctccgctggaaggggtgatagtgtccactgagtgccagttcctgaccccactgcccttcccatcctgcccagttgggttctactcctccgtcttcggggccatgcagctgttgtgccttctcacctgccccctcattggctacatcatggactggcggatcaaggactgcgtggacgccccaactcagggcactgtcctcggagatgccaggtgacctgcctgtacagggatggtgacagcaagtggtcaggcagtgcttttcattttctctgtgcgtttacatccagcagcttgttgctttctcccaagaaccctaggagatcaggggtacctccccattttacagatgaggaaactgaggctaggaagggacctggcttgcttaataataagaatagctaatgcagagtgctgactgtgcacttggcaccttgccttgtttagtcctacaacacctctttgaggtagatgcgttaatatcttcattttgcagttgaggaaaccgaggtacagggttgcacagttaggtcattcacccaagatcacacagctttcagtggcagcctccagaacctgtgttataagggtacacgctaaagtcttgttagggctagaataggtagagttggtatattagatatttattgctgtataacaaatcaccccaaggcttggcattttaaaacaacaaacacttctcatctcatacagtttctgacagtcagaaatcagggagagactcagccggctgattctgagtcacagtctctcatgaagacatagtcaggctgtcagccagggctgcagtcatctgaagggctgactggggttggagaatctatgtcagttcaattacccccatggcctctccatagggctgctcaggacacagcacctgctttcccttgagcaagagggctaagcgacagagaccccgtatcttctctcacataatctcagacgtagcataccatcacttctgttacgttctattataggcacagagcaaccctgatatactgtggaaggagactggacaaagcaggggaataccaggaggcaggatccttgagggctgtcttgttggctggagaccaccattgagggtttttttttttttttttattgagacagtcttgctctgtcgcccaggctggagtgcagtggcacgatctcagctcactgcaacctctgcctcccaggttcaagcgattctcctgcctcagcctcccgagtagctgggattcaccatggagtcttgaacccagattctgtgactgcttttgctctttttgtgttcatccaaacagtccctgtttatcctaagaggatgggagaaagagactgggagagaaggaaatccagtggcctccctccctgctagcagagcctggccctggcactgagccttcctcctctaccctctgctcctaatggtgagggtcccctagcagggcccttctgtccaggacacatgggccgcctgtcctcaccccagcctactgacctctctcctgggctggcctcagtgcccttgattgtgccggagagaggaagcgctggacagtcaggccaagctgctgtccccaggagggcatctgcttatgtctagggcagggacaccttcctgaggacttctgatgagagacggtgtgagagcttcccacttcccaccttccttcccatccttggttctcaaaccttcaagtgtgcatgagaatcacttagtgggggatatttgtccaaatgcagatttgcagatatccccgctgagattctgagggccgagatgaggcctgtgaatctgcatgttaagaaagcacccgctttgatgcgtgtgtcattgggtaggggagcaacactttgagaaacatggagctagagaacgtgggtttctatgggtttcccatagaaacatggatttctgtgttttctgctgccctgacatcgaaggcacatctgaagggggaggggccaggccaagaaccagggagtcctgggaacgtagaggcagcagccagtgacttcccgtactcctcagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccaggtacccaccttcatccttcccctctccctgcctcccgaggctcctccaaagggatggtccatccagcacctgccttccaggaagcgcagttctggtcttctgatctggatctattttccgggttctccaggaagtgtttctagtagattgggttggcgagggggtgggaattgaggcccagttggcctcttcgccctacccctccttcctccagcctccacacactctcctaacctcttcactctctctttttggttttagtttgtgacctttgtcctgcacaccattgttcgaggtttcttccactcagcctgtgggagtctctatgctgcagtgtgagtctgttgggctgaaatgccttcctgagctttgcaaccgtgatcagagaaccccagggaagggttgggagggccccaggcatcccctaatgcacctctctctgagaccctctgatggcagggagctcacttccttaaaggcagcctatcctgctgtaattgactccccctgttggagtcttcccttagaggaagctgaaatacctggcttgatgacactttggttctatgtctgctgtttgaaacggcccccagaatggcctcccctccatgcccaccctgaagaaatttcccaagggcagccatttgccttataattttcctcttcatgttggacagtccccacttgcatctctctcctggtttcccctgctgggcgctgctgagggactctcccctgtgtatgtgatggagtaacaggacattacaataatgatgacaaaatgacaaccattatcaagtgctccgttggtgcaggcagcaggcaggatccttgaccatcactccctgagttcagcctcactgcagcggtctcggcagagggcagctctctttccttcatctgctcaagccagaaccctggagtttccttgatgtttctctccctcacactccatgttcactccgtcctcagtacagccagcagcagcttctacacaccccaaatctgacccttcttgtcacctccactgctgcctctccagtcctagccaccaacatctctagcctggattattgtggcagcctttagtctcccacatctgccctggccccgctgtctcagtctatttttaacacaggggctgcagtcacctgtcaggacataagtctcttcacatcactctgtggtgtcctgtctcatctgtctcagagtaaaagccaaaggctttactatggcctaaaaagccctgcaagctctggccccagcacttcactcccctctagctccccctcctccattgttcactctgccacagccacagtgcttcctagtgctccggaagtctcaagtgtgttccctgcttggcatctttgcatgtactagtccctgtttctagaacattcttctccagatatctgcaaggtgcccaatcttaccttctctccttcttcaggtctttccctgactgtcctcttctcagtgaggcctcccttggctgtcccatgtacaattgcaacctccctactgcccgcttctctgcttggtttttctcagcgtttatcactaacactctgcctatctcttgcttattgtctgaccgccacctgctccatgggaatgccacctcctcgatggcaggaatctgttgacttgcttgatcgtggtatctccagcacctagagcagtgcctggcacatagtaggttctcagctaaatgtttgttgacagaatacagtggacagtcctgcgaggtcaatgccatccctgttattagtggaggaagtggggctcagggagtttgagccacttgccaatatcacacatacaggaggtgtgagaacccagctcagtggccctgaagttggagcatttgccctcaaggctggggaccaaagagcccatgcaaagagcccgaacgcttaagcaccaccctgcctggccagcggggaccatggtggggaggggataggagaggtgctggcctgggctggagagggccacacacccctgatactccccgtctcgtggacaggttcccatccaaccactttgggacgctgacaggcctgcagtccctcatcagtgctgtgttcgccttgcttcagcagccacttttcatggcgatggtgggacccctgaaaggagagcccttctgggtgagagcgagggttggtgtggggggagcaggagccactctcctgggggcaggggtagggccttgtatgtggtgccatccctcactcatctcagccagaggcacctcagaggtctctaatctgcaggtttccaagttgtctgccttttagaacccctcacggagtgttaaaaatacagattccccagtcccctgaatcaggatatctcagcctgaccgtaggagtctgtttttgtttttaatttattgttattttatttatttatttatttttatttttattttttgagacggagtctcattctgttgcccaggctggagtgcagtggtgcgatctcggctcactgcaagctccgcctcccgggttcatgccattctcctgcctcagcctctcaagtagctgggaccacaggcgcccaccaccacgcccagctaattttttttttttttttggatttttagtagagacggggtttcaccatgctagccaggatggcctcgatctcccgacctcgtgatctgccctcctcagcctcccaaagtgctgggattacatgccttagccaccgcgcccggccctattgtttttttttttttgtagagaaggtgtcttgttctgttgcccagtctggagtgcagtggtaaaatcacagctcactgcagcctctgattcctgggctcaagcgatcctccggccccagccttctgagtagctgcaaccacaggtgatggctaccatacctggctaattttttaaaaaaaaattttgtacagataaacagggtcttgccatgttgcacaggctagtcttaaactcctggcctcaaatgatcttctcaccttggcctcccagagtgctggggttacaggcgtgagccacagtgcctgacctcctaggagtctgtttttagtaaactccaggtgctttgtgaagtggccagtcctgactcttgggcctgtgttcaggcaccattggtccaatccagttctacctagtgtgggatcctgtctccagcacccctgaaaggggacccttccctcttagcttagataccctcagtggtagggcacccactcctgcacgaggcagccctgctgctgttagtaagtcttttccttacattgaactcatctgcctccctgacgctgatctttcatctgccctgtggggccacccacacgtaaaccctcctcccaaagaattgtgatgaaataactgcttctatttaccaagcactcactatgtgctaagcatgatgcatacttttttttaacttacatcttcgccacaacagccctgagaaggaggcactcagtaagaattgccattatttgcccaaagtcacacagtgagtaatgcagagtgggatgtgaaccgagtcagagcccgcgtgtcctgggccttccaagccttctgtccaccaggctgtgcatcccagttccttgaactgtgtctgagagcctcctctcgccaccctgaacgggatcccattggttaacatctccaaaggtcagaggggtgagcccagaaggccccatttcgggagcagcctgaccagcccagactcctacagtgctgtgccttcctcatacctacctagtgagtgccatatggtgtgggcacccaccaggccctgccacttgttatacctgagaagtctcatctcagccactttgcagaattgctgaacattaagtgagatactggtggaacaatgactacacataataagtactagctgtatttattctggctcaggacctggagaaaaatggccgccttctcctccctgtgggaggctaagggcagatgactacctacttgactctgtttctctctccttgccctaaaggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgagagactggctggtgtgcgcctgtctttggcggttggtggggggtgtcttcccacacccccatccttcttcacccaggctcagctgggcattaactaggacgcttggcatgccagcccgttcgcctctggctgtctggctcacctccctgttcccaaccatgccctgcccttagtgcttggagggagtccagctcctgccccctacttcccaggatttggggtacatccaggaagctggcttttctccatacagaggattaggacagaatgctttagaaagaatgctaaggtatgactcaaacttcccaccatagcatccctagggcctgccgaaagtaacacttttttggagtctcctattttatcttaaaactttatgcaaattttgagcttccttgttatactatatttacatttacctttaacattaaagtgaggctttaaagtaaataaataaataacgtgaagctttaaaattatctatatcaagagaagacaccatcagtgaggacaagagatcctgcagaaagacataccttatttatccagccctgcacctgcttgtgcctctgggacataagccctggaggttagagcaagtccccaaatgaagggaaaactaacattggtttaggatctgtctgttctacacagctatctcattttatccaaactatagcctaagaggttggtgttgtcattctttcttgtcgctgtaggaaacaagcccagagaggttaaggcacacacccaagggcacacagtgttaggtggtggagctcaatttggaacctcggcagtctgtggaaaggatagctctgcagaaaggaggtcccaagcttctttccggttctcagctgctcctggggccaagagtgacctcagaggccttggccatctcccccacctccaaaggttggctctgtaagacagcattccagctaagccattttccctccctttgtctttgtttctcttgagaagttaataagagagactgtcccctccgttttcagataggaaaacctgtcctcaggggtctggagacttggcaaagtcacatcgcagatccctgctgctctgagcccagactcccgacttccaacactgactttttttgtttttgtaaagtacaaaatcagaattggctagcacccaccagcgggttcggctggctttcagtaggcttgccggggtctctgcactctgtgtccgggatcctcaatttgcgaatagtctggggaggctgagcgcgagccaggagcggacccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcctaggagaagggcgtctgctcactcccccactccccggggcttggggagggggctgggcaggggcggaagcgagctggagccgtgtttgtcgcggcgctgcggagtggaacagatggctggggaggggagagggtgcgtggcggggaggaggaggggtgcgggggccggaggatagggaacgaggaatttcgaagcctggagtctcccaggagaagcccccctccccgtcttttcccagaaaggggggcatatatgcgcctgcctttttcccggagagccctggcctctgccctgtggcagaccctgccgcgcaatcctctgccccagggcgcgcccctcacccccagacccccgccgcgggacggggtggcggggtcaggaccgccaggagcggcccgggtcgcgagggttaatggggccgcc
